United States Patent 9,328,346 (POLYCOMB-ASSOCIATED NON-CODING RNAS) - sequence listing, part 125

SEQ ID NO: 191403 - RNA, 246437 nt, Homo sapiens
caacuguuuauacugguuuaauccaugucaaauguaguuuacaaagggaaaggacaaguaccuuuguauagaauauacagacacagcaucacaccacagggcccacgggagggucggggagacgacacuuuuucccugggaaaggcagcucuaaucccaggaaugguucucagcagaggcuggguggccaggagcacuguccucuagcccccuaacucagccucugcuucagcucgguucccauuuccugccucuaccccccaacuccuuauaaagagccccaugagcuaagacuaaggagaggaucaugucccuuggggcgugugccccaugucugggagaagaaauauacaccacugaacaccgagcacaugggagagggaagggacaccacaggagagagagaggcagguaccccaagagguggaugggccgagcucccagccaacccugaaggaggcgcugcuuccagggguucuuaaaaaagaagaaaaucauacaaccaaagggggaggggacagguagagggcgaggaguugucccauuuauacacaacauuguaaacauacacggucuauauuacaugugcuucagucugguguuugcaugucugucuguccgucugucaguaugggggcuggaucuuaggagccgugccccacuacucccccaacccccaccucccugccccacccugggaacagagcuggaacagguauggcccccaaaccauaggugggagccagcagguagugccugggccacagccucuacucuggcuccagaguccugcguguguaaauguguguguguguacgcauguuugaguaugugcauguauguacauggggaaccugugugcaaguauguacaaagggagacggucacugucacagaggcugggggcagguggggcugcuggaggcgaggccugccuggggcagauagcucacaaguagauccuccgcaggucuccgggcgcugugaucguguugcacugagggcagagcuucuuggcacccugcagggagaacagggagggcucuggucuacacaaugagccaugugugcgcaugugagcaccugggccugcagccaugucucucugcaccagugugugcugagaccuugguccugucagcccaggcuggggacgcauaggcagcuucugugagcaggcaggcacgcuccuguguuggggggacgccaggaucaaaccgccuggccagccccgcagcaggagccccaguaaugagaacaaggcuggguccagcuguggcagccgcagcccuaacgagauuacacgcggccuuugaucaggacacagagcccacguccgagccuuuuauuacugucuccgggcgacauuuuaauggcugcuccugagcgaagaacaggggcaggagcagaaggagcuuaguaaugggagggggaggggccaaggcccugguccuguuuaccuacagccagccuccuccugaccccaggccucaccagucugugugaugcagugggccuucggggaccggggcggggaagggagaaugcagugaacucauggagggggagaaguuccuaaaccugcaguuggggaggagaggcagcgagccuggggguaaauauccugcggguaaauauccuggcuccuggcucuguucuccuuugcgccaugcuccccacuucccccaggcaggcucaggcauaagcacagacaucugggcagugcccggagcggccucccauuccccgacccccaugccaccucaccaggguccgcagccagcacuccucgcagugcacgugccaacacuggauggacguuaggggcaucgaguacgaguccuagggaggagggggcagagaaggggucacucugagguaggcccacccucuccaacucccccagagggcguggaagccugaccaagggcaccccuagguucuuuucuacucaccaugcagaugaggcauuuguaacgguccccacgagauagcugccguucaaguucucugacccgagccuucagagccucaaacguggucacagcugaaucuucggugauucuguaaaaaggaaggcaugguuggguagcaggcuggcaucucucaucuguaccuccagccuacgccucccuugaauuccagaaccaaauacauaaauguccccuaggcaucccugccugcccccuuucucugauaaccugaaucugcaaauuccacauuccagaacuaaacuccucacccucucuauuccuccauucccauucggaugaauuucuacaccagauaccagggaaccauuuucaaccacuccuucgcagucuucccaaccacccaaaucugucaucucuccuaguaucuccggcaucucuccucaccaccaugaguccaggcucucagaugucuuccaccaauuccaccacuaacuuuuuccagacagccuuucugccuccaggccccucaucucuauuccacucucccagcgccuagaggaauuuauguucucaaagcaaaucucucguggugugacuuccaacauuccaaugucccccuuggaguagagagcuccacuacacuccuugguccagccccagcccgccguaccccugaggaccuugccacgcauuuuaugcucgacuccuaugugucaccauccacgccaccuuuuucacugccuuggccucugcacugugaucccucugcacccccucgccugacucacuagcucugccucaucauucagaucuaguuuuguucccaugcccucccagaagccuuuuccagaccccugagccagcacugcacaguggcucucacagccccccgugugaacuccaccacagcaguguaaaguuccugaguauggguucccugagggcgggcugcucacuccaccaauacugacuauggccaagagccccaccucaggcaugggacgugagcaaacaccugcugaagaaagggcccguccaaacuccagggagagggggacagaugcagggacuaggcgugucccacaugaucuaggucucuuugccacagcccuggccugccuccagggcuccuuguuacuuccuagauauaucagaugcccugguaguccugugugugggccaagcccugcaccugaaggucccuccugcauuuccaggacuccuugggcugcacugcugaacagggaauagcuaggacucucucaaggaaccuucccacccuccuaaaacaaaugaacaggauccaggggagcucacagauggagaagaaugcuuccuggaaaaguagaaaagaugguauaggagacuggccuuagggaauaauaaugauaauacaaauaaaauagcuaaaauuuauuaagcacuuacuaaaugccagagauuguacugagggauugauaauuaucuuauuuacaccuuacaaaaaccccauaagauucuaauaucuccauuuuauauacaaagaaacuaaagcacagaaagauuaaguagcuugcucaagguccccacagagucagggagaugggauucaaaccuggcagacugauuccaugaucaacuaauaacugugugauugaccaugacuauacuggcuacacccaggaggagguggggcuccaggccaagggaacagcagaaacagaggccaagaggcccaagagcccagucuggcuagaaggcccacauguaggcaaagugcuacaguaagaaaggagauggcaugcaagaggaccucaaaugccacaccugaaggagcugaaguuuaucucguggacagcaggaagcugcugaggaugcuggaagaguggggguacgaacagcucagguuucacagauguacucaaucaggaagcagaggcuggacugaggcgggggaaucauaagggacguggacuuugggcaaggacagucuccugggggcaccuguucugcaguuuaggggagacaauuggcucaggaagcuugagagcuuacagguggccugucauugcuggaugugagugguaaugggagugcagggaggguaguggucccauuucaugggcaauacaacuucaaucucuggccuuuuuccuuuggggagcuagcagcaacacagagcgugacuccuuaguggcuguguccuuguaucagggacacuuaaauccaucacccuaggguccaugauucccucugccuugccucuuuccagggaugccaagaaaggcucugacucuuuccuccugguacuggcugauucccugggggcuuccauuuagcucucuggcucuggaagccuuuaccaucccuucccuccucacaagccuccgaacagcaggcuccuucccuggcauuuugcacaaugccauaugugccauccccaucuggauuacagguaaauuccugauaaggagacaaggauuuguagcugugcucccuuccacuccaaggacuaagcugagaauuugccuaguccuauauaguuaugucaaagauggggaaacuaaggccugcagcugggggcagccuacaccagaauggagaacuaacucccaaaccccaaaucagagaacuagagcuggaauggcaaagaaggaugaggccaggagagaaugaagccauuucccaugccaucuccaagagcuacaaggccccacugaaggccaauagccaacuccagagccuaccuauccuggaugugcucagcacacaccugcccuccaaucuuggcucuggcgaaauacccaagccuccaaccccugguccaggcuggcugugagcuauuccugagucccuccagggcaugggguggggagauuccuggaggagccauggcauccuaccauuccuuuucccugaguaguaaaacagaucuagggcaagaaauagagaaaucacggggacugaugggccccagucucagcagauccagacccaguggagagcucugcacaugacugagccagucuccaccucaucauagagaucccugccuacgggugccugugcucacacaggugggacagaaauccuggcuccccccagccuuggguggguuguaccuucauggaagccacuggcucugcccccaccucccccucgggcgccaucccugauuaaugaucuugucuuucugauuuaugagcagccccuccagacgagggugggugccccuuacaaccccgcccgcccugcucagcuggaguaggagagaauuauuaaauaaacauccauacgucauuccuccccaccacaagcugguugcgcagaacccauacggcccgcuccggcgcugacacggagcagcugcggugauucaugggcagccgggcccugcgccgcggcccauacaucaugccagcagcacucgcggccccggccgagauaaacugaucaaccacaacgggcuggaaugaauuuaugacaacacaaaauggagggaaacaaaugggaggugacccugggccaccgacccggcccugcaccggccuccaauccacucuccuggcaggaggcaaagauggaacacuggcccuggaaugaagaggcugccuuuuaaccccaggcaaccuagccugcagucagaaggugggguggguacuggaguuaagcaaugaccaauggcagcagcaccaggcagccuagacuggacaaugccaucuccugaggccagaacuggccuuccuugggcuucugggaaggcaggaagaugcccagcugauaccaaaucuuugugguucccagggauccaggccagggguugcucagcccugggcaaagugcuaauggaucccuuuuccucugccagagaacccaggccaaaaauuccuaccagaagugaugauacccaauguuccugccuaaaauccacugcgagugccacccgggacaagaaaaaugaaaccaauuuagcucccgauuaagaaacagaaacuggagaugaaucaagugugccggcugggcugggcggccauacaucacauuccccgggcgaaggccgccgcagcaggcgggcaggcaggcaggcaggcggguggacugcuccucccaccgccaaggcuucuggggccguggcccagugaucaauucacagagucacgcuuagcaccagcugggcuccacugccggccgugugcccagggcagcagcacugagcugcacuugggagggccagaagcccuggcagcaggccuuccugcuagcaaagggccccuccucccacugaacuguggucccagggcucucuccuggccaaacacuuacuucucgaugucgcuguucuugcaggucuucugcauggccuccugcuugcugcuuucaccauugcugguggauggcaucucugcugggacagaggggcaacucacacuccggccagacugggcagcacaggugagggguugggcuugagucagucaccaccaucuagggauacccccucucccccauuacuccuaaccuggggcaggacuuaccaucacuggcccauuuagagaacucaggugugaugcgcgugcugggagggccgccacuggaggaaaggagggaggaaaaacaaagugaggccugaaggcgggcaggacagcccugagggucaguacugcguuaaccccugccucagggcuuccuguuucucugcuccacccgcccaagccugugcccacacuugcuuuaggacugcgccccgaagugccucucucuccuuggcuucaccaggcuccucgccugugcaggggaugacaucagccucuguguaucuggcaugguggucaaggacaauggauccuaguuugcagcaggcuaugaggguugaauccucaggagagcauggcccuccuggccaaagcugagacucuggcccgggggguggugcaggugaauacuagaagagcuacuuuucuuauucccugugccugcccuaucagccccaccagcccccauagugcuccaaggauacuguggcuucccauacuccagagugucauccccauccacauccaagucagcaucacuguccggguucucuuugccgcugcacaugaugaagccagagccugugggaagcagggugugaggagggccuggggacaagacgaggccaagggugccccuccuguugccuccagguagggguuaggcuuuggaccugauaaggcccagagggaaaccugggccugggauguauagagccagauacuucagugccccugacccugacauuucaggcccuucacucugcaaaccucaucuuucucugcuacugcaugcugcuccaaguggucucugcucauaaacuagcccauucauauauuaugucacguccucggggacacucagcccaggccugcuguccaccuaucuuccaggucuaggaagaacaguaagaggacagaaaaauucaggucuaggaauuucacaggaaaagaguggggccuccccuaugccccauuauccagccugacaaguccaucagaggagagaacaggcuggcuaaggccaaucagagccacagagugggacccccggccaacauccugauuuuggccgcuagguccuugccagcaaaaacaccaggcagcuguucaaauauuuggugucugaagcgccugacauuaauuauucaucuccaccucacucagcccagauuccuggacaagugcaguuauaaagggauuaagaagggacagacgagggaggacaggcaugcacaccuacuucucaaagcaguccaugaaggcaaccaggcugagcggaggccaggccaugggccacgcaaguggcugaccccugaggugcaucuggcacagccacagacggacucucagcucagagggaggggcgagcugcuggggcuacaccaggccugcucaccugccaggcgaucucucugacauccaggaccacccuuccugauagccuagggucaagugcuauagagcuguuccccccagcuccccacuuccuccuagugggucucagaccacaccucacuagccagcacagcccugccagggacaaaagaaugugagacucuguggcuacugggaucagcaaggaaauccuuaaagaagugaggaagcagcuuaguaucugccugaugauuucagacauuucugcuuguccacucuuuccucucagguccuuauacucucauuaggguaugucuuguagggaguccucaggccucuuaucuguuccuucauucugcuuaccacugaguucugaccaccuuuccuccugcuccaaaaccauugauggcuccccacugcaugcacaaccaagcccaggcuccucagccagauccaugaagaucuggguccauuuaugucuuuacucuugcucucuacuaauucacucuguaaaccccaagcaugugcacacacaggcugcucaccaaaccacaaacauagccuguauaugcugcucuuaagaccccugcucaugcuauucacuccaucuggaauguucuccauuuuucaagcccugaaaaacacugagucuugauccuucucccuucuaccccaccagucucuggucucacaaagacaccaccaaucccaaaggcaagcagcaucgggaaggaaagaugccaggcacagccugcaauccaccucucccugacaguccucauuugcccucuacccugaggcacugacacacuugaggcagcaggcaggucaggucagcagcagggccauuaagcugagaaaacaccaaguuacagcucugucuccuguacacggccagguguccugacaagcaauucccgccuugugggugaguggcaccuccauaaacccucugacaguuugggagacaaacuccaccaucaaucagaauguagcuaucagguucacuuacagcuugcggcacccaaguccugccaaccccccuuccccaaguacacgcagcucagcagcuggccucacaucuucugcucggccuggcccugccuagcccugccuuauaaguggaaagcagagaacccuggcaccacaugugagcccaauauggcuccauggcaaagcagagaaaacaggguaccccaaagcugccaggaaaagccccagcuucucaacgcagaaagcagcccuguagccugaaguccuuuucucuguagucuuacugcccaccaugccuggcccaggacucauacuccauuaaacagagcuacuguggucucccaaauccugugcuuucucaugcccccaugccuccgcaccuccugcucucugccuagaaccuucucccuccuggucuacaauauacaugccugcuccuuuggcaagucugacucagcccaaccaugccuccuaccauuaacucacagugcccacacagagcagcugcucucuaaaucccugcuaaaggaaagaacucucaccucaaugccauucuuucaaccuuuauugggcucauccucuguuuggcuccauguugagaauagagagcuucaagaucugaucccuauccucauggugcucugcguggcagauggggcuucccacguucuuauacacaggugucccuucccugguguccacccagaauccuguguaacuccaaaaucauauuuauuaccaccuauugucacugucccucaccagaguggaagcugcaagggucccaaguuugacucacuguugugaucucagcaucacccagcagagcuggccaggcugauggcuggugccacacagcacaccccagcaguacuggcuaaacacuggcgacacugcucuauuagguccuaguuagcugguggccuagagaaaucucucaggauacaacuuuccuuaucagaucccagcucccagccgggcagcagcuuucuguuccgcuggccagugaggcaggauggacagcacgacacacuuuguuugccaaagaaaaggccucugccucuggucugagccauucacucugacccugaccccauccuccagcugagacagauguugggaaccucucccuacccccacagguguucagaacaggcugcugcugccaauuucacucuugugcugccccagccugcuccaaccucuuucccagcacauuaaacuuuauuuucuuaaugaaaugucacuugcugacuucuggcagaaucauaauaaaaagaaacggccauaaagccguuuuaugcagacagcgcccccgccagcuugcccccccucccgcuuggagaggaaggcuccacagucguuugauguucucagcugcuggaauaucccaagccaguacucagaggcaagauggcacagacagcuccuuuccaagucucuggcuccucuuccauguagcuccagcgauaacaggcaagcugccacuccuacuacugcuaucuagggaaggaacucagcccccaggaccuccaagauggcccagaguacccuucagucaccagggagggccucuugcuacaguucugccccagcuuaaaguggcauaaaggccugagcccccacccauaggcaaccuaagccugauggucaaugauacccagcaggguggugccagaguuguccauuccuggcgggguggguagugcaaaaaaaaauauccuucuccucacagugaaaacugagcaacaaagagggagagaguuaagugcagaaaugaaacacaggucuacguuuuauaaaaacgacccuucucccauaaacucauuucuuccuggguuauugagaagggagaaaaaaaaaaucaguguuaauuuaaucaauugaucagaugaucgauugagaaacuggagaugcccguuuacugggggcaguaucguccuggaaccugaaaccacaaaaaaggaggcaucgauuuccucaccugcugcucccaacaaaaccagagcccagggagaaaggaaacgucucggggcccuccaggggccugugcucuccaacacggagggcaggggcagcagcuuccggcgaguuuuacacuggaauuaguuacagaugcaguuacggugucuuguguaaacgccaucgauuggggagcugacagucuggggagcugcgaugcgggacaaucaaucggccugcagugucaccugccaccucgcugaacaguugacaaugcaauuauccaguguggaggcagggaguuggcgugugucaaacgcacuuagccacuuuccgggccuccucgauaacgcguuucacugccucacgucaggagagacgcagagagacagacgccguuuaaaaccauugauacuugcuccuucugccugcacucccucuguccuagcuuaacaauuguguuccaaaaggcgauuaaaucccaucaguugccacgggggacagaaggugccuugcuccuugccaccucuccucaccccucccaacaggcgacagagagaacuaaagaugguagggagucacaaggcagcagcccaacccucuccacuccaagaccgccuccagcagugugcuguuccaacaccugucacuggcuggaccaacagcagagcugcacugggggacauuuuuagcaccuggggcucccuucuuuugagaacuagcacaccaaagaaggcagcagcuagggcaaggccuaugugcccaugcccuggggcuuacaacaccucuuacccccuugccccauacuucuggcgcugaaguuuuaucaagaaauagccagauaaaagauuugugccaggccgggugugguggcucauaccuguaaucccagcacuuugggaggccgagguggguggaucaccugaggucaggaguucaagaccagccuggccaacauggugaaaccccgucucuacuaaaaauacaaaaauuagcugguuguaguggcacaugccuguaaucccagcuacucgggaggcugaggcaggagaaucucucgaacccaggagguggagguugcagugagccgaaaucgugccacugcacucuagccuccagccugggugaaaaagugagacucugucucaaaaauaaauaaauaaaaaggaaaagaaaagaaaagaagagaaaagauuugugccacagcugcucugccuguuugcuucaugacuucucauccagcuacuuggaaccggcuuaaauguaaggaacucaugaaagauaagaaacgcuucaggccaggaccugagcaggacaaagacccugcacugcugacugucuuaacacccuucuuuucccuacccacuccuccuguuugguucagaggggcuucaugcuggauuuuagcaacgcagucaccgccagggcuuaaagauacagcugcaggcuuccauuuccugugaagcuuccugggaaauuucuccaucucaccacucuugugcccacaucauugccaccuuauuugaaaccaaucauucccauguccucuuuccagcaugucccuuccagaugugaggagcucugggcuccccaaugcaguugggugaacucucacuggcaaccaacacacaggagggaccaugguucaccacuauaggucucuucuccaggauccaggagcuggauggaggacaggagaggaaaggcauggcuccuuagucacacaccuccuuagacuacagguggaagcaggcuugucuuaagggcuguauaguuagguuccccuguagucugcuucucuagccuagaagccccuugcucugcccagguuuggcaugguacccaagaaaaacaucuuuucucccuaacugcggaucucuuuuaguggaauguugguggcgcacuaggcucugugugcuguccuuuauguaaagagcaguagcagguuagaaaaucuaugguucugaaaggacaaucaacaacuuagacacacagcuuaaguauuucuucuagaauugggaaggucagagugccuccuaggcagcaaaaauuccuuccaacuuacuuucuugaaguaauaccuauuuccuuuagucuuuucaaaaaucuguuuccagugggaccuaccucagugcucaccugcucugucugcuucuuuauuuuguccuaaaauaucaauccgaguacucccaggccugagauaucuggagcuccuccucaguaaccacagguccccaucucuaaggccuguugcccucagccaagugucuccaccgaaacucuugcccguucacugcuucccacagcagauuacauuugagguaaccgaucugauccaucagaccaaccuccaggggccuggugggaagcuuugcugaggaugaagaagaggcccuacucugggaggagggaugggggugaucggauacaggaacuuaucugcaauucuucacuucuuucauaucuaacaacgacagcaaucucuguucugucagcacgcacagcgcaguuuaaaugggccucgccacucgccugcucauccugccucugccuccuucucucugaagucugcugggcagcuucuucagcuggcguuaucacucccucuaaccggucuuggcaggcaaucuaauuccuccugaaaaggucaccgccauuuuaacugccuuucaaucacauuaagcacgcgcugcccggcuugcagcccggcccgcccggcgggcgaucaaugcgcugcacugacaccagcccgccuggcgaggccacacccaaccccccaagaguuagggccuaucaguccuggccagggaggguaggcugacagauggccagcuuuugcagacaggguuuugggggcagaggcaguagggaucagccagggccucccuuugauagcccccccacugaggagccucagccuccuccgcuccacugcgccccgcucucugccucguggcccccgcugaucucgcuguaaaacagccuuucaagucugccugucuuuugacugcacuaagcuguuuaagaggcggcagcagcuucuaucaggaaagcuggagcaauucucugcagauaaaggcaccuccggccccuguucccucuucaagucucacucucauucucgcucuccaaaucgcucaaagaaaagcccccuuugaacuccccucaggaauucuugaaaggaacaaccucacaguguaaacacucagggaaaacggauacccgcccggggccuaagagccccucacacugcugugcaagugcaucccggcacaggggaaauacucuugucaaaucagcaggcccuuugcagcuuuauccuccauaagcccugucuggugcccagaagccaucagguccaggucugugccaaggaaccuaagaaggugccacagcaauggaggaugugagcaguugcagcugccaacagagcuaaccagagcagcacguugaaacugacccuguguggcugccaucggacacccauguguccaacucaugggacagucgucagcccugcugcucacucuucuagggccucagauacucgaaggcuccaguacgggaugagugaaauggcaaacuaacacucuccagcuccggcucagggagacuguuuggucugacuaaccuuccugauuuauguuuuggcuugcccccaaacaccuggguaaugugagagacgcccagaggcauaaugucucaucugggcucuuagccccuucguggaaccagucugcacuggacggcccugcagagaccacuccucagcaucugcccagguagcacggccccacgaaggcagagaacuucuucccagcugcugugagauuccccagggaccauacacagcaguauucccaaagguguugcccagagagagaggcagacgggaagcagauuggcucacuuaaugaccacaagcugcaguaccagcugugcuugugcacagaaagagagaagagcuggaggccaagaggcagacagcuccccuuuuccccugcccaaggcuggggaguuuaacaagucacuaacccugggcacccaaccaauucugcugucugaccugguggggggugucaagccuugcucuuccaaggagcugggagggcacuggagaugggcagggcccugcacacuccuuuguagcaacuggggagagcccaagggaaggagggagcagcugggcccaggccccucuugcuucagggcagagggcgcccagggagaagggaugggaucagagcuaaaauuagauucaccaaugaagcucaugggaggucaaauuuugccauaacucacucuccucuguaacugauuucccugacauagggcugaagaggaggaggaggaaaauccaauguguuugccuggaagcccucagggcccccagugcuggagguguacagcagguugcuggauucucauuuaucagccuuaagagggauggagugauaaaugcauaaccgucccuuuaauauuuuaugcaggugcuaacgcggcuuggcugucaccuucaaugcaucacccgaagcugagagccccccuucgucacuccuagcuugcagccucacaauuccauuuccccacccaaauacauccauuuuaauaugcacaucacaggcaggcagcacggucacaaaggagccccaccagcagcaguccccacgugguggaacggauggaugaccagccaccagccucggccucuuggcuuccagcagauggauacccagcagaggccuggcaccagagugccaaugucuacgugucagcugcuuguaccucggaagccaccuuccaggagagugguggcccguauccgcuucuguccacaccacucauacuccucaaagcgguuguuguucucaugcucgauguccacagcaucauccucagccaugcaggagccuucccucugugaagagcagagcaggaucaugcugggcccaggccauccccaccugcuccccacagucugcaacgaaggcacagcucuagccccagcuguggugugccaagugggcccucagcucuagggcuccuuugaagcaaaccaauuuagaggucaaagaccugggccucuucccaauaguuuuccgcuggagcccaaggagggaaugagugagagugaaagcaaaaggagagagcaguggucagaagggaagaagcugcugagaccacauggagaccccaagagcccacagauucaggggcagucagcagcuagugucgggggaagggagcggggaaggaagguggguggugauggccccucuaccuuagaaaggcaaugcuccacaugccuacucaucuccugcuccgauccugccagggggcgguugcacaggggacauaccugcccuucaucuugcuuccuccguuucauuuucccaauccgagcugcacggggaaaccgaaaacaaagcacagaacaagcagacggucacugcagcccccagggucccaguggagcugacacauccugaccucuugccagccauuggccuuuuuauucagugccugaucuggcccucaucuugaaauaccuccugcuccuuuggggacugggcuuugccaagagcaccuggggaggagacuggugcuaacuaagccagugaguaaguccacucuuuggcugcagcuggugcaaggucuacccauaccuuucuauuugcaguguuuaauaaaaauccagugagcaaagacacuccauguugcuagguaucucuccagaaggccaagaccaugaacucuuuuggugucaggaaauacaacucuaaagagcaucucuugacuagaaccuaaccccuccgauggccugacuuggccugcuguucacucaucagcuaaauccucuuugguuccugggccaagagcccugagguacagcuccuagcaucccaccuagaaucuuaucaggaagaauuucucugagguccacuaaucccauuucacagaagaggagacugaggcccagucauaaagguaagacggucugggucagaccuuuggcagccaggucagaaggcucagggaacccugagaaggcagcccuuauugugcccacccgaaccuguuccaucauuucuaaucaguacagaggggcuggcaggcccuggaggcagagggcugccugccauguugucccacagggggcucaguuccaaagugcacacugcaagcccacaacacugcuaauuaaugcugagcaaugcaaucauuucuaauuagcucacuaaucccucucuguagcccuccugucacugaagcaggaaggggucaaaacaagaaacucucuucccucuagucccuuccagaaugccacagcaggaucagagauggcuacucugggaccagacugauggggaguggggagagccagcaaaggagggaaagguuccccaaagcagggccaggaagaacuuucucauggacagugacccuaacgggaagcucaugaaugcaaucuaggaggggaacacaggugagagcugcuauguuacaauuuaagcuucuaccgugugucaggcucacagccaaguaccuuacccaagguagcucauuuacuaccacuugcugaagcuagauugcauuaucccauuuuaacagaugaagaaacccaaagcuuagagagaucaagguacguguccaaguagcuaaaaaguggcaaaggcaagauaggaaaccagaacugacuucacaaccuagaaugcccuccuguuucaaggggaccuccuaacugagcagcaucaacaaagacuggucccagugagugugcuagggcuccagcuccugccuguugugagccugaggcagggagcuacuccaacuccaaaacagagcaaccccagaaagacccaaaccaaaaggaaagcuaccauccugccagaacugggcauggaguuugaggaaacuuggucuguagcccaguccaucucuucacuuuccugugucuucacuauaggugacaugacuguguccuagugccucacuugacuuuguggacacagaucgagaacucuucauuuuggcugcccuaacucuuggaaucucagacuuagguagccuugacacucuagagccagggcugggauggagaauggacgugaaacaucagaaaggcauugagcaaaggacccugagaguucuagaaguguaguaaggagcagugugccaacacaaagcuuccucccuaccaugccuacaccaagggaaugccucccuggggaagaaggugcugaugauaccacaauguucaaugacuaaggaaacgaaucucauggaauggucaagaaaggcacaauacuggaugcgcuccuugcucaggacacacaggccagcagaugaucccuuguugucccuggaaagcaccccaauggacugggcuucaucugcaaauucucagagaaggaaggcagguuugguuuucaccuucccauucaucuucuaaauccugaauuaagcuuaccaaagugugguagggaaaguucuguucucuauccagaggcuacguacgaguaggaagaaucaaagcauuugccaaggagguagcauggcaugguuggagaaacacgggcuuuggugggaaacaaacuucaauugaaucauggcucaguuacaucccagcuguguacuuuuaaacaaaccacuuucaccucucagagccuguuuucuuauucacaaaagguguguaauacucuucucagaggcguugugagaauggugcuuaacauggcgccagcccaucaugaauuucucccuuuuccagacuagggcucagccuggcagcagaaaccaagugauaagagcuggggaucuugaacuccauggccucucucacuuaccagcugacccagagacccuaaaccccuuacagccaccccccagauaccacaccccaguaagcacaaaaagcuaggaucauucaauuguauucagcaaacaggaaugcuccagagguuugaauccaaaaggggggcugcuagguagugcauacacggccugcuuucagagaaggccucuaagagcugucgagcccacgcugaucaccuuugugaaaugugggccgacugauaacucaaagagcccugggaugaguuaguuccuguugccgugggaacuccagaucucacuguauugucaagucucagcagaggggcuguauucacacuacugggcacugauuaaaaacuggaagaaaaacauucucagcgcccugcagguuuguauagugaggucccagcaguuugcaaauucaaagcugagcucccgaguagaauuguguagcucguuccucauucuccggcacuuauugcccccccaggguucuucagggccuuuagagagguuugggcaagagcugggcgccauaccuccauuagacagacggggaaacugagagcggcagcuuugguuugcacauacucaggcgccgugacugcgaagaagccaacgggccccagagucgaagagacccaggcaagccaggagcggcaggcagugagggagggagggaggaggccggggguggggcggagggaggggccgggcaggacucaccauucagucgggucugccgguuggcucguacucgcagaaaggucugggagaagaucgcgggcagaugcaagaaaagaaaagagagcgucaggcgcggccugcaguccuggcccccgccccagcaccggacccccgaccaaagcugcuccgccccaaacagcccguaaacaaaccuacuuccucccucccgccggccccucugcuccuccggccgcuccgggcucucggcauagccgccgggcgcugcucuaacgggaccccguggccgcugcgcggugccgccccagcccuggccuccggcgcucugggccccacggccgcccggccggcgagggcggcgaugcgggcggauuccccguggcugcccggcggcggcggcacuucagcuccaagcggcggcggcggccauguuggcccuaaucacgugaucugccgccgucgcgcgcugggggugaaaguucacaaugcggcgggggcggccggacagagaccaggaagcugccguuuguacucggguagcaaccggcagaagccuccccggggucccucccaccgcccgugaagccuacccacccaaucuuuagcggcugcgaaguccuuccaccccacuccacgaccccucccgcugcggggcuccuuccgccccaucgcccggccccggcucccgccuccugugccugccuuucucgcggcugcccuuagggcagaggcaucgcguugggugcuuuacaggggacaaggcguccgaauucccuaucgccugugggcgauccccgcccaaccccuaggccauccaguucuguuaucagaggacucccaacaugucagcugucugcugcacggccccuggagcucccauaggcacugcauacccacacggccaacauggccaacauggaacucaguauccuccaaacagaggccuuccucuuggguucccuguucauaagaggaagccacuaucuacucaggugugcccacagaagaaaguugagagucguccuggaccccacuuucuccaucccucacacucaauccuuuucuagauccugaaaguguacauugaaaggucgcuaauuuucucaucuccaccucuguaucuccuacucauccuuccaggucuaacugaaaaauagcuuugccuuguguaagaguacauucaucucugcgccguuaucaucgcuugugaaguuuuuaucaguggacugaccacuucaggguuggggccgugugugaauuauuugggugaacccagagcccagcauggcacugggcaaaggcaagucagcccugaguuguucuuccaugguuguaccuaccuugguugucguugugcuccagucauacauaaucuuacgagcucucgaaauuugcagcuguucccgucucaucuuuuggucucuagcuucucucucugcaacccauccuccacacuacacacaaugugaucuuucuauuggacaaaauuaacccucuccuucuuuaaauccuucagugguucuccaucaaggcauauaggccuucccugucugccuugccagacucuucucucacuccuauucucucccuuuacauuccugacacucagcuuugcagagcuaacuagcucuuugagcacuccaugcucugcacuccaggccagagagccuccaugcccuccaguaucccuugcuugguuaacuguuguucauccuucaggacucuggcaagacuuaguuuugucccccaagccuggguuugaugccuccucugaguuuucaguuccacugcuucucuuugaucauguauauuuugauuguuuguuuacauaucugucccuuguacuuggaaggucaucucuagccauuuacccagcacagcgucuugcaugaaggagacaccagugggaacgggagaaagacuuuaugagauaagcccugagcccagugauggguugggaaacaaucucggauuuagggccagacagacucaaguucaaguccuaauucuguuacuuacaauuuauguguucuuagaagagucaccucuuucuaggccuguuuccuugguaauagacugggcaugaugaauacaguugcuaugagguuuaagugagguaaugauaaagaggguuaguuagucagcaggggcuaaguaaaugagaauucaaaccagaaaccaaggcucaugccuuuaaucuuagcacuuuggaaagccaaugcaggaggauugcuugagcccaggaguucaagaccagccugggcaauauagugagacccugucucuaugaaaaacaaaaacaaaaccccagaaaccaauacccccugguuucaaggccuagcucagugacuuuaaaaauccgacauagcugaacaacuacuacaugccaggccuuguguaaagagcaagggaugggauacccagcuagucucuggguugcuuuccagcuucaccuacuaacuuuccuugcauucuacuuucuaacaaaagcaaacugcuagcagguccccagauacaucauucuguuacaccucuauguucucuacauaguguugucuuuauaucuggaguaaccuuucuuccuugucugccaagugaacuucuguuccuucucugaguccguuuucagucauuaccuccugugugaagcuuacucugauuuucuccuccuucuacuguaguauccuagaaacguauucuuuauuauuaauuuuuuuuauuuuauauuuuuaguagagacaggguuuugccauguugcccaggcuggucuugaacuccuggccucaagcaguccacuugcguuggccucccaaagugcugagauuacaggcaugagccacugugccuggccccuagaaacuuauuuauacuccugucauagcacucaagacacuggaccauaauugucuaucugcaaaucuaaccccuugaaggcaaggacacuaagcugaacaugagucaguacuaaauaaauguuugaguaaaggaaggauaagacaagguccuugccuuggagaaacuccaagucuaguggagucagauucauugugaaagauuaaauauggccagaauuauuugcaucuucuccuaucaagagcugccuuuccucaucacucgauuaugggcuagcuuugugacuugcuuugcuuaauagaaagugguggaagugaugugugaguuccagauucuaggccucaacaggccuugcggcuuuggcauuuacccucuuggugugacacugcccugagacugcuaaguaagaaagcugauugaacauacuggaggaugagaggccacauggaagagagccaagacacccaaucucccaaacaugcggugaggccauuuuagacuuuccagcccagccaguccuccaggaugaaugagcugcaugagugaggaaaugcccagucaaccacagcaucauaaauaaugaguuguguuaagccacuaaguuuugggaugguuuguagauaacggaaacauaccugaacaggugaucacaauguagggugacggggcaauaaccaggacacacaagggucaagagauagcuaauccagaaagacuuccuggaggagaugauauuugggcaggauuuggaaggauaaauagaaauuugauguagugggguaaaacaguucuguuagaagaaauagcaugugaaaagacauagaggcaagaaaggaaugccucauccagggaguguuuagcauuaguucagugagcauagcccauaggauucauggacaguauuuggaauggaagcuggaaauauagguugaaucuauaucacagaaggccucgcugccaugauaaggagcuucagcuuuaucuuguaggacacaaccuaguuugauuugcccuuucggaggugugcuuagagucuagaacagggucuugggucuuaaccugggcuucagagaucuccaagugguauugggaugggaucuagagcuuuccuaaccuccugaaguuguauguauaacacugcaugugugugugccuguguguauguaaaaacacaugcguauguuuuuaggcaagagaguccauagcuuuccucauagucucuaggagauaaaagaaauacugacauuuguggggaggaaggugggucagggaguugaggcauuguugccugaugguuacucuuuccuaguugaacagauggcaaggcgcaugccgugagugcaguacagaggacaggccucugaagguggggcugucuauuccucuggaccagaaugcucuggaacaaagccuugucucuguucccuaucagaucagaauucccuggggucuggucauuucucugccuugaaccaggguugucuggaucggggcagugucucccaggggcuuauugggcuuccuuucugaaacugggguucccuuagagagagcagggaucccuucccagggcuugcacuuugggcuaugcaguuugagucccaugcaaaggcauucggcggagucuguccagccgugcugggcacucuacucuccaagcucugcacccugugccaggccaggcugugucagcuggaaggaaggggugcagagaacaccuuucuuuaauucccacaaagggucaggugugccagcagggccccugguucucuacccaagcuuacaggucccugcagcccugucuuucuguaucagaucagggcuguucuucccuucucacacugggccucccugcgaagcccuguugccauuuggacaaauguuccuuggaauagggcacuguucucuuucaucuaacggcucugggguucuuaaagacagggcucugccucuccuuagacaaaaguuuugggggaaguucuuuguccuuccuacuccagagaagguccguuuauagcuaagaugcuacccuuaggccccucugcuaugauauuguaggacugugugaugacucccuuccuauuugcccaagacacucacaggcagugugugccugucucucuaucugggccugauaccaagguuuggcagaauugaaugguuauuugcuuaagguaucacgcuuuuuuuuuuuuuuuuuuuuuuuuuugagacggagucuugcucugucacccaggcuggaguacaauggcguggucucagcucacugcaaccucugccucccggguucaagugauucuccugccucagccuccggaguagcugggauuacaggcgcccgccaccaugccuggcuaauuuuuguauuuuuaguagagaugggguuucaccauguuggccaggcuggucuccaauugcugaccucgugauccgcccgccucggccucucaaagugcugggauuacaggcaugagccaccacgccuagccuuuuuuuuuuuuuuuuuuuuuuuuuuuuugagauggagucucacucugucgccaggcuggagugccguggugcaaucuuggcucacugcaaccuccaucuucuggguucaagcgauucuccugccucagccucccaaguagcugggacuacaggcacacgcuaccaugcccagcuaauuuuuguauuuucagcagagauggggucucaccauguuggccaggauggucuugaucucuugaccucgugaucugccugccucggccucccaaagugcugagauuacaggcaugagccacugcacccggccgguaucaugcuuuugaagucugaaaucuucaggugauucugggcuauguaucugggucucuuaugaaaccaaaccccauaggauacuuccugauggauagaaugauucagaggugcucagagcccauggagcccaugugaccuuggcaucucucccuaaaauccaucuauuuaaggccuauucccugacacguaugccuccugaguucacuuaggggcacgggacacagggggaaccaaacccaguucaggccucuccuguggccuacagaggagaggaggaguuagcaccgggcaggcucuugaagcccucccccaggugagcuugcuucucauggccacucaccaccccuccucaccugguaucugucugaaugguggaggucaucgguggcagaugaguggggugaugccguuggagacucuccuucccucuugauggaagcagacaacaggagggacuggaagaagaaaaaagacauguggccucaggccaaaugagaccuacagucagucccuagaguucccaguccuguggugcuuuggggagccaggcaaagagaaggaggcugagggauagaaagaccacucuugagauucuaaaggcauggggucaaguccugggagugugguugugggagagcauggcuugguuuuagggauggguagagaccccuugagggacccugcuuaggcuaaucucugucccaguggagugagacucccaguccacuccgaguaggcugagacuauauauguuuuguuuucccuuggagagcagagacucugggauccccaugaaggguuguggguaaagccauauacccgcuaccccgccugcccuuaauacaggcugauggcagccccacaauggagacaguaaauuaaauagcaugugaguuucccacgugcagcuagggauguauguggguccauuuaucccggugcuacggugaugaccccagcaaaaaccccagcaaaacuaauccccccaugucaaucuuguauggccucuucuacauacgccugcaguuuagauuaauaaacugucugcuugaaauugugugcaaucaccacaauucuaaauaccacauggcacauucugccugagagcccgcucuugccaaggccuguucagcugcaaacugggugccuggaggccugaaagcaauccauacuuccuccccccaccuucuccagccuguacagcucugagccggaagcacacaguucccuaggagucuuccccagcuuagaaaaccaugccaaaucgccagugacagcccaaagaaagcaauuugggaaagauggagcagccauuuauccuucaucuccggcugagccuuaggaugugacccgcaugcgguggccaugcugcacauccucaggcaagggcccuggaaagggaagggacagcugcuggucuggcagggcucccugacuugcccauaccccaggagcuggaggagagaagaggcuggaaagggccugcaugggauucucugcaacguggagcuccuucuucacccauccaagcccagugggaggccucaugggugacccagcccucagcucagaaaggaggugcucucaggcaauguucuucuccuucucuggucccaaggaagaugcuaacgagggggaacagugugggucaccccgaccuccggcccaugaaaaagcuccuguuugugcgcuuucucucucucucucucucucucucucucucucauucucucuagguuagaagcccugagaggccucggcauuacaccuggggcaagcggaauaaaaaaaggucacuggugcuuuuuaaacauggaccaaaaagcaguaaaauguguuuugaaaaaaaaucccggcauuaaaucaugacuuuuugccuggcucuucgccucauuaaaaguggccuuuuggaagguaaaauuaucauuguaagcgauaagaucuuuaagaaaauaauucacggcuucuucacccuuuaauaugauagccgccaccggcuaauuuuuuucuuaauggcaacgaggccaucaaucuugucuaaggcccccucgcccucuccuccuccucccucccuccuucucccuguccuuucagucucuugcuugaaccuucucucucucgccucuuccacucacgaccugcuucccuaaagccuaggucaaggcagaggauagacccugaacuauucagcuuugggggugugggcauauaucuggaagugggugagcaagugucccuuaucucugugucucauggucaguaugccugugucugugguuucaggacacauguuuuaagacuuccuaugucuguauucugaccugagugugugugugggucuguauauguggggagcuagggacggagguagacugugucugccagggguuuguccuuagaacacaggccucacugauguccaaguccccagcccugccagccaugcucaggugucagcugucaccugugguggccgacuuggaagcuugucucugacuuuccugaaccacaccauuaaaugcugcaggcugggccacacucagugaguguagcucgcuaccucugugagucugcagcugccuggcacccccagccuccccuuucucuuuggggcuuugacuccuuggccaaggccuauacccacccaaggcagggcuaggugcucugcuccuccucucccagcuugcugcaggugagcaguuuucuaaacgaagguacacgauccauuccuauaccuuugaaaggcuugcaggguauuugggucuaccccauggaagugauacuugucacucuggcuccuuucccaaaacugcccucuuagaggucaccagucacugccagacuucuaaauacaacgggccccuucuccagucuuucccuguuugacugcugaccaccugauacauuuagaaacuuucuuccuuaggauccugagauaccaugcucuccugugccccucuuaacucacugaguguuccuccucugucuccuucccugccuccuggaccuuaucuugacaccaagugcaggagucccucagauucucaccuuggccuuugcucuaaucucuccaaacacucuccuucacugauuccacccauucccaaaucuuccauagucauuccucacucccuauaaaaugggcuagggguggccuccuguucugaauaauuaugggaaaaaggaugcagucuucuaccgaggaauggggaaggggauacucagugagugaggguuugguucuccccauguauccauccccucaaaaccaccuuuggguaaguaguacccacuguguccauggccaucuuugaggaguucuugauacaaaugucauugugcuaaggccucuuggccccuccuuugagccagauauuugcucuucacuuucccuuucuccaacugaugcuuucaagucuuucucccacaggguuuguucagagaggcagacuagcuccccaaaagaguccagccucuuccuuggcuccuuguuccccucaggacaaaguacacacaaacacacacacacgcacacaccugcacauucauacaccccugugcccccauagucuggcuucuagggcccugcacuaucuugaccugcauuucuuuauuuuucuucaucugcuauagcucacuuucuuccuuugagucuucucacccuuagugucugggucacccacaucucccaggccauucuuggcucugaccccucuccuggcuggaagaggaggaagucagaugagcauacucucacucaugcacagaccacacacacuuacacacacacacggcgcagcccuaggccucaggaugauguucaagaccuggagauaguugaggauauuagaaaagcuggagauaguugaggauacuagaaaagcuccuuuuucucaggaggaaccaguucuggguaggccuagguuaguaugggcaggaggaaaacauguaauuggccaccuaccuuuggggugccuggagccauggcauccuucagaagggaauucuugcugccaagaaagaagagaacaggguaaccauucuaccugcugcccagggcaugcaacgguagaguagcaagaagaccccaaagacagagaaggcauagaccgccuagcccagcccagcucagccaagcuccacccaguccuuucaaucccaguggcccagccucucucaugggcugaguggcucagccucucucuugggccaagggcuagugcuggccccugggagggagacacagacacuaggcaugguagauuucccaguggaucugaagaaaggggcuuuaccugacuccucguaucagcccugaagauucugccuguccuggagacccccuucucuccacccccuguucccagcccgcucuuagcuccugugggauuggggugauggagcugacagggcucuugucaauucucccuccaacaugcugcaaacuguguuaggccaggaaugaucucccccugauucaauuugucagccccaggcccuccggcaucgggcgcggcaggcaggcgggagcugggcccugaaauauggugggcggcucagagcaggcgggggcuggggugggaggugauggaugggcugugggggaggcgaggacuguguuuaauaacaaaauugguaugcaaggccacauccugcgcuaagcaugagugauccagagccacaaaguauuacaaaucccugcuaaacagaugcugacaauggaacaagacguaucaaaucagauccacuucagaaacauuaauaucccuguuccugucccucccugccugcugcccccacuacgcuugccacaucugugcucgcacauucaugcgcgugcacucacacacacacacacaugcucacagaagugcuggcugaugaaugcacggaggcagacacagcccauucacauagggucccugcacagacacacauaugagguauaacguacagcacaccugcagauauacccggaaagcagaagaacacacagacacacauccaaggcagaaugcauggggcacauagggacuuaacgaguguagacauaaggaacauccacagaugagcucagacacccacagggccagacacaaacguaccggacaagccagcaaaagcacaggcagauucagaugcagcagugacucucagugggggacaggggagaaggggaagggauguucaccugcacaggggacauccagcaaugucuggagacauuuuugauugucaaaacuugagcggagggaggggagguugcuacuggcauggaguagguagaggauguuaaacagccuacaguguaccagacagccccucacagcaaagaauuaucugaccccaaaugucaacugugccgagguugagaaacccugguauaaaggcgcacacauauauacccauagacuuucuauaauucugccaacaggcacagauauaaccagucacaccuggagacucagacacgcauacagaugcacagggccacagaggcauauucccagacacauguccauaaagacagaugcaugguccggugcaguggcucacgccuauaaucccagcacuuugugaggccgaggcugguggaucaccugaggucaggaguucgagaccagccuggccaacauggugaaaccccgucucuacuaaaaauacaaaaauuagcugggcgugguggcaggcgccuguaaucccagcuacucgggaggcugaggcaggagaaucgcuugaauccaggagggagaaguuggagugagccgagauugcgccacuguacuccagccugggcaacaagagugagacuuugucucaaaaaaaaaaaaaaaaaaaagauucacaacagccacacagauuagaugagagcugcucaugugcacaaguccaauaaacacaugcguagauauggacaccuguguguaccaacacacacccagaugcacauguacccacaaauguagacacagaugcacaacacacauaacauauguauaucccagugcagaggccaccaggcccagcagcagagugaggccaaggucugaguguaaaaacagagcugucagccagucuaaucacacagugggggcaucacagacuaggaaggcuagcuacaacagguuccauucaauuauguuuugcucauaaaugguucaugccagcccugauguaggcacuggggauucaagaagggcacggagcugcuuuugagagcaacuaguuuuugaguuuauggcuuuuaucauucguucacuccuucauucacucaguaaacaaauacugccaucaccauuucugguacggaaaugagguaucuacuguacaacaccaugcuugcucuaccuggccuaggauaagaguauuaucuccaguuggaucaggugacagcagaaaaggaaggaaugaacaaugauuguacacccacuguaugugacaggcgcaggccuuaacauguguuaucucauugaaacuucacaaaaucucuacaaaguugacuaccaggucaaaugacauuucuauggucacacaguccguggaggguuugggauuugaguuggcaucuggccaagcccacagugcuggcuuuuaauugcccaugcugccucccuaaagacacucagggcuuaggauagagggcagaauccaguucuuuuucuuugcuuucugugugacuuuggggaggggaacugcugacucugggcuucaguuugcucugcuggugaacagaaacagggacauucagggucagaaugcccagccugucauuuggcgauccacuccucuggaucuuuuccuagcaacacucuucacugucccuugcauugcauugguacuaccugagacuccuugccucucucugagcaagggacccccucccuaucuucccuccaacaaccugauuaccucccagugugcuuggcccccagaggcugaggagucugcugaagggccugccucauagaagacaggucugagguccgcagcuguaggcagccuggcucccgcccagcccaucagcucugccuucaucccucccuauuuccacagcccgcccccaacgauuuccucccuugcucagucacucgcugccuagugauccauggguuuuaaauuauaacugggacccaggaaacgcauuccuaaguacaauauucaugggcugggcugacacuuuuaauuaaggugauuuacacugaauuauccuuggaaauaaagaaauggugcacugcccgggaauaaaccaucaucaccagccgccuuuguaaguuacacuucguuuuaaucuauuuggggaauuguuuaucuaguucauuacccaaccaaacaccgaggccggccuuaaauaaggcuuaagugggggugggggcacugccaucuccacaccccgccucuucucuagagucacccagccucccucuggcuucuuugagcccuuuuaaagugcuggccagagagcuggcuucccagcucagaggccagaucuugaauggcuccagaaaccucccagagaaucucucuaaguucaggccccaccaagccaagcccaacuuuuagcuuugugcaaucucuccaugcccaaggcuacuucaucucucuggauggaaacuccugccugagggccacugggaagucugggggccaacuccuuccuccacccccgcccuucaaccuccagcccccaucuaucuaugucccugccugucucuccacacauccagucccucccccaucaccaacccagagacaucuuaggcugagcuugcccaacauccccuccuucccucagacacuugcuucucugccaccaucacucucccaaucauucaaguuagaaagcuuccucccaauaagcaccccaacuaaguccuguggcuucuuccuccaccuggucugucgucauucccucuucugcauccccacugccacugccacuguccugggucggccucaccaacuuuccccuggacccuggccgaccuccucccuugccuccuguuucuucccccaacccacacuccacacuggccuugcaaccaugccccucccacuugucucucucugaccaggcuucacccuggcucaugaauguucggcuuacucuccaccccaucaaggacguccuccagcauugaaggcccuccacaaucuguccuccaucuaacuuugcccuccuuguucuaccuggccaaguucuggggucugauggaaccccugugaagggguugagaaggggaaagauaaaggauggggugagggagagaguguuagcacagccucugaucucaaauggaaaagugcuuugaaaaguguaaggacuuugccaaaggaaguucugauugcucuuccuguaagugucugugcacccauguaccugugggaaugacacccaugggacaaggcuucuuucagggugugugugugggcacaucuguguguuggaaugggugugugugugcaccugcauguccuguauauguuugcgucugugucugaaacacagccagcccuggcucuggagcuggaagguuccugcuucucucugugagcccgugagugugucugaaauagcagccugcuccuaguggggugugcuuugugcuguugggcaaagggaggcaggagguggaacaccaggccagucugaagagccccuuaggaugcagucaaguggaggggggacguguccagguugauggagggcaccuggcggcagcauccacagacucaggagcuggcuaagcugaagaaggccagggagggcaaaggaggcaauggaggcaaaggcaggguaggagaggaaaagggacaauuggaggagagaagagggaggagucagcaggggaaagaagggcuggggcagagaggagaggggaggggaggagggagagcuggggaggaagccuccaaagaugugccuuugguggauggaacugcccugaugugggcucugcuaggacccuggaagugaggcacacacaggcucugcccuccugcgggccucaguuuccccaucugugaaauggcugguuucaggccccucugcucagggagcugauggugaggaguggagagggugucucaggaaccccagugugucaucuuuucccaaccuccucugcugucuuggcuucccgagagcgggcaggggcggggcaagggcagccaaggcuggggcccuccccgcgcuccccgcugaacggccgucagcccggagggagcugacacgcuccuugggaauuuaucacgcacccaauuacaauguuaauuggcaaguuccugaaaucaauuaauucgcaaauuuuuuccaauuaaaaauccagauaaaucacgagggcggcggcgggccgguccagcccacaguccggugggcgcagcggccgcagggagggagggcgagagaagcgaggggagggggcgcgggcgcggcugcccuugaacgccuuugccggccgguccaacugucagcgcgccgggcgcggcggggccgagacagauaaaaccaucgacccgucgccgccagcguuucggcuuuaucgauccgacgggaauuucacuugcugugcagaucccgcuguccggcugucagacacccgguuggaggggggcgcgugccgggggcgcagggcgcgcacagacggagggggcaugggcguaggggugcugggcugggccgcgacgugagggguacagaugcagggacgcaagacauagccgugagaagcauggagcuugggguggggaaauggacacggggaugcucugggaggaugugagggauaaggggguugugcagagucauggguggggguguggaaaaaggaaggcuguuggcagaagugcaugcccuggacauugcagguguggagcaccugggacugcacuguaguguggcccucaccgaggaggcagacagagagcugggggcccgcauucuccaggcccuuagggggcacacugcuuuuacaaggcugggcaugcuccucuagccucuaccucuauucucugacccugguaggagaaguccuccucugggagcaaauuacacaggacuccuccuggacagccaaaauauggaacccagcugcagaaggauuuuuuuuucccacuuucugccacuggcaggccaaucccaggugugugugggcgggggguagggauggggagugauuaagagcauggguacuggagucagauuacuuuagguuugaaucuuaucuucaucacuuacuagcugugcaaccuuagagaugucacuuaacuccucugcaccucaguuucuuccucuguaaaaugggagcaauuauugucaccuacuucagaggguuguugugaagauuaaauaaauuaaugcaauguaaaguacucggcacauagugagcauucaacaaggauuauuauuauuaucacugguauagucuuauaugcccauggauucuuucauacuccucccuucaauggguagagcuucuagagcuuaauucuucucccuugagaaugagcuggacuugacaacuugcuccuagugaacagaauagaauagaauagaguagaagcaacagugugugacuucccagacuagaucauaagaagcacuguggcacccuccuuagucuucucuuggacugcaugcucugugggaagucagcugccaugucauagggaaauucaagcuguccuaugcagagacccacaugugggggaacugaggccuccugccaacagccaugugagugagcaucuuggaagcagauccugcagucccagucagaucuucagaugaccguugccuugguugacaucuugacugcagcuucaugagagacucccagccaguagccacuacuacccacaaccauccagcuaagcuguuccugaauugaugaccacagaaacugagauaauacauguauguuguuuuagcugcuagguuuuaggguaguuuguaacacagcgauagaugacuaaauauuucuuccuucaaaauucagcucaggccuuaccuucugaggaagccuucuuugcucugugcuggguuuggugccuccuugauacccccaagcuccaguucuucccguauagcagucuccaucccucuggguuuguacugccugacccucccuacccucaugcuaugaacuuccaagggcagggaccauucugauucacuaugggauccccugcaccuugcauggggauucgguaagaagguagaaggaaggaggaucagucaagucugaugacuugaacugaauaagggucggacugggaggagcggggcagaccgucccucaguagcagauuauauuuuccaaagacagcaucaaccauaucuuccaucccacauacguuucuacaauuugaccuugccaguccucccaucaaaagggggguguauguccucuccccuugaauucuggguggucuaauacugccucaaucaauagaauacaguggaagugagauucagugacuuucaggcuagguuauaaaaggugauccagcuuccaucucguuggcuggaacauuugcuuuuggagcccaaagcugccaugcaagaaguccaaccaucccgagguuggcaagcuaugaggaagcccaggccacauggagaagcccuguguaggugcuuugauuccagccucagcugaggucccagcugacagccagcaucaacccccagacaugugagggaagcagccuucacaugacccagcucccagccaccaagucuucccagcuaaggccccagacaucauggagcagacaucagccaucuccucugugccuuaucugaauuccugaccucacagauuccacgagcacaaugaaaugguugcuuuaaacugcuaagauuuuagguaauuugucacaccucuccucuacucuuuuugauaaccuggcuccuccaccaggcccuugaggaggcucagcccaguccuucaggcagggacaagggagggaggcugggggugagguggggugggacagugggggacacaccugagcacauucuuaagauugucaucuuucagacacugagauucauagagaagguaguguccaccccacuggaggaaggacuuggcugcacuucugaggggccugccaggccuaggaccugcugcuuuuauucugcucugaggcucaacauggcagugcugggccuuuggcaguggcucaccccugucuagcuccucucauguuuuccuuugaggcuggggccugcggggucacucuccucccaucuccaaaaauagagcaagaagaggaagguggcuccauucagcggaaagaucugaggauugaaacagaguuguggagaaggguggcaggguccugucuuuucccgaggggcugggguaugggccaggcggcugcuucugggauccgguggccagaacccugaguggacuccuccagcaggcaggcucccugggagguggcuuaccucgagggcaguugggcuagcugcuccaguuccugcuccauaugcuccugcagcucacugggccucagcaggaccuggcagauggggcaaauuggggccuggcugucgaacaaugccgcugcuuucuucuuaccuagugaggggagaagaacagacagacgcguaagcugggcuaguccaggaggcagacccagcaucccaguccugaaacccaagccugcugcugcccucuagggcuucuuggccuagaggaggggccugaggguuucagagcccacgagcaccccuccuccuugcagcuccagaggcuguggccaugaaugguaccuccucagccagccaccccucucagaaaucuauuaggacacaucccccaugggaugucuauuuuuuuuucuuuuuuaaauuaauuaauuaauuugagacagagucuugcucuguugcccaggcuggaguacaguagcgugaucuuggcucacugcaaccucugccuccuggguucaagugguucuccugccucagccuccugaguaguugggauuacaggcaugugccaccacacuuggcuaauuuuuguauuuuuuguagagaugggauuucaucuuguuggucaggcuggucucaaacuccuggccucaagucaucugccagccuuggucucccaaagugcugggauuacugcgccuggccuuauuuauuuauuuuuuuuauagagauggguucauuauuuugaccaggcugguuucgaauccuggccucaagugauccucucaucuuggccucccaaagugcuaggaguacaggcaugagccaccgcaccuggccggcugggauguuuaaaccgccucuguugccacuuguggagacacacaaugcucuguggccucugcuuacaggugugggguugaagagcccuauuaauccagaaacaucccugcauauccauggaugcucuguggccucugcuuacaggugugggguuggggagcccuauuaauccagaaacaucccugcauauccauggaugcucuguggccucugcuuacaggagugggguugaggagcccuauuaaucuagaaacaucccugcauauccauggaugcucuguggccucugcuuacaggugugggguugaggagcccuauuaaucuagaaacaucccugcauauccauggaugcucuguggccucugcuuacaggugugggguugaggagcccuauuaauccagaaacaucccugcauauccauggaugcucuguggccucugcuuacaggugugggguugaggagcccuauuaaucuagaaacaucccugcauauccauggaugcucugacugcacaaaggacuuuaguuugagcccagauuuuccuuccuucuucuucuucccacugguuccuggagggggucaaaaucagcuuucagagagauaaaggccaugccagacaugagcaagaugguugccuaagggguugccagauuccacacaggaugcccaguucaauuugaauuucagauaauaaauuuuuuuuuuguauaagcaugucccaaguacuacacgggacauacuuauacuaaaaguuauuuaucauuuucuagaauuuaccuggaugucccauauuuucuaauuuucuaaauuuaccuggaugucccauauuuuuauaugcuaaaucuagcaaccuuguacuugaggaagccucaaguucaggcugagcacaaaacccaccucccuuugacaccagacugaggaugauuacggcucccuuggaugcccagauagagucaucugagggcuaaaacgaaggaggaauucuucguuuggcugugaguuuugaggacuggaaaaaagagaagguuuaaccaaagaagugaaauuuaagcuguaccuuagaaguauaucaggcaauugaacgaguuaaugaauaaguugugaguuccuugugggacagaccauuucuuaucuaucuuuauauuuauagacaauuuauaucaggucuggcauagccuagaugcuccaugaugaagcaaaagagaggaaaagagaaagggggagaagaaagguggggaugaagaacagacuguccuagaagccagauaaccuuuggagggcugggacagcagcuccagccauccaggaggcuucaguccguguggcaaggucucugaggaggggaggaaguccuacugaucagguggcugugccucagaugcucggggacagcuggagggaagcucugaguaacagcagcagauguggcccaggucugggaggugggagaugaggcguccagucucagcucugcuccugccuucaguuagccagagaaucucacaggugaacaagacccuagacauucuccaggccauuuuauuuacagcuagggcaauugaggcucagaaugggacacagaccucuguacucggcuuuugauuucacuacuucauucuuucacucagcaaacauuuaacaauuauucuacgucagguauuauucuaggagaaacuggagcucagagauaaauauaaugcauccuuggccucgaggagaacacaaauuaguaggaaaggcaaaaagagagcccgugacugcagucagugcuggugagaacuaugaggaggauaugaaggauuugugggagggugggaaggggccagcaagguuggcaggaucugugggcgaggugaugcucagugggaggcacgaggagugaguaagggaguugacagguugcuggaacagauaauugaggcagggacuggggucugaagggggcaaugguaagacaggagaauggagaaagagguggaucccagacauggggucugagcugagcuggaaauaucagggguucagcccccauuagccugguacaccaagucugguucuuagggcuuccuggagcccagaugucucacuccaagcauggggaccaggcgucagcauucccacauaccuguacucaguucaucugcuuugcugccacagggacauucuacuuuucugagcuuggccccaguuucccuaucaggacaacaggcccucuuccugccuccaagcuucaggaauagcauuggcagggaucagcaaagggacucugcagccucugcccuccaucccacccccauuuucucagggguuagaguggcaagugucagcauggccaugggcccccuguguccccucccccgcuguguucucuauaauuuuauauugagaccuguggucaugacguggguuuuacugcacuaacgacauggccugcccagguuuaaugacaaaauccauacucuggcccugggccugcuccgcguuugcauaauucccagaauacagcucccugaagcuuuugaccugggccauuacaguggccauaaaacgggccauaaaaaccgcuggggauggccaagacgagggggcuguggucuugcugggguggaaaugaagcccucaaccccauacucuuccuaggcuugggaggaagcauccucuggcucuuccuuuccacagcucccagaaucuggaaguccauuucaggcuggcgaggccccuggaauccuuaguucagcugcccauuggaugcaggaaucccuucuccaauacugccggcagcaccacaggugggcaggccgagcccaccagaggcaggcugucagcaggcauccucucgaguguuccucucuccagcucaugacacuccccaacccccaaaagcuggccaaacccuuuugccacaugugggucuaggucacacaggccugguugaauccugucccuccucaggaggccucgcucccucaggaggucaggagcugggcugagcagcauaguggggauaugcgggaagcacaaggggauggggauggggacagggacugggaugggcugucagugcuaaagaugaugaaugggggaggugaggcgggaggcccaguguuaucggcagaggauggcgggugcgggcgcuugccguuccugcuaauccccgggcgcugccucagcccuugcacugauaacgaggaaaugggacugacaacaauuuuuagcugagagauucuucaccaaaaugccaggcggccagaggucugacagcgccugauugagugugugagugcguggggggaacgcccgcagcccccuccccucccaugcaaagauggaucgcucauuccgccucccguccacauucauuaccucaccucccuccccaccgccccagucgcggagugccugccaccuccacuucucugcuugccacagguaucccugcaagcaggaggagggcagggaggggaggggcucugaccccauccucagccuuacacagggcaacuccagcuccaagagcagggaggcgacucugcagaggcagggaccgggagucaggggaaucaggucccagccuggaggcucccuaaguuguaugaccuccagagagucccuuuuccuugcugagcugcuagaauaccuuuccugcuggacaacagugaggcuccaacagggagugacugaugguaagcugcgaaggacaggccugucgaggaggagagaagaggucaugccaaggcagcccucuuccuagcuugggccaggcuccagccagcccagcccucucgccucgaaacaaggccucagguacccgggguccuagaucagcccucugcugccccccucuguugggaaugguugaccauugggaacaggcaacucaagugccggcacaaccugccccuucccugccaucuuccacagcgaagccuggugcagaauuggacauauagaggucgggcgucuuguucaaagggaaagcccuccccuccuugaccacucacccacgucuggccuugcagcuccccaccgugugauugccucucuggcuuggcauguuugguuuugucccaguucuuuugcaugagaguuccauucucgccucugcuuguccaagcaacaaauuccaucucuauuuuuucucuacagaccacaaaaggcauggcuugaucgacuggugucugacagggaugaggaggguugaaaugagggugagggugacuguaaugacagauggccauggaggcugggacuuuuaagaguauguguguggguauauguguguguucauguguacacacguguguccuaccccaaccccugcaauggaaagacuuccauuuccuagugaccaagaaacaggaacuucaagcagaauucaacagagcugccucuugcuagcugugugaccuugggcaaaucacuuaacguuauugagcuucauuucuccuugugugaaauggggauaaugauaucuaacucccaagacuucugugaagauccagugaaaucagggcuguguacaagugaggagucauuagugccuccaguaacacacuagcaaaguuuguuguuugugccuauaucugccccauccugacaccugcccugccuugccuauaucuggccuucuucccuucuaugauccagaucuuuuaccacucaguaggugcccuggcccuagcuccucuggcccccauggaguuccuucuuccuauccaucauuacccauauaucugguuauugguuuauaugucgguuuauccaucuguccaucuaccuaucaucuauccauuaucuguccauuuguaauaacaacaacugucuaucaaguaucauuauauauuuggcuguaggucaauacuacacauacuuuaucucauuaauccuuacagcaguucugugagguagguguuacugucucuaucacacugaugaggaaaauggggcucagaacaauguggugacagcuacaaaguucagagcagggauuuaaauccaguucugucugaauccagaccugaacaauacccaacuaccuaccuaccuacccacucaccuagcuaaugauucaauaugacuccacagauguuuacuggaugcccauuaggggucgcuauagcacagaugccagacaauaaugaagacaggcgcacucucugcccucagggagcuuaggaccuaacaauggauagaaacaugaaacgauuguccccagaguggucuuaggaaaagaaaaguacauggggccggugugguggcucaaaccuguaauccuagcacuucgagaggccgaggugggaggacugcuuaaggccaggaguuugagaccagccugggcaacacaguuagacccuaucucuacaaaaaaauuaaaaaauuagccagcugugguggcaugugccuguagucccagcgacuugggaggcugaggcaggaggaucgcuugagcccaggaguuugaggcugcagugagcuaugaucgcaccacugcacuccagccuggccuacagagugagacccugucuuaaaaaaaaaaaaaaaaguacacagaacuaggggaguauaucaucuggucuggaaggugaaggaagugacauucagcgaaggcugaaggaugcgugggaaccagucaaacagugauugggggaaguggugcucuagauagaaaacagcacauuuggccgggcgugguggcuuaugccuguaaucccagcacuuugggaggccgaggcgggcggaucacgaggucaggagaucgagaccauccuggcuaacacagugaaaccccgucucuacuaaaaauacaaaaaaaauuagcugggcgugguggcgggcgccuguagucccagcuacucgggaggcugaggcaaggagacuggcaugaacccaggaggcggagcuugcagugagcugagauugcaccacugcacuccagccugggugacaaagcgagacuccgucucaaaaaaaaaaaaaaaaagaaaacagcacauuugaagguauacaggagaaagagccuaagugaggaacuggaaagaguccaauguggcuggagcacagagagugaggggcagagugcugagguaugaugauagagagggugcauccuggaggacuuuuaaacuacauuagugauuuugguuauuuuuuuuaaacauacaaugagaagccaucagagaguuuuaaacaggagagugauauaucagacuuguauuuaaaaaagauuauucuaacugcaaaguagccaguggucuaaggggcaagagcaagugcaggaaggcuguuuaggagguuaucucacuaacucaggggagagacgauggcggcuugcucuagcaugacgaugccggagaugaacagaggcagauggauuggacguggaaguuaagggacagaaaagaguuaaggaugacucuaagguuucucgcuugagcaaccucuaggugguagaacauugacugauuuauggaaugggaggaggagcagcaagcuugguaaggaagaaaaugaguugaguuuuggauguacuuagcuugaggaacuauuagacauucaugugaaaaugcugaguaggcacucuaugugagccagagcuagaguucuagacccgggagacauugacauagagcaccgaagcucaccacuguguccucugugccuggaacaaugucuggcaugugguaaaugcucaauaaauauuuauugaauaaauaaaugaaugaaguucagaguaggcaagaucaccuagggagagagaauacacuaggaagagugucuggaacagaaccuucguuuacaguuagaggaaguuuaaggcaucaaggacuaagaaggaacagccaagagguagaaugaaaacaaggaaagugugaugucauugaagccaagaaaggaagaguugcaaggacucuacuguccucaguaaggucaaaugcuguugagaggucaaggacauaaggcaugaaaagcaucccauccacucaucuuauacauagcacaaccaucuacccuccaguucauccaccugucauccauccaaaccaccuaauuacucauccacucuccccucacucagucccuuccuccuucucuuaaaacuaugauuggcgccucugcugaguaugggacagcaagaguuaacaugcugacagauggcauuuuuuaccuucagucaauaugaacgaggccccaagacuaugauuccaaacaucuggauuucaucaauaugugaucugucaucguauauuggcauuccccagucuccgggccagagcaaugcggcugguuuuauuaauacgucaaauacauuauccguguaauacacuugucuggcuggggccucccgcuggggcggggcagcggauuugaauguaugaugaaucaguuugcauuacauguucguaagucaucauuugucaggauuaauaggcaucccugguugaggagguagggguagggcgggcaggggagagauauguauuuagcuguggcccaugcuuucuucuggugcccagggauguccugggaacagcugugcacccucuugcccagaccccaggguaguggccggugcccguggggcagaggugacauuuucagcaguuccagagucacuuggaacccaauaggccuauuuguuucugcuuugggcuugcuaaacaaccaaaaaggauaggacaggggcuaguugcacaaccuggcuaacucuuccucauccuuuaggaugcaaccuaggguuccuucuuccacguggccuucccagacuccuccagacuguauugggugccuccucuguguucccgaagccucuugugcuacuucuaucacagcccuugucacagugucauuauugccuguuaugauucuaucaccuucuuuagauuauaaauuuauugagggcaaaaauuaacuuguucccugcuauagccccagcauguagcagaaugcauagcccaaagugagaaaauagucauaguaauaguagaaaucaauaaauauuguuugaaucaaugaauaaguaaucacugaccucgcuaaauccccaaagaggcagaugccagcugggagaugccaugggguuuuucucugauuccuugucccacccugacucuggucuagucuggucagcuauccuucuauauaugcuuuucuuuucuuuuuuuuuuuuuuuugagacggagucucacucugucacaggcuggagugcaguggugugaucucagcucacugcaaccucugccuccugcguucaagugauuauccugccucagccuccugagaagcugggacuauaggugcccaccaccacacucggguaauuuuuguauuuuuaguagagacgagguuucaccauguuggccaggauggucucgaucuccugaccucgugauccaccaccucagccucccaaagugcugggauuacaggcaugagccaccgcgcccggccccuauauaugcuuuuaucuguuccucuucuuucuguaagacauguauagacccucucacacagcaugagguuccuuacaugugacacacauaccuagauauaauacacaggugugaaacauucauggcuacauacccuugccaucuuuccuucucccuccauucugccugcagaaacucaagguuggcacugcccauuccacauggccuccugccagcuccagguacaagagccugacuccuauggugaugcaugcuauuuaccaucucuagcaauagaaggugccuggauugagccagacauggcuccuggguggccaguggcaaacaucugcaagacagccaggugaagucagucuauggacagguuuaggcucagacuugggcucaagcuggagccaaaggcuccaggccaaggcacaagcaagcucacugagucuuggucauagaagcuaaacccuugaccccaugagccuuugcuccggccaaaggcaccagccaaccuguucagagacuggcggggcuucaggggccacagcuguuucacacccaugaccuuggcuauuucaaacauaacuacagccucuguccucuuguggagcuacaauucaguuucucuccuuuagcuaauaacuuccagacaucucccuggguugggcugggccaguggaggguggggcaggcagggccucccagaguucccugggauuaggcuucacagacuacagugaagggccugauucuggaaaauauccacauguggaccugcacaugcauccucucaagugucuggacacacacaugcuugugcuggcacuggcacacacaagugcucacacgguguggguauuuuuuugcauuuagacaaacaccugagcaccuaucacuauaccugccuauucucccuagccugcacacacacuucacucucucucaugccuuccuugccaugcagccaaaaugcuaagacuguacuguuuaaaggaaaguaacuucaagugugcuuuacccccugcugguucugacgaugggcuuauaaaaaugaagugggaaccuccgcagcugugggcaauaaauccugagcugccaaggagggcaguguuaccugcuuucuaggcugauggguggaccguggggcacugauuacaagugccugcagggcuggaugggcaaugggccagcugccuggccucaggcgcugccugcuagcacaucccaggccagcugccucccucacaccugagggguuaagagacccagaacccuagggagggaacaaggacuaugagagcagcagagggagguagaggaagaaaagggcuggguggggagagugagcagccagccacgugcugcuaaggcugaggggagcccuugcaucuggagaucaauuagcaucaauuacugacuucauuuaauugucguccaagaugaauuugucauuuuuagcugggaauuaaugggagaccuucaccucucccuggcagcagcggcggagccaacaauggucaccucagccucccaggagcucugaauccugcuugggucugggcccagacuugggcaggcaaauaguggggcuucugcucccugggugagcucuggccugccccaggcccugcuggccuggcccaccguagcccggggccaaggugggggcaguggguccuggguagcaguucuuugcagccucuggcuucagccagaaauuaauuugcugggcugagcauguuuaccuuuucccagcaaaggcgagacaguaaacagcggaccggcggcugaaauugaauugauaacugcaucaacgugccagauaacgccuaaaauaauacgccgauaaggaaauucgauuugauuugcugcugcgcaucagauuggccccaucuguagcugccuguaaucauuuucaauugcguugggaaaccuuauuuguccuuaaauauuucugucauuuuucauugcuggugacagauccuugggcagguggcaggggugugcugccucuaugggcgcaggguggcggcccgaggaggaggaggaggggugguguggacucggagagaaggaggcagggagcaggcagccgggcggugacagcuguuccuccaaucaaucacgcugucgacagggagggacgacuggcuggcagaaauugaguuugccucacaggggacgauugagcaaauuaauagcccauuagccaagcagugaccugagaaaugaaggugcagggguuccugcucacucaggccggaugggguggggcagggcaggggaagggucuggagaggagagaacuaaggaggagugugggaagaagaggaauggauggauggaugagaugagcgguaugugugugugggguggagucgggagucagugaaggaggagggacaucaaguuggggaaggcaggcuagagaugcaggcaguucugggagggaugcaguggacagaggguagugguggagguagcuccgacugaugucucuccacuaccuucccagcaugaccucugggacagaggaccaugccaauaaacuccucuccauccgcagucucuagauacucccuuuacucucucuacucacuuuccccggaaccuggagaugcugccacucaguugcuguccucuccacugcaggcuguuuauucucccaacuccaugcuccucaggccaggcaguggacucagugucuuccagcucauugcuucuccacccucuggacucuuugaggucaaguaccaugcuacagcccaccuugucaguuaccuaccauucucuacacucacccaggacuuucacacuugccucucuccccgaagcccaucacuguccugaccuccucagcuccuauuauuuuuuuuccuguucuugacuuccuccuggagauccuugucaucaaccuaaguagaacccgugacggaacucccucucccccaagcccucucaaagacuuguauccauuuaacuugcuccucccucuucccuucucccaacucccaagccaccacgcacucauggaugcuagccugggucccuugugcaccuucaacaccaucuugccaacacacucaacuucuuacuuccuuugccuucuccacaacccaacuauucuccuuuuugucucagacacucaggcggcuaagcacagcuggggaaaaucacaaaaccaugcagauaugugccaauaaaaauucacaguuuccaaucucagcaccacuaaacaauccuuuugcaugcucuuggucagcuccgucuccucuuucccacagagacaauucaauaauauuuuacuaucuugagccgccucgccaucuccugucccccucucucugcuagguggccuugcuuccuccuucacucugaaauuuaguccuuaggcaugaauuuccucagcuuguggaucuacucucaccucccuguucccuccaguuucaguggaacaggcauccuccuacuuuagccuaaucacuucuccugggcuuugauaccaauccugccuauguucccugggaaaacugucaaguucucccucucuacugcaucuucuccuucccuuccucaugcuuuccuccaucagcauaucaacucccacgucuuucccauauuacagcaacaucagcaucaacaacccagcucucucuuccauauggcacccuuuuacuaauggccuuuucuucuccuucucuucucaccuaagaugcuccaaagacucuugcuugcugcccauacuuuuuuaccuccuaaccacuucuuaacucaucgcaaccugaguuucauccccaccauucuaugguaacuacucucagugagguccuuggugaucauccacaauagauacuccaguuauauuuauuuauuagcccaauaaauauuuguugagugccuuccaugugcuaggcaauauaccggggucuagggauacaaugagauccauguccuuauggagcuaacagucuagugagagaacagaugcaauaacauacuuguacaauuguaaaauugcaauuguaccaaaaagaggucaacagugcugugggagccuguaauauagauauuugccuuguucagagaaaccuagagacacaagcugaggugugauagauaaguacuuguugaagagaugaggaagaagggaagugguaacacuaaucaaaugcuuacucuguggcaagcacuguacuuuuuuuuuuuuugagacagagucuugcucuuguugcccaggcuggagugcaauggcgcuaucucagcucacugcaaccucugccucccggguucaagugauucuccugccucagccucccgaguagcugggacugcaggugugugccaccacaucugucuaauuuuuguauuuuuaauagagacggaguuucaucguguuggccaggcuggucuccaacuccugaccucaggugauccauccaccucggccucccaaagugcugggauuacaggagugagccacugugcccggccagcacuguacuauuuaaucccuauuuuauaaguaaggaaacagaggcguagagaaguucuuaguuugcccaugguuacgagguaaguggcugugugggacuuauguaauaccacagccccaugcaugcucuuagucacgcuauucugcugccucugauguuagcuauugcccuugucaucauucacuucucccucucuccacacucuaugugugaucucugaaacucugguuucauucccucagccuguaccuccaaucugagccacguacaacacugcguagaagaugcucugcuuggaugucccauaggcucuuuaagcucaacaugucugagaugggacuuaccuuccucuagaccugcccuccuccugcuuuugguuucagugaaugguaccacuauccagagaccucccuaaauugacaaucuuaauuuuuacucuuuacuccagucccuacauccaguaagucaacaucuucccuguuuuuaccuccuaaguacuggucagaaucaucuucuuuucuucauugcccuaguuuaggcaucuucauauucagucccuacucuuaggucuccucauguaucucucuccccucuaaucuauuccaucccuacaguuacaaggaucuuccuaaaacacaaaucagauccuaucauucagcugcuuaagauccuucccugguuccuaaagccacagcauacauucugaacucuuuaucauacaugccccucuccagccuccuaucccaucuugcaauagugugugcucuggcuggacaaaauguagcucuucaucugguauucucacugccaauaaugcucaugaccaugccaucaucuccccaugggcaacuuuuaacugugauuuauuccuuuuuuauuuugagacugggucucacucuuuugcccaggcuggagucaguagcacaaucacagcucacugcaauuuccacugcugggcucagugauacucucaccucagccuccuggguagcuacaggcacacaccaccaugcccagcuaacuuuuuguagagauaggguugugucauguugcccaggcuggucuugaacucuugagcucaagcaguccguccaccucggccucccaaagugcugggauuacagaugugagccaccgcgccugacccuauuuauucuugaagaccacacucagacaaugcuuccucuuugaagccuucccuaauaauuaacuacucucuuuuucaugcuauguuccacauaugucuauaugucgauuauugcauacaucauauaauauugcaauuauuuauuuaucugucuugucugggagauucugagcucuuuguuuuauuuauuuauuuaauuuuuuuacugcuccuuguggagcagggcuaccccguaggcagugugcccagaguagcugaugcugagcuucuugagggcagagagauucucugauucauccuggaacacucaagacccuaggcauacagucuggcauaggguggguauuaguaacuguuaaaugauucagggacuaagugaaugggagugaaaggccugcaggagaaugucuggaaaaaaagagagauggggugggggaagugugagggugagagagguggggauaggggaaggaaggcaauugaggcaaugccgaaaccuucuuuugcuuaaaugaagccuugcuucauggucagugagagucagaggcccuaagggugucaaaggguagaagcucucgaaauacagaagcuccagaacugcucuccuuaccaaaauaucaaguggucauagaccuggugggaaaugggugaccagugaccaugugaacauaaccagacagcaaaaucccaugccuagaaacacugacagacaugcacaccaggacauauggccagucacgugcuccuagaggguccccagcagcuccccuaucccagagcccucggcaggccucucugugggcccaagccccacccggaaccccugggcugcacgcuuucucucucucacucagcaauuucccuacccaagaaagcucuaaggguuucaauuaccggcgugugggauuuagugcccugggcuucucugacuggaggagauuuauuugaagguuuagugucguggagaauucacgucuucacucccaggagcccagcuuccguccugagccccuaaaucaggaaccaagaugggcuauugucacuuaccgcauuagccucguuagcggaccaggaggggugauuaauagcaauacacacacagccaucuugcucgcuugcagcuccugcugcugcucaugaccuggggagggguggggaggagcugaaccugcuccagaauaacugaggacucugggcuuagcccccucccuguuucccccuccccaucaccaggcaggaaaguccacaugaccauucaagaucuggggacaguucaaagauuagcaagccuagccagagagagcacaucuggaggccugacucuuggagggggcgggcagggggcaugagggggcugguuucaggauaugucccaaaguguacaccuguguucgagagagaacgagagagagagagagagagaggugggugggguggggugugaggagacagugggggguuguaugugaaggagguagacggguguauguuuauuucauuucccaaacugucuuugagacuggagauagcgcacugaggaagacagacaagggcgccgggaagaggaggcguguacaugagagaaagagguccauguaagagugagaaagaccaagaagugugcaaggagaaauaaaaaaguguggcugagagaggggugaauaugugcaugugagaggcuucuaugagacagagaggugcgugugugccggagccaucugggagacauucgugagaaacggugugugugcaagagugggugugugaggggagaugagagaaaggggugcauaacagacauguuguguaugaaaagaacgugagagguguggaugggagggaggggcacagcgugagagagggaggugagggagguucgugugugugugugugugugugugugugugugugugugugugugcaugagagagagagagagaagggcguguauguauguugagacagagaaggauguacguuuucugucuuguuuuccuuugucucuucaaauucuccccuccuugccccuuuuccccccaaaguuuuuggagccaugcuaaccuggguuugaauuucacuucuggcuacuucauucauuuauuuauccauucauucaccaaauuauuacggagcaucugcuagcuuuuaccuuccugugccuccuuugucuuaccuauaaaaagaagauaauaauuauacuugccuaacagggugauuaggauaccuuggugguauaacuuacauaaaaugucucgaaagagcacagaauuuggagcuggaugcacucuauagcacagcaucuggcaugugggucaggaaaugguagcuacagagcugcagcuccucugccaaucccuuucucucuucuuuuuccaugucccuuauccuccucccuuccucucucccacucgcuuguucucucucaaucacagcugagccauaguauuaauuauuagaaccaauugacuguuuagacucugauguuuuaacuaaucaccacuaauggcaaacacuggugggcaaucacauucauuuaguucuugggcaaacuccucauaguugagagcggacuagagggaagggauccagcaauaacuggcauuugggaaugaugggaggggaggcucacugcugccuagaaagaggcccuucucuccucccugggccagccaggucccuugggaugggucagcugagccuugccuuggaagugggucggcuuccuucccuaucguuuuuccuuuauuuauuuuuuuugugacugagggaagugguaacacuaaucaaaugcuuacucugugcaaagcacuguacuauuuuuuuuuuuuuggagacagaaucuugcucuugucccccagguuggagugcaauggcacgagggcucacugccaccuccgccucucgaguucaagugauucuccugccucagccucccgaguagcugggauuacagguaccugccaccacacccagcuaauuauuguauuuuuaguagagacaggguuucaccauauuggccaggcuggucucugacuccugaccucaggugauccaccugccucagccucccaaagugcugggauuacaggcaugagccaccgcacccagccccuucucugucuuuuuacuucucugcccuuuggccucagucuccccuuuugacuuagaauucuuucaugggagucuccagaaaccacuacaguggaaauaucccagaaauauccuaccugcuccccuuccuugaguugcuuuuuaguuguuguccuuccuaaaaguccauuuccagaagagucauuuagacauagguucaaaaaucuuugcucaucggccaggcauggcggcgcacgcccguaaucccagcacuuugggaggcugagaugggcggaucaugaggucaggagaucgagaccauccuggcuaacacggcaaaaccccgucucuacuaaaaauacaaaaaaauuagccgggcgugguggcgggcgccuguagucccagcuacucgggaggcugaggugggaggauggcgugaacccgggagguggagcuugcagugagcugagauugcgccacugcacuccagccugggcgacagagcgagacuccaucucaaaaaauaaaaaauaaauaaaaauaaaauaauaaaauaaaaaguaaaauaaaaaucucuguuccucacagggcaucugcuugaugcugguuggaauggaaagcuguacccuguccauucuggcugaggguuucagugaagagagcagacaaacacgugcucaguauugcugagucuggagagaaugccagggcuggggaugugaucugagcaucaugucccugagaaaacaccugcuuacugauccugucuucuucacacugaggccccagagccccagccugcacacaacccugcugugcacugagcccuggcccauccuguaccugcuccccuagucugucccggggagccagauucccagaacucaggaaugccagcuucagggugcaggacuggcugggccagauggaccacagggcccgggcguccuggaggggguggccuagguguccguggccaguaggugucgcuguggcuccagcacugggaggggguguuaggcaggggccccggagccggccgagguguugggugcccuuuggccucccaccccuaccucgggccuuccuucacucagagccuucaccaggcuucucacacuuucuuuaaguguccauggaacacuuggagguuaaucuaaaacgcagauucugauucagcagcucuagaguggauccuagauuuugcauuucuaccaagcuccuaggugagaccagugcugcgggucuguggaugcucuuugaguggcaagguccuaacuaaacggcuccauaguggggaggcacuggcucugcugucuuccaaagccaaucuucacccucacuccuaugucuuuaaauaaagccccgaaucagaggccaaggguagagcccccucuuuuuuuggagaugggcuuagcuagaccagcaugaguugggcaguuucuagagaagcucugaaccuaaaccuaacuccaguacuuugaaccaacccagcccuaccuccuagcccaaguccuaaacuucaauccaauccaauccaaauuccccaaauuaaccccaguucccaaugggcuauugauugcuucaguccugucccaagaccgaaugcccccuuagccucucugauaaccuuccugguccucugccauaccuucuucuggauaccagccugagccagggcgguggggcaauagggucuggggacacaugccuggaucaggcucuuacagaacucagcaagggagcucaggcauugcuccagacaaaggaaaagagcaauuuggcagucuaguugagaacaggcucucccugcucucccagacucucccugcaaggccauuucuguuggggaaaguucugucucugccuuaccccguacggcucugcucugcccgaugggcuccacuuccugggacguggggaaggcugggaggaagcauguccauuagcccagucccaagugcaggugaaggggguaggauggagggagugaaaggaggaggagggaaugaaguaacaaggagggagggggggaggcaaagcgcccuccagggcuuuucuuuucaaaucaaaguuucucuugggggccuuucacuuuucuuuuucuguccacugccuggcccuucuggguagugcagaagcggauuccugcaggggugguagguuguuauucaagcuggacuauaagaguuuaucccuuuuuuuuuuuucuuuugagauggggucucacucugucacccaggcuggaguacaguggugccaucucagcucacugcaaccuccgccucccaggcucaagcgauucuccugccucagccucccaaguagcugggauuacaggugcccaccaccaugcccggcuaauuuuuguauuuuuaguagagucaggguuucaccauguuggccaggcuggucuugaacuccugaccucaaaugauccacccacgccuuggccucccaaagugcugggauuauaggcgugagccaccaugcccggccaagaguuuaucccuuuuaagucucauauuuugugauuuuuaagagugcaauuauuuuauuuuauaucauuuaaaaauuuuuuugagacagggucucacucugucacccaggcuggugcaguggcgauccuagcucacugaacccucgaacucuugagcucagaugaucaucuuaccucagccuccugaggagcugggauacaggccugugccaccaugcccagguaguuuuuauuuuuuguagaaacaggcucucacuauguugcccaggcuggucuucaacucuugggcucaagcgauccucuugccuuggccucccaaaaugcugggauuacagacaugaggcaccacccuggccuguuauuauuauugauaucuugugauauuuagcacuuuagauaugaaaaauuucuuuagauagggaaagguaaaaguugccugaggucauguuggucgaaagcuuaaaaaugaaacuuugggcuccuaauaguccgaugcuguguucugacuccuacacugaaaacaucuggucaaagaaauccuuaucaggacugugauaggacagugggucucaucucuugcugcccucugcgggucuagggcaugggauggaacagggaaaagggcuuugccaaacaaacuggugggucccugugggcuggcucaggcuugggccuguguugggagagaagauuggguauggucugcuccuggaucuguucugugucugccugcugggcuucugugaccaaaagagagagcuguagagacaccauggcagcucugggcccaucccccccaucaaaaacuccuuccucucuccucaagcuuauauccucauuucucuccacauggcaucccccucuacucccacucccugcguccuauccugguggcuccauuguaggcagaaugcgagggccagggcugggcugucauagggaacaggaguuaggcaaagagcugggagggcagaacaugagcuuuggccucggggagaccuggucuugaaagcaccuggaagcauggcuagccaugugucuuugggcaacugcuguaacccauccgagucuucuuuuccccaccuagagacugaggaugauaauacucacccccaccuugcuuuaacaaaugaaugagaggagcguguaccaccugaagcacagggacuugcagaguggcucucagcaugccuuccugccccaagcggggaaucacagagcagguaugggccugggagugcagagggcgggggcugccaaccugggagcccacaggcucucgaguuccuccucccaggaaggccuggcccuuccccaggcacaguggucaguggccaacaggacaacacagggcugugucaugaggaaggcagcugcguagggggcugggcuggauguugugugcaauaagggccugagacagaggggcagcugggaggccuggccaggcacagccuguuaccagcugcgcaaugggccucucugcccugccaccaccagcucccccuagcugaaaagugccagucccaggcucccuugcucuccuagcucuugguucuaagcacagaguggugcugcgggaaggaauucggggaaguauaccacgacugaggcuggguuggcuugaggcagagccuucccucgcccucucucucucugucuguuggucuguuucucccuuccuucuucucucauuccuuucauuuuuaucauguccuuuuccaaacuuaguccuggaacacccucaaagauugugggccaguccucuggggguguggaguaaggagugaggcccaggcucagaagcucacaggaugggggacggcuugagcaccuaagauaccacugugaggaugaagugaggaguaaggaggaggaggaggaggucagggcucggagguggagagggcuuccuggaggagagaagucuggagugucagauggcaagagaaggaagaguggagugaaaauuaagacaaaggcccagaggcagcccagcaggacuaguauggcuggaggaggaggaggacagaggagugagaggguccaggcucuaaaggugaguggggccucccaugggccuucuuucugcgggcauuucagagccgggaggacuuauagaccauguuguugcccccucaauauuuagacaggaaauuguggcuugugacuagaauauuccuuugcagaaguucacgcucuggccaugccucuaaccacacccuaauaagccagggacuggcccagcacaaggcaguuggauccuuagacauggcggacguagcuggaauuacugaccucacuuaguaagaauaaaaccaagacucagagaagucaagcaagauaccuaagucccacugcaagugcauaauggcucugggacuugaaaggacuuagauuccuuagcaaggccugcaagggcauugcgcauggacgauaggugaccugccagccuccucucuugcugccucucaccuugcacaccauugucuuggucccacugaauucuuuugguuucucaaaugggucuuuaaacauguuguuccuggcugggugcaguggcucaugccuguaaucccagcauuuugggaggcggagguggacagaucaucugaggucaggaguucgagaccugccuggccaacauggugaaaccuugucucuaccaaaaauauaaaaauggcguggugggugccuguaaucccaguuacucgggaggcugaggcaggagaaucgcuugaaccuaggaggcggagguugcagugagcugagaucaugccacugcacuccagccugggugauaagagcgaaacuccaucucaaagaaaaaccaaacagcaaaaaacaaaacaaaacaaaaaccaugcuguucccucugccuggaaaacuaucuuccagggcucagcuucaagguuaacucuucuaggaggcaguacuaucagaagcaucuggcuagauuguguguccucuagcccccaagacuucccuaauugugauuacacuuuuacuugucuauuucuuuaacagggccuggcacagugagugacaucaaaugaaugaauuaguggaaggugaaugaauccucccuggcccccccgcuuccuauucaucaucucugguaucagcggcauccacuccccauggccuccugaguaauagcacugggcauggagcuggacugaaagaacagagccugccaggggcaaacauucuggggagcggggaaccggacacagcagagaaucacccaaguuuaguucaaugcaagaccuagccuaaagcaggauguauucagggcccuacauauaaagccacuguugagccaugagagcucugaggaagcauggggcuccugcaggcugggaaaguaccacugagaggaagccccgugaaggauggagaauacugagaucauggagagcacaggaccacaagcuugggagcagggggacacaguaguagcaaaguuggauggaggaaggauuucagccccuccccggacuuuccuugcccagcagggcuugggcugcccagcucaccaaagggccucauaugagugauugccuggaaggcugguccuucuaacaugcugaguggaugagcugggauguccuaaaccacaccugugaauccugguaccagccugcuccuuggcucagggaucaucacagaaaacgcaugcucugaagaccauaccugggccagcauccgcacugccacagaaccacacacaucagccccacugugcccuguccauccccauaucuggcuuugccuugggcccaugaccuucacccauuuuuccuguagcguuuugcaucuuaauuugcaccaggguccagagccugcucaccucccgugcagccuuaacuuaaaccagcugauugugugcaccccuucucccugccucauacccccagaccacgagcaccuugagucaaggaaucaucauauucuuuguagucccagcuuagguguuguuuauaaacauauauuaaauuaacuauugguagagacagaaauauaagacacaagggaugaggauuuugccuccuuaagccaguuuuuccauguaaaauggagacaguaauuccuaugaccugggaauccugugaaaccuaagugaggucaagacuguuaugacuccaccuuuaggagguggauauuccuuuuuuuuuuuuuuuuugagaugcagucucgcucugucacccaggcuggagugcaguggcaugaucucagcucacugcaagcuccuccuccuggguucacgccauucucccgccucagccucccgaguagcugggacuacaggcgcccgucaccacgcuuggcuaauuuuucguauuuuuaguagagacgggguuucaccauguuagccaggauggucucgaucuccugaccucaugauccgcccaccucggccucccaaagugcugggauuacaggcgugagccaccacgcccggccaggagguggauauucuuguuauaccuauuucacagauaagaacacuggggcucagggaaacauggugacuugccgaaggucacacagcugggaaauggaggguugggauucaaaugaaugcuucuggcacugucucacuguauagcuuccuggggaaagugaaguuuggugggagguguaagucaugucuagaagacagauauggcuuuucaucugaccaguggguuuaaaguucaaccugcagcacacagcugagcaggcaagucagaaaggagaaauagugggaaggggcaugcccuggagccagggggccccucagagagaagacacagccuuguccugggaagccugauaaauucuaggagaggaggcaggccucaggcacaugacaggcagggugaggguugguggagaaguacuucauggcaggagaggccugagauggcagagucugaaggugggagagccacuagaaacugauggcaggaagaaguccaccccagccucgguagucaugaccugaaccccagguaggguugggguuuggucaccugccacccuccucacaccugugcuggggcccugcucauagccagcccuaagcuccagccaccucugcccccuggcccagcagucggcccagcuggcucaccuucucaaucaauacugugcucuuaaugggcccagcuaccagcaccaaccaggggcauuaaauguuaauuauaucuauuuggauuugaaaaauuuuauuacucgaguuaauuaugguuggagucauaaaaagguuucagagugaaaggacugccuuauuggggccacuuuccccaagacagauuggaaaggcaaagaagaaauaaaaucaucuggcuuagagggcggcuacuccacauccaccaggcugagcgugcugggcuaaggacucugaagccuccaagggaaaggccugaagagcagcucgccuacuggccgugcuggugcccgggaugcaggacaggccugucuuggcagggcaggucugccgcuuggcagccccagcaggagagaugcggucaaguagagaagggcucccugccagcgagccuccaugggagcugccguccugcugagaacagcccggcucccagagaucaggauugcaggauaugcccagggcuccucuucaagugguccaaauacugggaccuucucuugcccagcucuacccagcccugccugauugcuuccugccagcgccgcuuaugauucaugggccugaccuugggcuauaagguguucacucuagcggguacagaggcaggauuuauggccucggggucagcuguaggcaaugacacaggcaauagcugacucacaagggugccccauccccagcccacacauaacucucccuugcacacacagguacacacacacaucuggacauagccgcaaaugcacauucaugccaggagcuaucucacgcacgcaucugguaaugggaguucauuuguggagcaagcacugugucuaaggugcuuuacaagcauuugucuaauccuuaacacugccccuguaaggccgguccaagccagagcuacucauuuuacagaagaggaaacaaaggcucaagcagguuaaguuaucggaacacaugugcccuagaagagaaccagcccuacagagaacccugaugccugucuguuggccagggaaacuaauaccaccagagagcuagacuacagcagccugcggggcaagagagaccauuccacccccucccucuucccugucaaaggagccgaggccagcacagagggggcgggaauguuccccaucucuuuccacccccuccuugccacaaggugaugaagagaaggggaaaaaugccuuaaagaagauacaacaguggccgggcgugguggcucaugccuguaaucccagcaauuugggaggcugaggugggcagaucaccugaggucaggaguuugagaccagccuggccaacauggugaaaccugucuucacuaaaaauauaaaaauuagccaggcgugguggcgggugccuguaaucccagcuaguagggaggcugaggcaggagaaugacuugaaccugggaggcagagguugccgugagccgagauugugccacugcacucuagcuugggugacagaacaagacuccgucucaaaaaaaaaaaaaaaaaaaaggaagaagaagagaagaagauacaauaguggaauuucaaacugcaccaacuuuaaaaaaaacagaaggaacugggaauuagggggaauuugcccauguuguuaagggaucaacugcccauccaagggcaguugaggugucuccgguagagacuggagggggacaauauuucauauauaaacuuuuaauuaucauuguuaugaugcgguuacugagaaccccauguaaaaggaguuagccacuucucucuucagcuuaauauccauugccuccacuugauuuuccaucuucccucaauuuucagaacuuuugucuuuucuccaaaaccagugccuacugucccuuagagccacuucucuccauccucagcagggaccuugcccuugcgauauuccucucgcucuugcauuuuugccacgagagcgguccuuucuccucugucuucuacguuguguguaacugucuccuaaaagggccaacccuucccuggaccuugccgcuuccucuaucuccuuccuuucuucugucuucuagucugccuccuggaacaaggaccugugccugucgccucauuuccuuccccaccgucugggauggagcucuuaucgcuguccuggugucauccgcagcagcucccugggucccuggagcugugacccccuccucaggcaucuggggcucuuccucagcgcuccuguccuccuuuccacaccacccucuauccuuaccuugucccucaugccucuuccacugaccugauccggggaccuugucacugcugugcccuuugcucuuagagaauuuaucuuuuuacccucuugaacgucaacuuuccaggacucccaaaccugccuccaauuugaugucucuccugaaugcccacaccgaauugucaacugcccaaaggacauguccauuuggacucuccauugucaccuccagugaaacauguuaagucagaaauaauuaucuucucuucaaaacagcucccuuuccaccaccucauuucuucccauuaaauaacuaccuagacuccccaaacacagaacuacugauuaaauuauuacauuaaacaaauguuuuccagguaacuacccuaugcaaagcccaaauagcacagggcaauggggguggaggugggaggcaggaagaacagggaggcagccugaugacaacagagagugaagguuuuggagucagguagauucgggucuacagccuggucugcugcuugccaggguauaauguuaggcaaauuaccuaaaccaaacauagccagagcaccugcugugcaccaugcucugaccuaaaggucagacaaucucacaacaaucuucccaacggugcuaugauuaucccauuuuagagaugagaaaaagagagagguuaaggaacuugcccaaggucacacagcagagccaagguaugaaccuagguggaggcugugcuuauggucacugugcuauauuuaacuucucguggucucugcuuuguucuguuuugcucacucuugugucaccagccccuaggaucccacuaaauaucugcugaguaagagaugacaaacaaaugacugaaaugcaucuauuggauuugauaguuugaaguuguugcugaccuuggcaaaagcagggucaagggagagguagggacuuagguagaacagccaugguuaacggagugaaugggagggaagcagugcagacagaugucaggcaugacacuguuccagaaguuggagggaggagagagagggauugccguugucuuaggaagcacagggucuggauuuucuuuuugguguaugaaagagaguuggagcuccaggacagaggaucacugcuggagccaggcuucagacggacaugaggaaaugggaucccaagugcuagcagagggaacaguuccugcuagugagggacauuagucuacuggagagauagauggguuaaacagaccuggggacgagaggcacuagaggaaacccacggggccuggggagucaggagacgggagaugacaucuuaauaccaucuuugucaggagagccaggugaccugguggguagacauuugggcuucucuccucugccuuucccuaggaugcauggugacagcucaggcaacuggauuagaaaugcuacuucugggcugggcgugguggcucacgccuguaaucccagcacuuugggaggcggaagugggcagaucacuugaggucaggaguucgagaccagccuggccaacauggugaaaccccgucucuacuaaaaauacaaaaaguagccaggcguggcggcaggcaccugcaaucccagcuauuugggaggcugaggcaggagaaucacuugaaccugggaggcagagguugcagcgagcugagauggcgccacugcacuccagccuaggcgacagagugagacucagucucaaaagaaaaaagcaaacaaacaaacaaaaaacaaaaagaaauguuacuucuggcugugccaagacaagcuuggggagcaauucuugggcuacauauaccugagccccacguuccaguaccugcaacuacugagggacagccagcuaggguuuccccaccauccugacaaccuucaggggagccaacuccuauuuccagagcuggagccagcuaggcuuuccugagugcagcaauaaaaggggaaaaucaacaucccaaugaucuuguuuauggugcuaaguaagcugcacagcuuaaucccuacgagguuaaugaauuuacgacuugcuuuggaauuugacaagggcuauaaaagaggaaugaaccacgcucuggacagcuccuuccuagcggcugcuaggguuggacuagcuugacccgcccugaugaaggaggggugaagacguaagugguggguucauggccaauugucuggguucugaauugaguggaccaaaggagggacaaucuaagggccaaaggacauuuccuguaacccucuggcuaggucagggugagcagccugggcugcucgagcuggaguucccaggucuucaggugaccuuggugucuugggcaagucauuuaaccucucugagccucuguuuccucaucuggaagagacacgaugcuauguaccucauguuguagcugugagaaugaugugagagaaugcauguaaaggaacuagcauuggauuuguauauaguaaguccucaaaaaauguuaguggugguaauuaucauuucauucugucuuaaaucauaauuugcugucuacuugucuaugcccccaccauuuauccauccauucagaaauucaauaaaucuuuacugagaaauuagacugcgugccaggcccugugucagauacaauuuggaaugagaggcacauaccuuaaaacacauuaaaaagaaaggagauuggugcugggaaggaaggacguacagguuacccugaaugcacaaagaaagaaguggcugaaccugccucucuagucuaagccaguuuugaauaaugccuucuacugauagagcacuuagcacaucacagaagugauguucuuugauucuuuugauucucgaaauaauccaguaaugaccacauuuucuaaaucaaaaauuagaauccagugugacuacaugguauggcaauaggucaaaacauuuggaauagggacagguuagaaaagcugggacaugcugaacuucauaaacagagagggcacagauuucuaguaucuguuugaacagcuaugaaaaugaagcuaaaauugucagugggagaagugaggcuucaucccauucauucacugauuacuuugcgagaagccaagggcaaggacugugcugcuuacuucuggguacacggagccuagaauagaaccugcagagauuagagccucaauaaauguuucucacaugaauaaugaaucuuuguauaaguauauauauauauauaucugcuucuggaagcaaaauucaaaagagaaacugauauucaucauuuucucuuuuuccccucucauauugucuugaaagcgcucuggcugggauugacaagcguucccuuuuugccaguucugaugguuaagucucaguaauccucaccggacuccacggacagugacuugagcucaguagaucacucccuucuucuucuucuuuuuuggaaauggaguuuugcucuuguugcccaggcuggagggcaauggcgugaucucgacucacugcaaccuccaccucccggguucaagcgauucuccugucucagccuccugaauagcugggauuacaggcuaauuuuugguauuuuuaguagagaugggguuucacuauguuggccaggcugaucucgaacuccugaccucaggugauccacccgccucggccucccaaagugccuuuuuuuuuuuuuuuuugagauguagucucacuauguuggccaggcuggagugcaguaacgcgaucuuugcucacugcaaccuccgccuuccggauucaaucaauucuccugccucagccuccugaguagcugggauuagaggcgccugccaccacgcccagcuaauuuuuguauuuuuaguagagaugggguuucaccauauuggccaggcuggucucaaacuccuaaccucaagugauccaccugccucggccucccaacgugcugggauuacaggcgugagccaccgcgcccggcaccacucgcuucuucuugaauuuuuuacuuggcuuuggguaccucaguccccuguuucuuccugcaucacugggcacccauuauucucuuugcuggagggcccuucuuuucccauccuuuaaauacuggacggcaagaacagacauauaagaggggugcauggaugugggaguggauggacauugccgcucaggagcaggaccccugcuuuugugggcugccaguuucucaggcuuugccuuagggugcaucucuuucccguuccccucauccaagcuuacuggcuucuugguuuccagcucuaguuuuuucaaagucuucucucuuccuuugacuguccucauucuuccacucugcaacuagaguucuucugugaucuggugacucccaucaaacaaaccaacagcccaaggaucugagaagcagcuccguuuagcuguaaggaaguaacuucccaaggugagugcuggccaggccgaauguggaaagucagggaggcauagaugcuggugcuggugggcgcuucccuuggccacauugacaccagcauugacagaaaauguccauuuccauugaccuggcuagugggcacagcugcuucacaccuagagaugaaaccccagcacacaaggaacacaagaauggagcaagaagagcaggcuuggguccuagcuuugccaaagaggaaugaauagagaacaccagcagaucccagguuccagucagguucccagaggaaggcccaggauccugcccaccccagcccccuaggacucuuucuucccucauguccuuugccuccucuuugcauccacccugucccucagcucucucuccagagucccucaaaggucccucucugccaaaggaugaucgucuuaggaaaaacacugaggguuugguccugacuuuccguuucccaugcacuccagaccugaaagccaugguugccuggccagagguuucauuuuuucuggaaaccacccuucccuacuccccaggcaugugugggaaagagcuuggccaaagcagggauucccuggccggcacccuggggaggcccuuugcucuccagggagggucccuguaggcuccaccuguccaacuggccucacugcaggggacaagcagcugggaccuguccugccggcguagaggcugaaacaggcuaaugaauccugaugggagaagugaccuuuuccaaaugccacaugucauuggauuuuauaucacacaaggacaaugugccauggguauuaaaaucguuuuuccaauaguuauauaugugugugaguguggugcagaguccguaugaugagaggaaaauccuaaugaagaugucaucaaaugaaccuuccccgaucagcaccagacaggcaguccuuccggacacucucucucucagccaaggcuuggccuagaccucagcucuuaagcacagaugagccuuucucccaugaaguucuccuggcccagacucuggcucugggcauggccuugacuccacuuccugcucuaggaagcucuauucaaaaucaagggaagagcaaggccuggagaaggcggccacacagcgaauggacacaggcccuaggcaugccacuguccacuccucagucuccuggagaagcuggaggaugcuuugggaaggagggacacacaaccagcagagcaggucagguggcagguguggcacucagcagcuuccagagcucugaaggcugggagaggcugggauuggagcccagaaccccagacuguucucuauaaagccucaaagggucuuauggucuagccugucuucacaaucuuccuaauagguggccugcccaaacaccuccgaggccaggaggcuccagacauccucaggcggcuuugcugcucuggggagcuucggcuguuuagaaaguucacacacagcuugagcuaaaaucuauuucccuggaaguuccacccacuggucuguguuuaaacucuugggcucagacagaaaagguuugaucucugucccacacaauagccuuuuggaaaucuaaaaacaacaauaauguccccuggagucuucuuuucucuaaguugaacauuucuaguccauucagugauuuccaacaugacccgauuucaaauauccugacccauaggcacuccaguucuauucugcugagaacauuaggcccauuuucuauugucauggugggaaaaggggaaaaaagcacagcaucuggaguuggaggcccaagguucaaaaucccagcuucauuauguaauagcaacaggaauuugaguaaguuucuucaucuuuuugagauucaguuucuuuauccuaacacuagaugaagggacaaccuucuccauggaacaauuucuucuuucuuucuuucuuuuucuuuucuuuucuuucuuucuuucuuuucuuucuuuuuuuuuuuuuuuuuuuuuuuuuuugugagacagggucuugcucuguugcccuggcuggagugcaguggcaugacauggcucacugcaaccucugccuccuaggcucaagugauccucucaccuuagccucccaguagcugggacuacagaugcacgccaccacaccuggcuaauuuuuugguauuuuuuauagagauggauucucaccauguugcccaggcuggucucaaacuccuggacucaagcaaucuacccaccucagccucccgaaggcuugagccaccaugccuggccuggaacaacuucuucaggacaugguccaaagauaggucaggaccucaguggggacuuacuuaagcagaggaggucagcagaagucacaguaugaggagaggagcagaaagaauaaacaauauccacaaauagcugguugucucggaugaguguccagaaccaacugucccaaaguccuagcaaauagcuucaaguacacaguuuuccccauucuugcccuuagacaaacaggcucacauguaagaggcugcuugccccagugauggagccacccuguucuuaggccccacagcgccagaacucaagagucaaagcucagacuggggguccaagucuagggagagauuaagaugcagcacacuagcacuuaguaaagcaacuaguguugauuuccaucaagccucccuguccuuucuuugcucagacuccucgguagucugggucugagucuugguccuacugcucagugacuguguggucuuggucaaguuacuuaagccccucugccugcuucuucauuugaaauaugcaguuagucuacccaucucuugguuguuaugaagauugcaugauuuucuuucuuucuuuuucuuuuuuuuuuuucugagacagagucucgaucugucacccagacuggagugcaguggcgugaucucggcucacuacaaccacugccuccuggguucaagugauuccccucccucagccucccgaguagcugggauuacaggcgccugccuguaauuuuuuuguauuuuuaguagaguugggguuucgcuguauuagccaggauggucucaaucuccugaccucgugauccacccgccucggccucccaaagugcugggauuacaggcgugagccaccgcacccggccugaggauugcaugauuuucuguguggaaaacagaauaaagaauguugggcacacugugagcacucaauaaauauuagcuacuguuauuaucccacucucaggauauuugugaagaucaaggaugcuaaaccauaggcaggugucauucuuggcaaacuaucagggucuguggucugugggagugauuagaguuguugaucagugucucuucucccaaacuggacauuguccuccagguggaucuaccgcuaccugacaagugcagaguggaacagaacucucuauccccugaaguguucugggauccaaauaauaguagaugcaugggggcccauagcacuugccgacuucuuucuucuaaauuuacuaucaaauaacccccagagcuucucuucagcuuagccuuccuucccuuggcauggacucaaauugaaauacuuaucccacuggccaggcgcgguagcucaugccuguaaucccagcacuuugggaggaucacuugaggccagaguucaagaccagccuggccaacauggugaaaccccaucucuacuagaaauacaaaaaaugagcugggcaugguggcccacgccuguaaucccagcuacuugggaggcugaggucagagaacugcuugaacccggcagguggagguugcagagagccaagauugcaccacugcacuccaggcugggagacagagcacgacucugucucaacaaaaaaaaaaaaaaaaaaaggaaagaaagaaagaaagaaagaaaaucccaguugcauucaucugguuggaagauucuacccaucaucugagccacuuugggaggcugaggugggaggguuguuugagcccaggaauucaagaccagccuggacaacauggugaggcccugucucuacaaaaaaucuaaaaauuagcugggacuggaggcugagguaagaggaucacuugagcccagaaggucaaggcugcagugagcugugaucaugccauugcacuccagccugggggauagggugagacccuuucucaaaaaaaaaaaaaaaaggcauuugacacgcccaacuaauuuuuguauuuuuaguagagaugggguuucaccauguuggccaggugggucucaaacuccugaccucaagugauccacccgccucggccucccacagugcugggauuauaggcgugagccauuguccccaguauuuuaccacgcuguuuauuuccuuugugguacugaucacucccuuaaguaucuuguaucuuuucauugucuguuucccacuucuaaagcaaaagcuccuugguaacaggguuuuguucgucacuauuucaaguguugagaacacagaguagaugccuauuaaauaugugucaaaugaaugaauggcauaggaucagggauggacacauaaaguggugauaaagggcacuaagguugagguggucaagagcugagaaucugcuuuagauggcagaagggaaaagcugggaggagagguggcaguggggagaagggagaagcugggaggagagguggcaguggggagaggggagaagcugggaggagagguggcagcggguaagagggggugcacugcaguuuggggcugaaaauacuggagaaggcugcaggggcuuguacuugggcaguggccgaagauggcuuggaugugaaaccugauaggaagacaguccuaggguuucacauguaacuuugguaucaagauuauuggaauguagagugaacuuuccuaugagagccagaguggggcuaucugagccaauguuggacagacugucuugacuauuugaaucugcuguaucagccucugcucuguguucuaacaagaccuuggauauaccucuauauauacuuggcaaaugcucaauuccuuacccuccugucggcuccuggagccuguccccacuugucugcaguuuccgucuuugaccccuuucccagaagugagccuagaguagagaaggcaaagugaguugagcugaggugagaagagaggagaugaggugaggaagaucauugagacuucagcuuggcccagcccaaccagacccacagucagcacagcaauuguccggcugaaauaacaagucagagacgaaaaaacuggccaucccucuuuguuuacucagcuuuuuuccccccuuuuucuuuggacaaugcccugcugggcuggggcuguccugcuggguuguugcugggcuccccugccaagauggagcccagcugcucagcuguuuacaaggcaaauccgguuuacacuggggcccauccuguccuggcugggcuggggagcuucagucacagcccagccacuggcuucuccuugcccagggcuccccagucuuaggcugggggcacuagaauugggagggaauccuacaugcccaaaggccagggaaggcaucagccucaagauggaaugaaaacaguguaagaucuggucccgcagccaaacuucugcccuuaggagccccagagaaaggagaacugcuggaaucccauggcuuccaucucuguucuuucaaguggugaacuugugacaacaaaguucaccaacaaaguucacuccuccuggccacccccuauucucccugguagcuaaggucugggaacuaaucucugccuuaucuaccacuaucccccagaaacugcuauaaggaucaaagaaaauuauguguaugcacagacuuggaaagcauuuguugcucugaugaaguaauguaugcuaguucacccaagugaucuaugguaguucacccaaguggaauuuguugcucugaugaagugaucuaugguaguucaccugagugaagugguagaucacccaagugaucucuacggaugaggaucaaguggcuagacuggcaguugcucaagggcagggaccauguccucgucaaccugguggucccagggcccauuauggagcaugucacacagugggacacaauuauuucauuuauuaaacaaauguuucuuaagaagcuugcagacuagugggagagcaggcaauaaaaagcacagugaucccuuugauauacugauuucuucccuuuggauaaauacccaguagugggauuguugaauugcaagguaguucuauuuucaguuuuuugagaaucuccauaucguuuuccauaacgucuguacuaauuuacauucccaccaacuguguauaagaguucccuuuucuucgcauucuugccagcaucuguuacuuuuugucuuuuuaauaauagccauucuaacuggguaagaugguaucucauugugguuuugguuugcauuucccuggugauuagugaugcucagcauuuuuucauguaccuguuggccauuuguaugucuuauuuugagaaaugucuguucauguccuuugcccaccguacuugacucccauguuuauugcagcacuaaucacaacagcaaagauacagagucaaccugagugcccaccaacagaugaauggauaaagaaaaugugguauauuauuuagccauuaaaaaaaugaaauccugucauuuucagcaacauggauggaagugaagaucauuguuuaagugaaauaaaccaggcacagaaagaccaauacugcauguucucacugauaugugggagcuaaaaaaguugaucucauggagguagagaacagagugauaguuaccagaggcugggcagggagugcgugugaugaagagagguugguuaauggguacaauaauacaguuagauggaaggaauaaguucuaauggaaggaauaaguucuaauguuugauagcagaguaggaugacuauaguuaacaaugauguauauuucaaaauaguuagaagagaggacuugaaauguuuccaguacguagaaaugacaaauacucgaggugauggaaacccuaaauacccugauuugguaauugcacauucuaugcauguaacaaaaugucauaugugaucuguaaauauguacaaauauuaugagucaauaaaaaauaaaaaaaaaacacaaaugcaaaacaacaacaacaacaaaaccacagcaaaagcaacaaucccauagggguuagcacaggcggcugaggaagcacagaggaaucaccccaccccgggcuggaggucagggaaggcuucucaaaggcagugacaucuaagacacagcaaacaaaugugcuuauuaaacaaaggaggaaugaacgugcagaaucccuaauggcagugcaggggcaggcugaccugggugcucucucuuacuccuuuacccucacaaaauagcacugaagggccaggcuuuaggcucuugggcuuuggggcuggugaacugucugggucuggcuucucuaaguaaauguauuaaagauucacagugaagcccugagaggcuuuuucuauguuacccagucuucuuaaacuggagcacagaacaguguaagaaaguauacucaugaguugcaggaagcacaggauaaacauguguucuggacuuucucaaugguaagaaauuuaaagcuuaauuuaaaaauaugaccugaaggacaaguaagaguuagccaagugaagugggauagggcagaggucauuccaaacagaggggagaguuuaggaaaaggcacuccagagggcaagggcuauaggaggaagagcauggcccagcuggggaaaugugaguauuacacuauuuuuuauuuucuuauuuauuuauucauucauucguucauucauucauucguucauucacucauccauccauucauucauuuauuuaggacaagggucucacucuguugcucaggcuggaguccaguggcaugacagccuccaucucccugggcucaggugaugcucccaccucagccuccugaguagcugagacuacaggugugcaccaccacgcccagcucauauuuuuugguauuuuuuguagagaugggguugugccguguugcccaggcuggucucgaacuccugggcucaagcaauccacccaccuugggcucccaaagugcuggcauuacaggggugagccaccacgcccagcccugaauauuacaguaugaccagagggaaaauaacucuaagaggacauagggaugauuccagagagguaagcaaggguuagaugauguagggccuaguaagcucaguuuuuuguccuguuggagacauguuuccaugaaaucaacuaccaucuauagucuauuaauuccaaauuuucuaucucuauccuugagccccucuugggaaaucagaccccuauauccaacugucaguggauguaaacucauuaaacucaugcuaucugauaugaacucuccugauuuccuuccaggcuugcucuugauccuccuuuaggccucugcuccacuccaggucugcuuuccaugaugcccacugcuagguuuccuucuguagauucuggucucuucucuucuuucuagcccgguguccucauggacugauagcucagucauaaccccugggcuguccugauccugacaucucuuuuuucuggaugcagcauuccaugggcagggcccaggcaaaucugaccaugcaacucuccuucaaagccuucaauggauccccauuauccucaagauaaacaagaagaaguucaaacuccuuggcacccaacacauaguguucuagugaaggguaaaugagauaaugcaugugaagcagcuggcacaucgccugggacguuuuaggguuuuaggcauucaauuaauaauagccauuauuacucuuauaauaauuauauaauuuauauuauaucauuaucauauuauaauuauauuauaagcucccccuacccuguaccacauucuggcaccugucuuucucuucaguucuccugcgugcuuucuucuuugagggccucgagaacuucucuuucaagucuccacaucuuuauccauuucauucaacgugauuuccaccuggaggaucuuucccuucauuguuuacuuggugaacaacauccuuccucauggguaucucuccccaaguagaguaauggugcaaaauuauagggccaaacauuucucuuagacaauaaagguuacuugguauugaagagaagagacacaagcaugaccugaauccuuagcggcagcagcugauggcagauaucaaaagcuacucuugaggcaaugagucacagacaccgagagagcugagaaguggcugggccagagaagaccugccugggagaauggcuggucuugcugcugcagaggccagcagaucagaaggagguagaaggaacaguaaauaggauauugcaauguacagagagagauucacuuugucauugauuucacaaaacauuauucagcacccacuuugugcugagcuuuaauuaugaaagaggggcuuuucauuuagugaagagucagaugaguaaacaggaauuacagaaccacaugaugcauauuauaagagcaguggcggggugccaucgaggcuggguuucaaagagucccuucccuugugaauuucaggguacaaucacaugcaacaaauauucaagagcacuugcucugugccaggcacugugcugggugcugaggacacagaggcuauaaagaugaaugagaugauuucugccaccuagugggaggagacagcuauguuuuaaaaugccacaaagguagucaaaugucacauguccccagacugccuccucuuccauuuaaugugagaggagucauuaucaucuaauuccucaacuagaagccuggauauuaucucugacuccaggauuuauguuuuagauuaaccauaaaacauccuguagaggaaggaccggaggcagggagaccagcuggaggcugucccagucacuggggugagagauggcaauguggccuggacuaggcuaggagccuuggaaauggagggaaguggacugaucugagagcuauuuaaggguaggaugaacggaauuuagggauugauuagauggaggucugagaaaggaagagggguaauaaucucagguuucuggaugggcauuuaagauuguggugccauuuaaugaaaugggagcuaaagaagggagaaaaaugguauguuccauuuuggacauauguguguuagacauacgacacauggggagauguccuguagguggcuggaaagugaguuggaagcucaggagauugauuuggauugaaguuaagauuuagaagcugcuggcauaugguguagcauuuacauggaagaucaugagaucacccugauagaacaugugcagacaaaagcagagcaaacauucauucauuuauucaagaaauuuauuaagcaccuaccauguuccaggagcuagaaaucuaacagugaauguagaacuuacuuucuacugcuggaguaggcaaccaacaaauaaagacacaguggcaugucagguaggcacacgcaaaaugaaggaaaaugagcaggguaaggagaugcugagagugacagcagguggccaggaaaggccucucugaagaagugacauuugagcagauaucugagugaaaugaagaagagagucaugaggaucugcgaaggaggaguguuucagguagaggaaauaaguucaaaggcucugauggggaagguacucaguguauucaaggaacgauggggauaauguggccgugguagagagagcagauggaagaggggccagacuguagggucuuguagguugggaagaggacacuggauuuuauucugugugauaggaaggucuggaaaaguuaggagcagagcaguaauauaaucugauuuaucuuuuuuuuuuuucuucagauggagucucucucugucacccaggugguaaugcaguggugugaucuuggugcacugcaaccucugccuccuggguucaagcgauucuccugccucagccuccugaguagcuaggauuacacgugcgcaccaccaugcccagcuaauuuuuguauuuuuaguagagacaggguuuuaccauguugaccaggcuggucucgaacuccuggccucaaaugaccuacccgccuugaccuuccaaagugcugggauuacaggugugagacaccacacucggccugauuuaucuuuuaaaggcuuauuuuggcugcugugcaaagaauagaucgugggagggccggaaaggaagcaggaagauugcaauagcacaagugugagaugacagugaccugcaucgcgacaugagcgugaaggagggagaagucuggaugccuucccauuccugauacauuggaucaauaaaguaaaaagaggugccaagacucagaggugaaauagaaaggaggagacuucggcuuuagccuguucugaucuaaccacauagucucggggacauuauccgaccccucuguacuuuacuuuccuuaguccaacauaaguccuuaacacauggcgugccuccugugugguggacauucagcgccaaauggaacggacaaacagcuacauucuaguagggaagaagacaagcaauuuucagaagaaauguuaccaaagaucccccagaauacugucauagaaaaguggacaagggaaagggacagcgcuggaugggguuuguaagaaaagccccaguaaaggcgucauggaaggugagucaggaacaggaccuccacccucacuagaucugccucucagcuuugcugcuguucacugagaugagggauggaaaagcacaggcacuacagcagugacaaaggacuggacugucugaacuucgcucagcucuccuccccauuacccaaaauauauacccaucgcuuccauucggaccugaaaaacagcaacuccuuccuuugugcugcaaaggccuuuaggggcagcgccuucucuggcaccugucucuaggggccuucauaggauggucccaagggugcccgaucuucuaggagcucacagcaccuagaaccacugccaaguguaauaccaaacaccaucauaggccugcuaccccuuucagacuaugaacuccugcuggggcccaggacgaugcggguagagggcgucuaaacaaaugacuauugaaggaguggucuagaaagaaaugccccuuuugucuccuuuucucagcuccccauggccuuccuucucccuuccuccuuguucccccucagcagccccacaccccuucccaccagacccuggcuucucagcagguaguguagagauccuggcucugccaggguggggucugagcuggugccuaagucagcaggcuuugcccacagccccauccugacaggcggugccucuggcagcaaagucauggcccugauuccucugucuccacauuuaagaacaucucuaacugcuccuuggauagcucaauuaguaaagugaauauauuauauaaagucuaaaagauuaaacuaucaucgucagcccauaauuucaugaagaagucaggggaccguaucccucuuauuaacucuauaacaaaugugaugaaaauguucaaauagaauguuaaugcaauguuacguguaauuuucccaggcgauuuucugcugaaauauuucuuuauuaauaguaauugaggguauaaauuaugaaugaggcgauuuucuccuuucaguaggaaagacguacuaauggcaauaauucuuuauaauaauuuuuggggauaguggggcggggagagaggcuagucuaaaaacagacaaaagcaccuuuccaaagucucccuuggggagacagugcauuugccacagacaaccucucuuuagcuuccacacaccucagacugcccgcaagugaaguguuuguucuucaucaguuuuccaaaaaccucaaggucuguuuaaagggcuggaaggaaguuuuugccucuaaguucugaaauggaccaaguucugaagccaaacuuuucugcuuagaaacugcacugccaaaaagaccaaagcgaggcuccuuugcugagcucccagacccagucugucuggacccaaaccaucuuuuguagcauccuagaauauucaaggaggaauagccuccgaagccuucccauggaaucccccaucccaucccauaaaugaaagaauaaaagggcacagagauaauaaguucuaagcuacacaacauguuggugggggagcucggacuccacccaagcaaccuucugcacgcgucccagccucuccugaacaggcugccacucuccugccuucgcaacuccauccccgcugauuccuggccugggcaucuggagagugcuucaggagggcaaggacuacagagaaacgccuuccaaauccugcaaaggaguuagacuaguacauuucucuagggucuuucuucauucagggauaucccagcuggcauuugcccauucauuuauuuggcagacauuaaacaaacauuuaccauguggccaggcacugugcuagggauggggguuacaaaggugaauuuauccaacaagaauuaagauaaauucagggugcucaaggucacaggugggaaagacaagcaucggugcacagauaccuaugugagauaauacaugugagucauaucauuagaauguuugaggagcugccacacggccaguguggcuggagcagagugagguggggaugagugcagggaggcugagggaggcagaacuggcagggccuuguggccacaguaaggauuuuacccugauugggagggcucguuacuggaggauucucagcagaggaguggcacagugucaccuacauuguugaaaaggacacucugauggaucucuaguuggauguggagauugaagaagagggacucuaggaggaaccagaauuccagcaguggugacacagcgcugauucucugugugccauucacugaguuagggaugcucacuggggaacagagucagaggcaugaucacauaguucagcuuuggacaaguugagucugaggagccugagggucaaugggaaccuccaggaguccggguggagucuggagcugcagggugaaauggggcuccccaggcagguuuucagcagggacucgcacagccucuggguucacauggcgccugguacacugaguuucaugucuguucagaagucuuucucccuaguagaugugagcuccaugagcuccagucagaguguacugagugagcaagcgaaugaaugagugaagggaggaagagagaacaacgacuuaugcugugugaggcuaucccuagggucuuaguggccaccucagaaucucucuugauugcugcuaaacagucuauuucccuuacccucccaccccugccccaguaaggguaggcucucuccaagucuccugaucuugagaaacgaucuucucaagaucgcuugagaaaugcuguugaugaccucaacaggcauucuuggugucauucacggggcuucucaguuggucacugcugagugcucagccccuucccuggagcaggagaaaagguccccuucaggucugagacucuggcgggggcuauguggccaacucuugucccugucccaggaucauacacagcugggaaucucaucacaugcuccucccuucacccucuugcuauguucuaauccccaacagcugggucagaaauggggucacuguaauaagcaagucuuguuuugcucaaaacaacacucuuccaagucuucuguuuguacuguuccugguucccuaaccagaguccaugagcaagagcaucccaccucccgcacccugauaaggaacacugaccccuccacucggucccauucccaagaacucagauuucaggagagaagcuugguaagugucuuacggaugcauuaaaggagugauucuccauccauucuucucugcccuucaccaucucuagcuuuuccucuucuuuagacacaagaaccuuagcaggacuauucuagggguccuuggcaggggcaagggccugggccgguauaacgaggcuggcucagcuuucugcccucugaaaaccacagggggaugggauaggaaauggagcuauguuaguggugaucucugaguggccauagugaccucuugaccacaggucacuggggugaccuccaagggcauuucugugucucccccagcaggucccagccuccagaggucuuuuuucucuccuucagggaaauccauccauuagcagccgcccuccaaauuaggguaauguguguguguuccugcaccaggcccccuacugucuaacagcuggcccuaggguuucuccagcuucuguuucagauccauaccacuugucuggagaaaccccaucccagucucagacuuccaucccccuuucaauccuaggucauuucuagaaagggaaagcucacagcuagcccgaggcagccuugacggggagggccagagggacucugacagccaggauggagacccccagcuccagagccugucuucuggucucuuccaugcuccauaggcuagggugcuggauacaggcaggcuuagccagagaggggcugaggacuucauucacccccucccuccgcacuuagucuuggcuccccuggguacccaccucccaccucagcccccuuccuuguugaaccaacagcucgaucuugaucucuugaacuggaaggucgaccccagagggacccucucugaaagccaaugcuaauccaguuaggggcugggcugggcgcugcacucccucugcaggaccaagugcaagugaaaaaaugccaauuaccagaugacaaaaagggucccugccccuggggaagggcaagcuagggggagggaugggagggacagaguaacugaacaccuugccggaaauagcuccuaucaguccacuuagggagccaucagccccagcagauuuaugggcagcgugugccccucugauagaucggacuauuuaaaggcagccgaagccuccauuuauaucaauguggagcagagagggagggcgagaggcugagguggggagugagaagcagcagugggggccagccaugaggugggauucaagacuuagcaaacuggcuucagaggacagguaagacugcagcaggaggacuggguugcaggacggggaugggagucuccagauccagucccauuggcacccagggaggggcagggaaggcagugguucacagaucuuccagcagcaucucuuuagcccagcaucuaugcaaaccccuccagcuaaaauggguagcucaggcuaauacuaaaguggaacuccugauuggauuuccagccaugacccccacccuccccagcugcggggcaugcuugcccuccaugcaaccucccccuugccugggcugagggagaaggaagggguaauuguguuaggcugggggcauuagcgcugaggaaugggcccacugcuuccugccugcuguccccagccugcacuuccuaggggcagauuaagcggcuccugcggcucucucuggcucugccugggcccuuccucccuaacuccauuacucccuggcugaggugcuugcccgacccaugguggucccucugauaauucaccucucaggaaacucugccuuucugaccucucacugccuccuucuucccucccucccucccucccugcauuuuccccaggcuuccagauugguacccaacuggccuuauucuccugguucaguggugaacugcuauaauucaccaacauauuccuaggcacagaaccaacaucuaucugucaguuuguugguuacugguugaucaguuuguucacucacucauucauuuauucacggagugcugaccaagcauguccuaaggccaggcccaugcuaugcgcaggggauggaguugauucaggccaggcccaugcuaugugcuaaggauagaguugauucaggccaggcccaugcuaugugcaggggauaaagaguugauucaggccaggcccaugcuaugugcuggggauagaguugauucagguaucgucccuuuucuaaaggaacuuacaaucuaaggggcagacaagcaagggaacgacaccaccagacuuguguuuuauaagguucccccugagcacauguguuguggagaacagauuagugaggaugagaacagaggcaggaaaacagaauagugguucuuuuuuuuuuuuuuuuuugagauggagucuugcucuguugcccaggcuggagugcaauggugccaucucugcucacugcaccucugccugccagguucaagggacucuccugucucagccucccaaguagcuggcauuacagaugcaugccacugccugcguaauuuuuguauuuuuaguagagauggguuuuuucaccaugugggccaggcugaucucgaacuccugagcucaggugauccacccaccuuggcuucccaaagugcugauuacaggcaugaaccacugcaccuggccagaauagugguucuucaccuuggcugcacaauagaauuaacuggggugcuuuaaaaaugcugauuccugggccaugcugagaucaauuauaucagaaucucuggggagagauccaggcuucagaguuuuuaaaaagccccaccuaacuaggggaguccaacguucagcccacuuuguaaaccacugaguuagaaggugauugcaacgguccaggcaagagauggcagugaucugaauaaggguggcagugacaagguagaagggaggggggaauuugagaaacauuucucugauagcuauuuuuaacaguuaccacucucuggucccccauucauccccuacucccaccacucuuagcagaugaccucaauuccaacuucacagaagaaacuggggccauuggguaaaacucuacaggauuccaaguccuugaaggcaggcaugggggccaguggcauucucacacgauagguaucuaauaaauguugaauugaauugaaucuagugggcagcuguaagugugggucucuaacucaggagggagcugugaagagaagauagagauguaagagaugucagcucugggaaacccuaaggggcucaugcaagaaaaggagcccaggaacaagacuggagggagcagucauagagguuaggaaagguagggguggaagaagaacacggacguaagucuguccuggacacuucacagucaucaucucauucgaggaguacaacaaccuuuugaaauauggacuauuaucucuauuuuguagauggugaaacagguucagagagggcaacuugccuaagauguuaucagagauucaaauucaggagcuaggauuugaaacuauaucuguccagcucuauggugucuuugcacuacaucauacauacuacaggacacacuagugucacagaacccagagucagagaauuucaagaacgagggaggaguccacggcggcaaaugcagcagcucucccucuucccguucaucuggccccaucucccuggguggacuugaaacagguaccaucagggccaagggagggaagcggggcccccugaaguccucagcugcuguggaugaagccccuuucuaccagaguuacugugccacuucagccaccuccugaagcaggggggccaccagcucagggggcccugccucagcaucagcucagaccaguuagaggaggcucagcuccagcaaggcuagcccagccucgccccugaggaccuaggagcucaccaggaaaaaggggcugccuucccucugcccagcucacacaaauccucauucaacaaggcccaggucugcuguuaccaucuuggagaaauauuccccagcuucuccccauuuccuuggccucauaagugcaucccccucuggguucccaccaaagcacuucauucgugcccaugagaacuuuuauuaccauguuuuuugguuacaggguagugucuauuguucccagccccauucagguccacagcucccccaagacagagagcaaguauaauucuugacuguauuuccaacguccauuugugauggcauuggauaaauacauagugaucaaugaagcaggagagcaaaacucuuggauggggauggaagaggacacuucggggagaggaggggaagaaagaagugaggccugcuuugauuucuaauggcccaggcagugaaaacggcuccagccuucccagugacaauuuccaaagagcccucgagggcauacagggagcugugccugccuuuuugagguuccuugagcuaagcaugcuccaauuuccuccaggcaccaaccccccaaccccgacuuagccccuggagcugucugggaccugcucaggcugaggcagacacugaaaugguggcagcaacaacauggcuagagagacugaaggugcuccuauaucuuugcucaggaaauggccucauaaaagugacagggagacguaccuauggaugcuuguuaaaguuuuauuacuaaucaccuccaaagucagcgaggcagagggagggagcugggaaauggagucaucaaggccugggagcaggugucagcagccucagcaucacaagcgggcccugacacauggguuuaagcagccacggcuuccugcagggcccuggauuccccgcacugcuccgggucccccuggacaaggcauucugugcccucuccccuccuugugaaauggacaccuucugguugguuuccuauaucuagcagggugccaaacuacguucagaccucaugcugggccaucugguccccuccuuccuggugccgcugcccuagucagauggcaccaucucucacuuggaccacugagauggccccucuagauaaccccucuucugcacugcugcugagguggucuuuucccuucacugacccugcaggaacuuuuagaaugggucuaacuccuuaaggaguuagcuuuaaauuagcuaaguuaaguuagcuuuaaauguagcugggaaauuccuuugggauuugguccugccuagcucucuccucucucucucucucuuuugagacagggucucccuuugucaaccaggcuggagugcagaggcgugaacacugcucacaguagccucaaccuccugaguucgagugauucuccugccucacucuccccaguagcuaggauuacaggugugcaccaccaugcccaguuaauuuuuuaauuuuuaguagagacggggucucaccguauuguccaggcuggucucaaacuccuggccucaagcaguccuccugccucagucucccaaaaugcugggauuacaggcaugagcugcugugccuggccccuggcuagcucacuaacacuauuuuccaccauucuuuuuccauggcugaccuguuugaauuuccccucaaauccaccucucuuggccuagaaauuccuucucccugaaugcuuagcaaacauauguucuuuuuuuuuugcucuguggcccaggcuggagugcaguggcgcgaucugggcucacugcaaccuucaccucccggguucaagcaauucucugccucagccucccgaguagcugggauuacaggcgccggccaccaugcccagcuaauuuuuguauuuuuaguagagaugggguuucaccauguuggccaggcuagucuugaacuccugaccucgugauccauccaccuuggccucccaaagugcugggauuacaggcgugagccaccgcgcccagccacguagguucuuuuuuaaagacucaguucacacaucuucaggaagccuugccuaacccucaggcacuuagggguuaguucaguaucuuuaucacacuguuucuaaucauccauuuacuuguacagguaccuccuagacuguaaaguucucuggggcaggaugcaugucugauucauuucuccauucccaggaguccagcuuggcaucacuguuugcugaaugaaagaauuaaugaagaauuguuaugacauuuaccuuucaugaggcgauucgcuacacaagggugggacagaguugguuucauucacugagguuguggugcauguacaggccuggcaggaaguaggaggucagcaacuacuggcugaaggcugggugugguggcucacaucuguaaucccagcacuuugggaggcugagggggcggaucacuugaggucaggcuuucaagaccagccuggccaacauggugaaaccccaucucuauuaaaaauacaaaaauuaucugggugugguggcauacaccuguaaucccagcuacuuggguggcugaggcaggagaaucgcuugaacccaggaggcugugguugcagugagcagagaucgccucauugcacuccagccugggcaacagagugagacugucucagaaaacaaaaacaaacaaaccccaacuacuggcugaaucaaugaaugaggauuaaaugagauccugugaaaaugcucugaaacucuacagauacuguuuuuauuguucuguucacauaguuuccagccggcauccuuuuuuuuguccauuuggucaccaccgacucuaccuccaggagccgaacugaugauggcaagaaagaccaugaagacacuggaaaaucuuguggcuguuuuuuuuccuguuugggaaacagcaccugcccuuccagucacaccaugauucuuuccccuuccaacaucugaacuggggagagcgguagaauuuucacucacuccaucagccaccaucuagagcuuaucaauaagaagccuuccgugggccaggcuccagguuacugccaggcacauggaugauuuagacccaguuccccacucacugggaguccuccccacaucacaggaggugacgccgucaucaaguagcugcagcuuuuucaaggccacuccacuccagagcuugcugggguugccugccugaugggcacugaggacagaagccagagagccgggaggugcugaaggagccguggcuccuccugggcugaggggggcccuuggcaaggcucagcucccaccccaggaaaagcccuuccuugggggagcucagagcucaggaagcagucacccucuugccuucagagugggcaaauaaagugggucaaaguucuucagaaauuauguuccugggacaaagacagugacaucgaugcagagaagugggcauucucuaaagugggccaaguccccucuaucugcugccucacagagcuagcuagcacugacagcuuccaaagcucccucgcacacugcgcaggcccccuuccuucagcucuggcuuccuggagucagggccguggcccccucuuccuaacaggccugcucaucugucccagccccacuccccuuccucccggggcuagaccgaagucucccccgggaugcccccugcaucaccgcuggagcgcagccugauccugcggugccgccgcccucccuuccuccuucucaucucuauauaucugucuaaugaacauuucaauaagccgagcacagcuuuuuccacuuaauaagcagagugcugacuucauugcggguuugcucuucacuuaucuguucagggccuuaaaucauucccaggaaaaagcuuagcacagggaaaccuggcauccuggcuauuggcugcuccugucagcaccugcccugcuagggccgaggggaagcccugcuuccacagaacagcguggcagugugaauaaaacuccugggauacccaagcaucuggaaggcugaggacuggggcugggggauguuggagccaucaccacugaaggaaguucuggaggcaagguggaaagggcaggggaguaggggagaacuagaaagcaagugagguucuggagcgagaaggcaaguuuaaugagcacuuacuauguguugcgcauugggcuaggcgcuagggacaaaacacugaacaaaacuaucauugucucugcccucacggaguugccuucuaacaggaaaggaacacauuacacaaacaauugccuaaacaacagcugugagggaaagaacuggcuuuaugggaaugcaucaugggggcuggagaaagcuucccuuaggaaacgaacuuuaagcuaaggucugaaaaaguuggguugagacaggugacagguaaccuagaagagaccaaaacaguccaauaacugaucucuuucaccggggcuauaacaugucauguugauugcuauauguugagaucauguaaggugguggcaaaaaacacaggcuuuggaguaagacacaccuaggucugaauucuagcuccguaaacuuucuagcugcgugaucuugggggagguuguuuaaccucucugcuucauuuaucauuuaucaaauggaguaaaaauacucaccuugcagggcuguuguaaggauuaaaguugauacucaauauaaaggauguauauaaagcaccuggcauauaggacauguuuaauaugcaguagaugcuaccacuaaugguacuaucauaugugucuauuucuuccccaagccuacuaggaggucuuugaagguuuagacaaagucuuacacauuuuauaucugauugaauuagacagggagcaguggaaaagauucugauauuucaccuggugccagaaaagagcccuaggcauccagccaaagguauggcccuuggugugcauacgcauauacagugggggcugggccauagauguuauucucuauucuccagcauccuuuuggauuuaguuggcaggaugauuucagggcaaaaggguacagacucaauuaaaugugggcaagugcaaggcaaugccuuuugugaugaacacaucaaaacccccucuccagugcucaacucugcauggucagccacgguucuggcaaaggaccuagaaauccuucuucauuuagacaguucccugaggcuguuggccaaaaggcuaagagaacugugaauaagaugugacggaagaaggagaacauguuccuugaggugcccagcuggaacaguccuacccgcagggcucagccguggcacucugucccacccuggagaagacgcagggcaugcaaaagcuccucaguggggaagggucgaugacucaccacccagucuggaagugagaaggcuggugggggaugugaaggaaaucacaaaucacaaaugguguagagaaggugacuagaaacuuauucacaagauccugaaacuguaggcaaaguggguuugcuuugaaacucgaacacauuugggaugaauaaaggugauuuuauaccguggccagugaacuuaagaaauucauucucccaaauggugggucuagcagaaaacauaaaugaauuuaaacaucuuuggacaaauuuaugagacacagucauguacaucccuuaaucaguuuguucagugaaugaaugaaugaaugaacgagugaauauggaugauccuaguuuucaagguauuucaguucagagugccuacuaugagcaaagcauugugcaagauguaaaaaugaacaguuucgcucuccuuccuuccuuccuucuuucccucccucucucccucccucccuccuuccuuccuuccucucucucuuucuuuccuucucuuucuuuuucuuccuuuuuuccuuuuugacagggucucacuauguugcccagaacuggucuagaaagaauaccuaggcucaaucgaugcucccaucucagacucccaaagugcugggauuacaggugugagucaccucgcccagccaacacaaacaguuucuaucaagaagcuuauauauauauauauaaaauauauauuauauauuaauauauacauauguauauauauuauauauacauacguauauaaaauauauauacauauauacauauacauacauauauacacauauauauguauguggauugagaaagaagcuccuucaacucagccccuagagagaugcagaaugagggcccaggguccccuauuagcggagggauuguuucagccauuucgggcacccugggguucucacugggcaaagacauucagcucagugauauagugagcaccauggguuccccucccugucuagcaacaucuguaaagaggagaacuuugcuuaaaaaugaacaggaagaggccgggcgcgguggcuuacgccuguaaucccagaacuuugggaggccgaggcugguggaucacaaggucaggagauugagaccauccuggcuaacacagugaaaccccgucucuacuaaaaaauggaaaaaauuagcagggcguggugcaggcgccuguagucccagcuacuagggagacugaggcaggagaauggcaugaacccgggaggcggagcuugcagugagccaagaucaugccacugcacuccagccugggugacagagccagacucugucaaaaaaaaaaagaacaggaagagcagacaggaaaaggcaagagagggaaggagauacccuaaauagguccagccagucugagggaguugcauuaaaaagagggcagguuuaccagaggacagcagguagagaggggugucauuuguucauucaggucaucauuaauugacuagggagcauguuugaugugccaggcacugugcuaaagcuaaggaaauacacuaccuuucuuuaagaagcacauagcacugggugugguggcucacaccuguaaucucagcacuuugggaggcugaggcugauggaucacuugaagucaggaguucgagaccagccuggccaacuuggugaaaccugucucuacugaaaaaacaaaaauuagccagguguggugaugcacgccuguaaucccagcuacuugggaggcugagguacaagaauugcuugaaccugggaggcggaaguugcaguguaccgagauugugccacugcacuccagccugggcgacacagagagacuccaucucaaacacacacacaaaagaagcacauagucugguggggagaaaaacauguggacagauaauuagaaaaugauguggugauagaaauacauucuggguaggggcacaaaggaggagacaauuaacgacaucaaggaaggcuucaagaaggguguaucacuuuagcugggucuugaaagauuaguaggaguucaacaggcagaugaaggcauagaagacauucuaagcaaagggaaagcuauaugcccagucacagagguaaaaauaaauugguacauucaggccaggcgcgguggcucacgccuguaaucucagcacuuugggaggccgaggcaggcgaaucaugaggucaggagaucgagaccauccuggcuaacacggugaaacccugucucuacuaaaaaauagaaaaaauuagcuaggcaugguggcaggcgccuguagucccagcuacuccagaggcugaggcaggagaauggcgugaacccgggaggcggagcuugcagugagccaagaucaugccacugcacuccagccugggugacagagcgagacuccaucucaaaaaacuuaaaguaaauaaauacauaaauugguacguucaguauagcuggaauuuaggguaugcauagaggccauaggaacugagacugggcagguagguggggucagaucauacaaaguugaaagccggguggaguggcucaccccuguaaucccagcacuuugggaggccaaggcaggagaaucgcuugaguccaggaguucgagacauuccugaacaacaaagugagauccugucucuacaaaaugucaaaaacuuagcuaggcguggugucgugugccugugguuccaacuacacaggagguugagguaggagaauggccugagcccaggagguggaggcugcagugagcuguguuaugccacugcacuccagccugggcaacagagugagacccugucucaaaaaagaguuugagugcuaugcuaaggagacuggaguugauccuauaggcaaaaaugagccauugaagaaaguuaagcaagggguaagacaugacuggauuuacaugcuagaaauaucacucuugaaacaguguggaggaggaauuaaggaaucagaauugugggcagggagacuaguaaggaagcuauugcaaaaaucuaagaggagggacaaagacaggucugaacuagaacaaccaagcaguggagauaaaaaggaagagaccaaaaaacgagugaaaagguggguggugaaggugagcugggagggccguugccuucuaccugcuugcuaugaaauuccagcuggaacucagacuggcuccccaccuggcugcaugcaaggaacugcucugaugcagggcacuggguucccaagccccacagguuugcuucagaugauuucuagggaaaggguagaucuuccugacccuccauucucuucucagcugauuccaagucccagaucaaugggauccccuucagcccaacuguuuccuguccuugggucugacauuggagcuuuuuucuccaggacagagagcuuuauugaguaugaauacaucagagagcacaaucuugaaauuccugccaggauuccuauucugucucagcuugggauccaguucuaggcuaggggaguaagacagcaaaggaguaaggguaggcgagaaggacauguccuaagcaguggcaagcauuccucaauuuuuuugcccaagucccuccucaaugccuaccaggcugccagcucccaaauucugggcuuugccucuuuaauggcucuugcucucuguccugggugaagccugaguggauaagaagacccagcccuccucaucuccauccuuccuccauuccugggggcaggggccagagagauaucuguucgcuucugcagauacacacaucacccuucuccauucuguucugugcccugaaagcugauuucugucuucugccccaacaaccaagcuugcuugccuucaggauuccuaugggguuugacacauggaggacauuagagaacgagaggagagaagcaguuggggugaguauugcccuggcuccuucucugccagccaaggguuagcauuccuuuccugaaagucacagcuccuccugcagccguggucauagccgcaguucuuccugggugcugguauaugcuccuucaaucccagggguaguaacagcuccccugucguugcuagcucugaaguacuucaccuucucuuuauaaaucguccuuuccuuaaacuuuccuuuguuaccccauucgugggccucuguuucuugcuagaacacugacuaguauagcaggcauucucagagaugggacacuaacuggaccauauauuuauuccagaaaguuuucaucagucuuauccuacuuugucuaccaugagucuuucaauacuaagugccuccuccuguugaugggcagaguguagagaaaccaaacagcaauugaaucccacgcccuuggccuaggcagcuucucauagccacuagggguucauuucuacagguuugcagagaguacaacaaugaaaaagaagucaucucguuuuuagugagagagaaacugagacucagagaaugucaggacuggguagcuggaugccaugaagcauucauucauucauucauucauucauucauucauucauucuuauacucagcaaauauuuguagggcacuuaucauguucaagauacuaugcuagucaccauggauaccacaagcaauaaacaaaauauaauccugaugucacuaagaacacaauuuuguuggagagaccgacaagcagggaggcaauuacaagaagauaaccuuauuagaagaguggguaugaggagugcuguggaaauacacaaaaguggcaccuauccuacucuugugggguggacagaagaaagcuucccagaggaaaugagucuaagcuaagaucugaaggaaaucuuggaguugacagggggaggaagagauagggagaagaagaagggaacaguaugugcaaagagaggagcuggaacacagugccuugggaaaaggaaaguaacucagcacggcuggaauuuguagcucaaggcggggcguggugagagauuaggcuggaaaagugguagagaucagaugacauguggucuucuaggcugcauuaagaaguuuagaggccgggcgcaguggcucacgccuguaaucccagcacuuugggaggccaaggcgggcggaucacgaggucaagagaucgaggccauccuggcuaacaaggugaaaccccgucuccacuaaauauacaaaaauuagccgggcgugguggcgggugcccguagucccagcuacucgggaggcugaggcaggagaauggcgugaacccgggaggcggagcuugcagggagccgagauugcgcaacugcacuccagccugggugacagagcaagacucugucucaaaaaaaaaaaaaaaaaaaaaagaagaaguuuagaauagcagggagccauugauggguuuuuguuguuguuguuguuugucuguuuguuuuuugagacaaggucuugcucuguugcccaggcuggagcgcaguggcacaaucauggcucacugcagacuugaccuccgaggcuccuaccucagccugccaaguaucugggacuuguaugugcugccacaucuggcuagcuuuuucuauuuuuuuuguagagguggggucucacuccuguugcccaggcuggucuugaacuccuaggcucaagcaauccucccaaagugcuggacuuacaggcacgagccgccacacccagcaggaguuucauuuucauucaugauggacacaucugagacagccuaaaggaggccauugugaggaucuggaguuuuccugcucacaaguucugagccugcugcggagccuuuuugaaauagucuuagaugaggcuuauaggacccaaccaaguagccucuauacuccaguuucaguagccugcuguccacgguuugguggcauauaccaggcacuagaggggcaauggcuuccacuggcacacaucaaaugacuuccagcuuggagucaggcccucagaggagguggcugccaaccaugccccauaaggagguaaaaauggagguauguguuaggaggagacuagaucuaaagcauagcuugugggaaugggagcuugagguguucaguuuaugcagcaggcaaguuggggagcagagcugaaggauucugagugaagaagugcgugguaaaaucucagucuuaggauguauaaccuagugauuauuaacaaggugaauuggagguggggagaccaaugggagguugcuaccauaaugcagaaagauuuuuuuuccccuuuggcuaaucaaauuaguaaagauuuaaaaauugauaauguggaugaugguuuaagaaaauggguauaaucauucauugaugaugagauugugaauugguauaaccuuucuagaaagcagucuaucaauacguaucaacagcuuuuuaaaaguuuauaccuuuugacccaauaauuucuuuucuaggacccuaaccuaaggaaauuaucagacauucucaaaaauaugaauccucaucaguccuauuaauaauaacaaaaaaaauggccgggcacgguggcucacgccuguaaucccagcacuuuaggaggcucaggcggguggaucacaugaggucgggaguucgagaccagccuggccaacauggugaaaccacgucucuacuaaaaauacaaaaauuagccaggcgugguggcccgugccuguaaucccagcuacuugggaagcugaggcaagagaauugcuugaauccagaaggcgaagguugcagugagucaggaucaugccauugcacuccagccugggcgacagagcgccucaaaaaaaaaaaaaaaaaaaaaggcaagaagugaagaugacaguaaacuugggugacacuuccagaccuacaaaggauaggagaggggccaauuuuggcaggguuuagggggaagacaaugacuuuaguuucugcucugcugcgauggaggugcuaggagauauccaaauccccugaaugccugagugauggaucugggcucuggaaagcaugguucaagugugucaugugacacuaggagaccagacacauggggguggugagugaaaugaacaggggguccaaccuggccauggagaagcauugcagggacuagaacaggcccaagaacgcccugagcaucuccacugaguugcugcugaagcuacacauacacucagaacuaaacgggcuggaaaccuucauucaaagccuagcuauguuauacuuugguacagcuccuguagcucaaccucaggcugggauaagguaagguaugaauguggggcaaguccugagcugccaugauuuuguauuguagagagguuccuacucguaaggauggaaagcaaccuuucugcaucucuucaagguaucuugcucuccugauuccccauuucuuauuccuccuaucagcccaucacuguugagagggccgcagauucucccaugcaccuaggggagauuugcucuguugucccugauuucagggaacugaaugcuguccagaacucugcaaaaccaagaccagcugcaugguacucaacagccuucccagcuaaugugcagcccgagagacacagcaggcuccuccaaggggaugucuccauaaccccaagcaucuccacccaacaccugccucucuugguugcaguagagaggucaagucugggucaucugggcuucuucucgagccuucuuggcccacuucuccaaaagccccuggcccucuuggcuuugccaaggggacuguggagggacaccagucaggaaucaggagggcucaggccuacgcucaugcuaucuuuuuggccuauuugcucucuuucuaucccuuugggcaauugagccauagggccugaaacauucccaggcuucuacccugcaggggacaaacucccaacuccgcuuggcucuagguccucgcagagcugcaggcugaggacagggcuucucugguggcuuggaguccuugcugcuucacuuuuuggagacaggacagauggagcccaggcguaggauaaauaaaccaaugaaaucugagaaaacaauguccugcuacuucucuucagagcuacugcccacccccuacucagggcgaaggugggucugucugccagcuaagaugcuggugugggauucuccccaucccuggcuggagaccccucauucaggcggccccugcagcuuggcguguuuaccuaacguggugaacacaugcucucucuggaggaucauuguuuucccucugaggcccuucagucacacuggagucccccaguuaagaagcagcaggaggaaggggaggaaggggucacuagaauggggaagcagaacugggagggaagagacaucaggcugaucacgcugggcaaggagggaagagagagagggaguuccaaggcuucaggaccugcuggcuggugaacaccucuuacuguuggaaacaccaggauucuaggaaugauggguugcgagcaagagacuaucacucuuggaauucacccuuuuugagaaccacagaaaagguggagagagaaaaauuccccuuggugauaaaaguuccucaugugcgcucugccuccuucgcuuaaacuugaccuucacuuagcaauuguucagagagccuccuauaugcaaggcauugugcuagggacuggggcuaaugaaaugaauaguugggaaagauggccuuguauaucaacauugcaaugcuacaucauagcuguuuuuguuuguuuguuuguuuuucccgagacagagucucucacucuguugcccaggcuggagugcacuggugugaucuuggcucacugcagccuccaucuccuggguucaagugauucucgugucucagccuccugaguaccugggguuauaggcaugugucaccauaccugguuaauuuuuguauuuuuaguagagacagaguuuaaccacauugcccaggcuggucuggaacugaucugcccgccuuggccucccaaagugcugggauuacaagcauaagccaccacgcccggccaaucauagcuguuuugagagugucaagaacuaaguacaguaguugcuuacuagaaagaaaggguuuccacuuauguuuggagggguuagggaagacagcaucucugagcuggguuuuaaagaaugaggcugggcgcaguggcucacgccuguaauccuagcacuuugggaggcugaaguaggaggauugccugaggccaggaguucgagaccagccugggcaacacagcaagacccugucucuacaaaaauaauuuuuaaaaauuaagccagaugugguaccuguaguccuagcuacaagggaggcugagguaagaggauugcuugaguccuggaggucgaggcuguggugaggugcaaucauaccacugcauuccagccucagugacagagugagaccuugucuaaaaagaaaaaaaaagaaaagaagaauugggagaguaccagaggcugaaugaaggagucuagguggggagccuggaaggaagaaacauuccagguaaaggaaaucuugugugcaaaugcuaggaggcauuagagagcucugauguaauccuggaagcaaugaggagcuguuggaguguuuuagacagguguuagagucacguuuuaggaagaucaugugagcagcaguggggaggauggacggcagggagaaagacuggauggugaacauuggucagaaggauuuuuuagacaguauaagugagcuacagggaggaccugaacuaagucaguagcaggggcuagagauaaggggacauauauaagggacgauaaggaauccacaggauuucgugacuaacgagacaugggggaugugaggccaagagagaagacggugaggaugccuaggauucuggcuuaagggccugggacaauagcgguacuguucgugguagagagaaaaugaaggaaagagaacaaguugcgaguugaugugugcgggugcuggggguaauaagacuguguuaagagucuggguugagauacucaguaugcaguagguagaugggccuagagcagcuauaccaaagaccacuucaagaucucaugacuggauaacugagaggaugacaaugucaucaacagaaauaaugaccgcugaaggugaauuaucaugggaguuggggcuacauggcggauugaauuuugagaugucuauuggacaaagcgcugaagauauucaccaggcaguuggaaaaaugggaccagagcagcacgaggucagauuuggagcuuuauauucaggaguccucuaaauaaagauaauagcugcagcugcaggaauggaugagcucaucagauuaaagugugcaccgagagaagagggucaaagguagaacacugggaaacaccuacuuuuauuuaggguggcaggagggcaaagagccagagaaggagcugucugcaaggagaaccaggaggugguaugagagaugccgagagagaaaaguguuucaggagggugaccgcaggguuaggcgaagagauguuaagaagggugaacaccaacauggacuuggagauguggaugaacaaucuuuaggagaacagauucaccaaagagguaaggacuguggcagaaaugagccaguggagagaauggaagugguuaaauauaaaaaagccuuugagcagugaggcagugaaggggacagaagcucaaggagugaggaggguuuaaagaauguguuuuuuaaaauggggaaggcuugguccaguugcauuuuugugacacacacaaggagacaucuucacuucagcucugucucacagggcuguuggcaaugccuuuucccauccugggggcucucguguccacagauucccagggccuaaugugccaggcacccuggaggaagcaucccucucaaugugugacaacaugaacaccuugguuuucuucucccuucuuucugcccugcuuccuucucuuccuuugcuuauuuacuugcugaaccccuccuuagugucaucugccuugagggguaugacucugggacuggggcaggugagagaggaccgccaggaggcgccuggagaggcugcuguagcaaugcaguuguccauagcaggugggcuggagaggagaguggaugugggagagggauuugagacuaaccagacauggguggagggaaaugcaggggcagagcuggcucagaagucccagcuuuggggugccagcgaggggucaggagugaugcccgaggucuuacuuuucagagccagagcucggugcaucaaugacucugaagcaagcacuccaucucgggguaacaugauccuguaacgcagggcuccucugauguggucugcuugccuuuuacagcauuaggggagcaacauuucauggaaaauucaauaaaucccccuguacagccagacgucuguaaacaauggcuuccaaauucaaucaggcuggggacccgcagcagcauuuaugagcucuaacguggaauauuauauaggggagugaguagcagggggcugggggaagggacuuccuggaagaagaaagcuccuguguggcuccugcucucagauguugcgguggaggugauucuccagguagaaguccuagccaugcgaccucuuaggcugggccuggggggccacugagccauggcucugggccuggggaggaggacagggaucuggccuucugguacuggccaugaagaggcuggguggccggaagaaccaggaccgagagugagcucgccagcuucuccucccacguccugcagcccaugcuuaccuggcaagcagugugagucaucucgggugcuuauugucuuugucacaccuuccaccuccuuuuacaaaccuucuacccacuuugguucuauggucuggugaugaucuucagagaacuagccccuuucucucucagguucagaaugccccucacucaguucagaaagguuugcaaugagguaggagaacaugcaagaaaggguuucuccucgucucuacuauaaauagaaaauuagccgggcgugguggcgcaugccuguaaucccagcuacucgggagacuguggcaggagaauugcuugaacccaggagguggagguugcagugagccgaguuugcgccauugcacuccagccugggcaacaagagugagacuccaucucaaaaaaaaaaaaaaaauuggguuucugaugaagagguugcaguaugcuguuuuagggaggcucagaggucucacccaucuuuaggcccccuagauaucuccucuccuuggcccugugaaccccucuacacucuggucaggucuccuagccucugcacccccacccccacuguugcccuugcacccucugccaggcuuucuccagcaaaccacaaggagcauaauugggcaaagggaagaacuaaaggucuggauucaaaucuaguucuucccauuucccuguuauggaucuuggauuagucacuuccuccucugaaucucaaggugggaauaacgugaacugccuugcugagugccugaggauaaaauuagauaauggauguaaagugccugaaaguuaauggcauggaaucagcaugaaauacacaguagcuuucuucuccacaauucuucuccuuucaaaccucccuucaauaaagcuucuuuuaauccucagaaacugcccucccuccaaccgaagguaccagaugucccgucagcucuucucucuguccugcacaucuccgaguucccuuugugacuggcucuucugugaggccugauuugaauccaacaggaagagcauagaagaucacaauggaccauggccacauggaagggguggaggcaacgccgaggugucccgcuugccuuccuagagaacuacggcguaagcuccucaagggcaaggauuuuagcccgcuuuguuuguggcucuauucccagggucuagagccaugcuugacacuugguacaugcucaauaaguauuuccugguugcauuaacucauucagcaucuucucaccauuuuccugugguuuuucucuguacccagugggagaauggagagauugcauuccaggacauacaacaaccccuccuggaaaucagaaauccucucuuccuucaaaauguccuuggaacacuggucaggcauccgccguggagugggcauggagcagaaucacagccacaaggcuucuccuugcagcccacugcuagaaacaaacaugucuuggaaggcaaaguuccacaaggcuuuaggcuaauccaugcccagccuuuggagauugaaaggauaacuuccagaaaggugagcuagagaugcacuucccuccuucuccggaggacaguucuauagagcccucagucaaucuuaaaacacagggcaacagggaggaaaagguuggcuagccccagagcaaugcugaguggcauuuauaaaggauuuaucgugugccagacucugcacucagcacuuacaugcaugaacucauuaaaaccucgugcuggcuaguacugguauuagucccauuuuaccuauaaggaaacugaggcucagagagguuaaauagcaugccaagaucacagggccaagaacaagaggaacagggugaucccaggucugucugacuccagagcacaagugacuacccacuauaaucuacagccucagaagacagggauggagagcaguccuuggcucagaugguucuggggccccggcagagaucaagcauuuuccugucugcuccugcucuguucuucucccacccccgcuccaguucacagugggcaacugagaucauuguuugggagugguugucuccugugguccucccgaccucuugcuggguauucccuggggaugaggaggaagaugggacagggucaggggagagcugcugcucucuguccccagcuccacaggccagugggaugcucugcuguccagcugggaccaguuccgggcaacugggcauaaugcaagaguucucaccccgggcccaggcuggagauaggcugcuugcuccaccacucgccacugcccaguaaucccacucaucuggaggaaggagauucuuugggaucagagcuggcguugaccuuuugguuuuuccauuuggcaggacgggggagggguucaagaaggcagaucccagagauaucuccccccacagccagauacccagcuuuugggguucugggauugacuccugaagucguuacaugugaaaugcuugcauguauuuuuuuuuaaugcccaaaacaugaugcaauguuuccuguacaccccggucacguacucuuguacaugcacacacggcuuccacguugacuucugugacuagccccuuccgugcuccggcuugcuuuugcucucucuacuucccccucccucucucucucucauucucccugcuagcugcuguaaggaucaguccccaaagaaaaaugcccaauuugucaugucauguccagcuguuaaccucccgucgguaagccauggggaagacuuacuuucuccuauuuauuuauuugccacuuggacaauagaaggccccaggccugcugaguucuccauaauaaagccaccaacgaucucccccaucacccccuccccuccccccagccccaugucaacaacacuagccaaccugcaggugucacugggcauuaaccccaggcuuaacucuggcucugcucaaccggagggaagggggaggggguagccggcgaagguggggggucugacggggaggucucugcacaaagaggaaggccuggggaugggcuggcucagaaccaucccuccggaaagcucacugugcugaggcugggggagggagggagggaucaaccaaauaaugcagcuccuucuucccagcucuccgauggucuccaggcagagccuuggccagccgguggcaggcgccugggcucaccgcaccuagcaacacugccgagagacagggcccuccaggaaugaggcccagugcggcuggcccuggagcgggccugggaggggcuggggcagggaggggaggcgcagacccuccggcccccagccccacucaagguaaccacuccuuucuccagcacugccuuccuccccucuccagccuucuuuggucagcccaauuugcuacaggagaacucgaggguucaggggaagcugcuagcaacgucccaaggcugggcucccugucucccuguggauuaaaugagaggugguggggcaggggccugggcagcccuuccuucuguucagaugucagagugaguuacggaucacccugaagugcagcccccauggccuuucaucuggggcucccagccccuuguugucaagaacaccauccucucuuccuggaacccuagcuccccccuggggacacgcuguggagggaaaacacagauuaggauuagcugggauugugcgccugagccugguuccccagccaucucugugguaguuucuuacuuucugcuaaauucccuauauccuccucccucccccauaggacauccuaaaguacaggggcaugggcagggcauuuuccaaggcuagucacucaaggcucaguguguaacccucugcugacuguccucagugaggccacagccuuggacucacggcacccagauacagauaaaagacuuggucagcuccugcccacugagguuucuugugcaucuuuguucacugucugauugacaguaggaagucacagcucaauggaaaaggaaaaaugauggucacuguaaagcucccuugugaggguccacugggucugcacugguacccccucuguucuuggcccagugcuggcaucaugugaagcagcuggagaaaccagagagccuagaggaccaguguacaggaacagagguccaggaucacacaggccaggcagaaaaggaccccaaaggcuuaguuaggucaagcccaggcucugccauagcauggauccugauugucacagcgagagaugcaaaggucuugcuccacccgggggcauucugaaguuaaaauuuuucuuaagaggaaucucucaaaauuuaauuuuauaaaauuaccuauauccaggagacauaugggaagaaggaaucugacaguugcaauguuucagagcaaggugacugaaugggaaagcaccugaccaaacaggagaggcucagaugacgguucagugugcaaaggacuuguggcugucuagaacugcucugcagcgcccugggcugccuugagaagcagcaccuuccaacaggaacauggugaugaccguccggaacagaaaagggaaagcuccuacaguggauagaagaugggaccgugaaguaagucucugaggaaccuuccaguuagugcucagaaguuaugauucuagagauagcaugauccaguuuaggagacaaugugguacggugauaaauacugacaauguugugagauggaccuggauuugauucccaguucugucaguuacuagcugugugacuuuguuuuuucuuuuuuuguuguugagacggagucucacucugucacccagacuggggugcaguggcacgaucuuggcuuacugcaaccucugcuucccgaguucaagugauucucccaucucagccucccgaguagcugggacuacaggugugugccaccacaccuggcuaauuuucauauuuuuaguagagaugaaguuuugccauguuggccaggauggucuugaacuccuggucucaagugauccacccaccucggucuccugaagugcagggauuacaggcaugagccaccacucaaggccuacuagcugucugacuuuggaaaaguuacuugacuuuucugagguucaguuucgucuuccaugaaauaagcaugaggauaccuaccucucaguuguugggaagauuaagugaaagaaucuaagggaaaacaccuagaauaaugccuggcagauugcaaacaccguaacaaauguuaauuacugucucuuuuccuugucugaaacuuacuugguucacucccugccccaaaaaacgaggaaaucaacuugcuauaucuaguggccugcacaccagggagaccugacucgugcucucagaaaguuuggucuuucuuggucccuucuuguacaccucccucgguucuggacagagacacuggcguggcugguuugugugggaggcaucuacacauuucuugucuggccugaauagcaggcauuaaaaugcauuuugguucacccaggacaauaaagaaaaaaaaggaagcuuuaagucacuaauaaaaaucaaauguaggcaguuugcaggagugaucagcucagagcuuugcuguucucuuguuaagggucuagagccauaaauaacuuccccauagaaggcagaggcgagggggagugagugagagggaacgcaacaacacaaaauuuuucauuuuucuccauaaaucauuucagcgugcgauaauauuuguuuuuucuaaugagucucuugugauccauuccaggagcuaacaucagggccugucagggggugaugugugguacaguucaacgcuuuacaaaaacugccugcuacacagauuuuuuuuucucucuuccuuaugcuaaguauucaugaagcccauuauucugugcucaugcuuuacagauucuuccuuucugaucuucuccuuugggcagcagccguccuguucucuccucugucugccugugcuguggggucuugcugcagccuggggaagagaugugggcagugguugaggaaggcugcucagagguauccuggggagaccaucaggcauagacuuugagcuuggcugcauaaggggagcauucuucaaaguucagcugaagccaguguggaagaaugccuuuaaaugauggauuucucauggcccagugguggacccuaucacagugggcaagaacaccugccaaacaaaaggcccucaaagagagcuggcaggcuagacagaggucagguuaguaagagacaguauucauaccacgccgaagaguuuggaguuuauccuaauaggcaaaagaggucaaucaagaauuuuacaaagaaucagauuugcauuuuagaaagaccuugcugcaucauuaguguggagcauagauugggggagagguacagguuagaggaagcaaagaguaggaugggaaucagaaaauucuggaacaguguuggauuaauacagaugaaaaaugauaagguauuggauucagaaaugagagauuuuggggagagcuuaguaaacacuacucauccuuuaagacugacuuuaguguuaccuuuucugugaaaucauuuccacacucuccagguuggcucacuaguuccuguuggcuccuguaauguccuuccauacucuccucucugcagacacucauuacauugcauuaugaugauuagccugagcuccuugacggugggcuccaggcuacgugaauccuugugucuugcucucucauauggugcauggcacguagaguggcucaaugguauuuauucacauuuugaaugaaaacaaaagaauaaaaggagggaagacagaacuauaaguagaaagcucgggcauuugggggcaagugaaagaagaggagucacccaaggagacugagaugggaugcucagagagucaggaaagaccugggagagugacaucagggcucacggcgaaccauaggaauagaacuuuauuuauuuauuuauuuauuuagagauggagucucacucugucacccaggcuagagugcaguggugcgaucuuggcucacugcaaccuucgcaucccggguucaagugauucuccugccucagccuccugaauaguugggauuacaggugcccacaaccaugccuggcuaauuuuuguauuuuuaguagagacgggguuucgccauguuggucaggcuggucuccaacuccugagcucaggugauccgcccaccugggccucucaaagugcugggauuauaggcaugauccaccgcgcccagccuuuuuuuuuuuuuuuuuuuucccuagauggagucucacucugucgcccaggcuggaguguaguggcaugaucucagcucacugcagccuccaccucccggguuuaagucauucuccugccucagccucccgaguagcugggaugacaggugccugccaccacgcccagcuaauuuuuguaguuuugguacagaugggguuucaccauguuggccaggcuggucuugaacuccugaccucaggugauccaccugugucggccucccaaagagcugggauuacaggcaugagccacugcgcuuggccagaauagagcuuuuuaagagggcaaugauuuuuggugccaaaugcaaaagugaaauuaagacagacaaagacagaaacauguccacagaauuuggcaauuccgagguuguuacugcuguuugagagagcaguuuacuugcaguagcgagggcagaagccauaccagccagcucacuucuagaugagaugugagaaaguguagaccaaucuuucaagaaaugcaacuaagaagaaaaugacaaaaacaagaguagcuuaaggggaaauacaggaucaaggggaucguuucaagaaggggcagggauuaaaaaaacauuuauaggguaaaucagacggaaaagacaugacaagagagaaaauacuggagaaagguaaguagauacagagcuggcugaauaaccacacccaaagaauauugaugagaguuugaaaacaaggucuccagugacauaugaccagauuuguccuuuguccuguacagcauuuuuaucaacaacuugaaggcaugaacagcaugacuaacacauuuauagucagauaagucuagggacagccaacaagaugaaguacaggaucaguauucaaaaaucacuucugcaaguaggcauacaggugagauuuaacagacgaaaguaacuauucugcauguaggcuaaaaauagaauuucuggaaguauagguuugagaagcuacgccuugagaagguucaugggaagaagauccaggaauucugguugaguuuacauuugccaaaagacuucugaagacuccagccacauuggcagaggcgcagugcacagaacaaaggcgggcuggucacaccacaaacacagugggaacauucugcacuuuucugggcuucguaccauucaggugauaggugacuagggcgaggugggucaggauggaaagaugucuuggaacccugacuugugaucauugguuggggaaguuggggaaagaauuugagaaaugcgacaggaauucuuaaguauuugccaguuuaucauauaguaaagagaauagacucccucugaagagauucaaaggacagaacuuuacuccuaggguaacgaaaggcaaauuuuggcucaauaugaggcaagaagucuauggaucccccucuaugcauggguuuagggucccuaaaauggaauauaaaauguuauguaaacguuaauauacauuuuuuuuuguagaagguguucauggcuuucaauacauucugaaaggagucugugacacacacacacacauuaagaaccacagaaaaagggagaauuuucuuucaauuaugguaauuggaauggaacuauggcuuccagaaggagcaggauucccaucacuggauauguucaaacaggggcagaaagaccuagugaacucuaucaaguuuagaggucugauacaagaagggguugguuguagaccacgcaaagaaagguguuuguguguguguguguaugcaggggguagaagaggggcagagagaaagaagaaggcaagacagagguagugagauaaacacugucaugggccguuuccaucauguacucacaagagcauaauaaagcccuuguaauauacuagaacuuguguggucccggggccuaauuugcauacuaauuacugagugcaaaugggaccgagggguagggagggagggugggggaggcaugcagggagcgaggggccuggacuguuugcucugccauuucauaucaugcuaacaagcuaauccggcgugcaguuagcuccugauauauaacugcucauuaguauuauaauaaaguacaugaaacaaccauaaaacguuauauacugcacaaguguuguuuucuugccaauuaucugcaggcggauuuaucaccacaguuguuucgaauuccccuuggugagguuugggcggaauaaagaaagguguugguggcggcagcagcagaggggggccuuuucgaggggcagaccauguguuuucuuaaguagcacuuacugaugcgccauuucaugagagugaagcaaagagauccguccuuccccagcuccgcagccccagaggaaagcgacaagggugagagcugagaaaggcugcaggcccauguuccagggcccuggggacacagggcccacagccugcuggacagcccagaaccuccaaguauaaaggccuguaucaaucccacggacuguuuaaugaggucuuguaaaucugcaccacuugcugcucuccaggcuuccaagcuugcuguucagguagcccaguucaaagcaauguuucacccccacugccuuauuccuaaagcacuuacugaaugagcucuagugaaggcagccuuguucugagaagauguucuggagaugcgucguucuugcaaagaguucguuucugccucugggcucucaagggacucucacaacacagccacccacucaguguucugggaggaguauggagggaagcucugacuuucccagacagccuguagggcccaagucacaccuccuaaggucacccuacuccaucaucaccagcgaaugcaggaaggcccuggaauugggaaguagagaagaccccuuucucaguuuuacucuauuagauuagaaaagagcacccuugcuuaauagcgaguugggaugagguuucagggcccuguuacacuucauccuuucucaccgcuccccaggcugaaggaaaauuugcagaguucucauauauucuaggaaggccucuugaacugccuggacccacagcacguagccagcucccagcagccucacuguugggaaugggccacagguuugaagaagccaauucuucaaaggucugcucgcugaccagaagucccagccaggccccauacaaucucccagaccucuacuaaguagacaucagcuucaguagucacccaggagcugcgcagaaggauggcgggucagucccacuuugccugugcugugcugguguaucgaaggacugauguggguauuaggaaauacacauuaacuucaaagacuaacaugaacagccacauuuccuuuagagauccauaguggaugugcuaauucacaaacuaaauucaaauugugaacacaucuggccugggcucugggcuccucucaaagaacccuaauaguaaacaaggcaaggaacaucagugggaguucucacaaauuucucagaagaagcugccuccuggccgggcacgguggcucaugccuguaaucgcagcacuuugggaggccaaggugggcggaucacaaggucaggaguucgagaccagccuggccaauauggugaaaccccguuucuacuaaaaauacaaaaaucagcugggcauggugacaugugccuauaaucccagccacuugggagggugagacaggagaaucgcugaacccagggaggcagagguugcggugagcugaaaucgugccacugcacuccagccugggugaccgagugagacucugucucaaaaaaaaaaaaaaaaaaaaaaagaagaagcugccuccugaagccccuccucacacagaaggaaauguaaugaaguuguucccccaguucccagccccuacccccgaugaagccagaaagcuuuacuccuccuacggagauuagcaguaacuugcucccuggucacaacgagucuggacaacucaauagcucccccuuucccgcucuaaauagcaucuccacuugaagagcuuaaaaacauuuaguaaauuucuguuccagguauguucuuuguuguuuuaguucucuccaaucuuuaaaugucuguccguaucagauaacaaaugacuagagacguaaugauuugacuauuuucuaaugggugugcuuugauguaucacagacuugagguuaacgaacuggaggaucaccuuucucuuccauauacaauucuagguuucauaauucggcuauuaugauggcaaccaugaugaugaugauggcagugaugauaaaggaaugaccaccucauucugauacuugauaauccccaaaucuaaggaaagaacaaugggcugaaaggccauuaacaucuccaaaccagauuaaaugccaaugcuuugucaaaguccagcagugaagaagugauauuugguauuuagaugcaaucguaauuugaauugacuaaagaaucaaguucagggagaagggagggauagcauuaggagauauaccuaaugcuaaaugacgaguuaacgggugcagcacaccaacauggcacauguauacauauguaacaaaccugcacacugugcgcauguacccuaaaacuuaaaguauaauaauaauaaaauuaaaaauaauaauaauaauagaaauguaaaaaaaaaaucaagcucaggccaggugcaauggcucacaccuguaaucccaacacuuugggaggcugaggcgggaggauugcuugagcgcaggaguucgagaccagccuggccaacauagcgaaacccaaccuccaugcacaaaaaguaaacaaaauuagccaagcaugguggcacauaccuguaaucccagcuacucaguuggcuaaggcacaagaaucacuuggacccgggaggccaagguauaguaaguugagauugugccacugcacucuagccugggcaacagagcaagagucugucucaauaaaaauaaucaaguucagacucuucagcugaucuuccaugaaguggcacccaccuccuucuucgggcucaucuccuaggcccuaccucuauguccuugcaaugcugacuugggucaaauucccccuaaaaauggaugcuuucuuuuaccucucugcuuuugcucauucugaucccucuacuuagaaugcuuauccacuuuuuuccagugccaacuccuccuaacuugggucaggugcuaucuccugcagaagccuuuucugacaguccaucccuugucugaucuaggugacccuucaugugcuggaagcacccuguacuucuaucucaugucaaucaauagcuuuugaaccucuucagggcaggugucuuauucuuuguggucccugcaacucaguaugaaguacuggccgaaagcaaguacuuaauacauguuucuaucuauuccauaguuugggagaaccaaccuggacuaaaacuuuauuucuuuuucuuuuauuuuuucugagacggggucucacucuguugcccaggcuggaguucaguggugccaucagggcucacugcagcccuccuaggcucaagcaauccuccugccucagccucccaaguagcuaggacuacaggcaugcaccacuaugcucagcucauuuuucugauauuuuuuagagaugaggucucacuauguugcccaggcugaucucaaacuccugggcucaagugacccucccacuuuggucucccaaagugcugggauuacaggcgugagccaccaugcccagccuggacuuaaagcuuuaaacucacaccaguaugcugaccuagagccuucagcagacuuucguuuacucuccccuuuaggacucaaagcugggcaguucuuuccaagaccaaagagagggggcaaacccucaugucugugacauuggaaguccaccauuuuauugccaucuauuuccuccuuccuuuuagucuggucuuuaaaggugcaagcagggacugaccagguccagggacucaguggcucaauccuacagagcaacgcagcugcaccgacuuccccuagggagcuggagcuccccucuuccuccccugcugugacaagaaggucuucaggggcaggaccauucagcagaaagccucaguauacccuucugcuuugagcuguucccauuugcaggagacacagguggauagcaaauagaugacugguguuuuucauaagauugcuguggggcuuaacggagauaaugaaggcaaugcuccuaucacugcaucagucauacaacaagcacucaaguccuacuguucugcuccuccuuccccuuugaaaggcacacuguuauaauucaaacaaaacagaacaaagcaaggcuuugaagucauaaaacaauucggccucuuauaagcuauucaacuuugcaaaaguugcuucccuuucuuaacuucagcuuucccaccugcaaaaugagcucauaaugcucacccacaguuuuaauaaggaauaaaccacgugauaaaagaugccaaaauacacauaugucugaaguguccaccucugguauauaguggggacucaauaaauaguagaaguaaggauaacaauaaauguaagagucugaauuucuaucuaaaaaaacagcauaaggacaggaugaaagagacaugacucagcaaugagacaagguagggguuuuaguugauaaggucaguaugagucagcagcuaaugugacuuccagccgcauucauaaaguggugacaggcucacccugcuguguccugguuuggccaccuuggacagggcaggucugggcaccauucuuugugagcucaaaauaauaauaaauguaugugaaggcccguuguaaaccauaaagagcguacauauguaaaacaucauuaugaaucaucagcaguagaguauuaauugagagagaggucaucugcacugacuuuagagggauaaagcaguacaguagaagggggagugagacucagcaccuuagaaaaaaggggggcagaaagaggaggcuuagagaggggugacacaggcagaggaagcugauucuuguauguccccuaugagccaaaccaagaacaguuggugaaaguuaaagcuaguuuaggcucauuuuaagaaaguauuuucuaacaaucagaguacugcuuugaagaauaaugagcucccccucauaagagguauucaagcagugauuggaugauaauugguccuaauggagggaauucaaacauggaagaagagaccagaucaucuugaagggcucuucugaccccaaagugucauggcuuugggggcugucuuucuccuguucucucucaucacaggggaagggaaaagucagaaaucuucaauuuaauaacugaucugauauuccucaaacacccacuaccugccaggcauugugcuagcugcugagaaaauaagcaaaaauaaggaaaagacuuuggccucugugcucuuacagucuaaugggguuaacuggcaaagagcuuuggacacacaucagagagagcaacuaaaugcuuggaacggagugaguccaccagggagaugauacuggagcugaguuuugaauaaauaaucuuccuagauggaaaagggaaauaacaggacaacagguagaaaggacaagaccugcaaagccauggaaucauggaaaagcagacaaaguuuaggggaagaugagcugcaugagaaaugggacagaagaaauaguuugggcuggauugugaagcacuuagugaaacuucuggaggaccccggauuuaccuugaggauuacaggaagcaagggaggaaucuacaaagagcagcccagucacaccuguguuuuaaaaggguuuggaucauaauucugaaagacacaauccugaaugccauaauucuaaauguugacaucccaaaagaucaaaaucccuaaacguaaaucucuaauguccaaaaucuccaagaucacaaucacagguuaguuuucuuucauuauuuuauuuuauuuuauuauuuauuuaagacggagucucacccugucacccaggcuggagugcaauggcgcaaucucggcucacugcaaccucugccuccuggguucaaaugauucuccugccucagcuucccaaauagcugggauuacaggagugcaccaccaugccuggcuaauuuuguauuuuuaguagagacaggguuuuaccacguuggucaggcuggucuugaacuccugaccucaugaucugcccaccuagacucccaaagugcugggauuacaggagugagccacugugcgugaccaguucuuucacuauuuuaaauugucagcauuauuugcuauaauuugcugugcuacguauuucaucuuugcaucauuuccaauacuggagguauaaauuguguagagacuuuuaagagaguuguaauucuuuuuaugcuuuuuuuuuuuuuuuugcagauuugacuccaugaaagugcauuaucacaauguugauuuuguguaucagcauugcgcaucuacguaaaaauguugaaacuuccucaguaaaugacgagauguccuuuuuguacaucugcauuugugaaagacaaaauuucuugagaucucugcucuuugggugacugcauaugugguggugacccacagugguaacccauuguaguuuuugcuccaucuugucaaaagacuuagguuguucaucaugguauuucagauaaccacaauuauaaagcugauggcacacaauuaccaacuauagugaaauguguuuauacauuucccucuuugaccuauuucuuuaugaauaugguucgucugaucauaaaugcuauacucaugcaacuuuuguuaguauaccuaaacguuuauacucacaaaaaaaguauguuguugcuuauuuuuuauuauuuaauuuuaauuuuuuuuuuuuugagauaagagucucacucugucacccaggcuggagugcaguggcacgaucuuggcuuacugcaaccuccaccucccugguucaagcgauucuccugccucagccucccaaauagcugggaguagaggcgcccaccaccaugcccugcuaauuuuuuuuguauuuuuaguagagaugggguuuugccauauugccaaggcugaucucgaacuccugagcucaggcaauccgcccaccuuggccucccaaaaugcugggauuauagcacuauuaccagccuauuguugcuuauuuuauuguguaaaguggccuaugaaguguucugucgugcuuuuauguuuuucaaauaaaucuccuuuuuaaaauauaaauaaauaucuggccaggcaugguggcucacgccuguaaucccagcacuuugggaggcccaggcagguggauuacuugaggccaggaguucgagaccagccuggacaacauagugagacuccaucucuacuagaaaauacaaaaaguaacugggugugguggcacuugccuguaguuccagcuacucgaguggcugaggcaggagaaucacuggaaccugggagguggaggcugcagugagccaggaucgugccacugcagcacuccauccugggugacauagcgagacucugucuaaaaauauguguguguguguguuuguguguguguguguguguaauuccuuuuuuuuuucccaugcauaguuuuacuuaacauuauuuuaggaucucugcugaaauauucuucaaauauauguuuuuaaauggcugaacaauauuuuaucauaugauuauacuauaacuuauuuaaccauuuuauuguuguggaacauuagguuguucucagauuuucucugcuauaaauaauacugaaaugaugauccuuaugcauaaaucuuugaccacauaucuaauuauuuucuuagaauaaauuccaagaagggaauuacuaaaauaaaggauaugaauauuuuaaggauuuugcuacacauuacaaaauugcuucuagaaagguuauacaaauguaugcuuuuaccaauaguauauaagaaugucugccuaacucuacccuuauuagcauugaacuuuauaauuuuaaaaguugccaauucuggccaaacgugguggcucaugccuguaaucccagcacuuugggaggcugagguggguggaucgccugaggucaggaguuaaagaccagccugacaagcauggugaaaccccaucucuacuaaaaauacaaaauuagccaggugugguggcacaugccuguaaucccagcuacuugggaggcugaggcaggagaaucacuuaaaccugggagguggagguugcaguaagccaaaauugugccauugcacuccagcuugggcaauagagugagauucugucucaaaaaaaaaaaaaaaaaaguugccaauuugcagggccgggcgcaguggcuuacgccuguaaucccagcacuuugggaggccgagguguguggaucacaaggucaagagauugagaccauccuggcuaacacggugaaaccccaucucuacuaaaaauacaaaaaauuagccagguguggcagcgugugccuguagucccagcugcuggggaggcugaggcaggagaauggcaugaaccugggagacggagcuugcagugagccgagauagcgccacuggacuccagccugggugacagagugagacuccgucucaaaaaaaaaaaaaaguugccaauuuguaucggcaaaauaucaccucauuuaauuuacaugaacuauauuaauaugaagguucauauuucuuuuauuaacugguuguucauuacuuaguccauuuuauauugagcuauuagugcuuuuuauugauuuguaagcacucuuuacauauuacggacaucaaauguucugcuauacuuacugcaaaucuuuguuuuucagguggcauuugccuuuuauuuuuguuuaugguggggcuuuuguuguuguauaguaauuuagaauuuuuggugacuucauugcauucacacuaugaaaguucuuuccagauacauagcuaugauuuuuacccuuugcauuuaacuuuuuuuuuuuuuuuuuuuuuuuuuugggauggagucuugcucugucacccaggcuggagugcaguggugcaaucucggcucgcugcaaucuucaucucccaagucaaagagauucuccugccucagccucucaaguagcugggacuacaggugccugccaccaugccuggcuaauuuuuguauuuuuaguaaagucgggguuucaccacguuggccaggcuggucucgaacuccugcccucagaugaucugcccaucucagccucccaaagugcugggauuacaggugugagccaccgcacccagcccugcauuuaaauuuuuaauucaucuauuuaaugcauuacuuaaaaaaaaaauaagacagggucucguuauguuuucugggcuggucuugaacuccuggacuuaagcgauucucucaucuccgcaucucgaguggcugagauuacagguguacaucauagugccuggcuuaauucauuaauucugauauaagguacaaggcaaggaacucacuucucuccuacuucccaaguuuuacuuauuuacucccucccucccuuccuuccuuccuuccuuuccuccuuccuuuggugaaagaggacagauaacggggaaagaaaaagggaagacucuaggucaaacuagguuucugcuugugugguuagauggugcugauggaucauuuaaguugcaggcuuggaagaauauaaugaugucaguauugaauauguugagucuggaggugcucugcaaggauucaaggagagauagugaguuggcagcuggaauaugggcaugaagcucaggagagagguugaggcugaaguugcagccaugguauucaucaguguuuagguggcaggugaaacuacaggcaugaugagcucaccccgggaagaugcguaaguaaggagagaagugaagcaguguacucugggaagcagcgauacugaaggggcacaucaagcagaagcuggggaaggagaaugagcaggaguagaaguagauaagauccaaagagaugagucagagaagcuaagggaagagcggcuuugaagaaagaagaggugaucagaaugucagugaagaagugggauagagcucauugagugaaugggcugacugaaugggagguggggaaguggaggcaaugugagugagaugucuuuugaacaaguuuaucaguaaagggaaagaggaagaggggagaguaaugugcuuggaaguuaagauuaaaagaagauuuaaaggggagauuugagggugugugaaggcagagagaaaggcauugguaggaagagggauauuuaaaaugugagagaagagaugguggugccagauugaaggaggaggagugaugggcccagguggaaggaugaguacugaguuaggacacaaguacuggauaguacugaguuaggacaaaagugcugaguaguacugagucaggacacaaguacugaguaguacugaguuaggggacaauucagugaagauggccuccagggugaggccaagguuagggagggagaaaaguuguggcuguuuggccuuuauucucucugaaaagcaggaaaugaagucaucuacagagaaugagguaaacagaggcagugaagagaaauauuuugagagagggaaggguuuacaacaacugcugugggaaaugggaagucauucugggacaaguacgcagacuguugagacuuagucagggucugcuaguggugacaccaguugaaaugguuaugcgcuuuucuccccggagcaucacaggccggaaauagaggagaaaguaaaugcuuucauggauuugggauuugagguaggcaaacaggugggacagaaaggcaaaagggugaggaaauggcacgaagaaauucuuuaaagauguugaucaaagggucaaggucgggcaggaaagaaagugaagcuaggaggggaauggugggcuuguuaaauuaggaaugguccagggacugaaggucuaacggaggucaaaaacagauucagugggagugaggaaggagaacggacauaaggacagcagacgcagcuuacaaaaugggauucagaguucauuauuuuugagacgaagaaauugugggagauggucagacugagggcggggcuguguuuccauggaaucugcuguaggagugcaggaugcugcagcagaggaucccaggauguggacaguccaugugggugcugaaauucacaggaggaacgcagaauaggggugagcagggagauacugagugccaacguuccugcugaauagaggggagaugucaucagcagaugacagugacaaguaaguagagaggaucgaauggccucaaaagagcagggauguuuguaugagggugaaggaacacauguggacagugguaucagcaaaagucacuugcuacaguaguagggggguaaacaggcaccuggcacaguuaggcagaccaaagcggggcagcaguuucaagguucuguuauuuuuuguguguguuuguugguugguucauucaaccauucauucaaaaaggauuugaugagaugcgucugcugagcccugagcgcugugcuaggcgugcaggacgcugccucuuccacaggaaugcacaccagccagcagccuuuccccguuuugccaaagguggccccccucucgcucagcaagccccccacaccaaaguccuggcaccaaagccaggcaggcccugacacggcuggugaccaguaggggaucuucuuguuacagcuuuuuccccagagauaaauaggccacaguaaaaaagauugcuacauccuuucaauaaagauuuuuuuucuuuuccagacagcuugagaaauguuuuaaaagcuucucacauuuccagugaaacccacagagaagaauuuugcuuguuaucagcccuggaagccucugauagacgggugacauuuuuuuucuuuuucuuucucuuuuucucuuuuccuuuuuuucaccagcugaagagagagucacaguguguuuuauaacuggcucucugcauuucaaaagcucaacgagagcucucugcuaaccccgauaagccuugggcucuuagcgucuuaaauaccucugacaagcuauacauuacagcgcuaauaauuugccaaauuugcgcccauaauaugauaucuguaaaacgucaagggcaguaaugcgauuagcggucucaaaugaaauaucgaacauucagcguuuagguccugaauagggggagaaaggaaaggaaaucaauuucaaaagcaggagggaaaaaggcgauaagcguguaauaaaaauagagagagacagaggagagaugcggaggaagagacgggcagagcaagacgcagggagagauagaccagccugcauucguguuugaggcagguaagagauguaaaaaacuuuuacaaagcaguuccaacacgaagcugggaaauaacauuuggucaccacagcaaccggguuuggguggaaggagggaggugggggcugggaguugaggaagggguuggccaagccuagggaccggccuuucacucucugcccccaacagccugcuuccauaaaacacaggaaguugaauuacaaggagucugagggugggcucucacccugcccccaccuacccgaggugggagagucguaauggacuaauuaucuggccagcagaggcgguggcggcggcaguucgcaggagagagggcccgggcugucacauaccaggcucuagacuaaauaacaacaucucacaccugcagcuuuacgagcccuugcugagaggagccagugcaagcccuccccucccuuugccccccuccagcauccccccauucacauuugggcccccacucuagccaggcugcugcuggggcaccagaguggcagggggagucucccccuugcugaagcuaggacccaucgcucaauccuuacaacuugcagguaucucgacucacaaugccgcugcucuugggucccccagcuaauuccccagggaccugagcaaggcaagcggacuaugccauuaaaauaccccaugccagaggucacuggcgagcagguuugucugcaccugcagcuaugucucaggcucgggauggacgaggggauggggcugcgcuggaugcuggauugugagggcagaaaugaccaauggauccucuugggcccugggggauagcagaggcgggagcccucugagcugccucagcacauuucucugcuuucuccuuccauaccucucccuaacaccaugcgaagcagguucuuucaaagcaugguguuccugcuccuucugcaccacuuggucuuggaccugaccccauaaccauuagccucauuuuguaaagagaugagguuuuggcagagcugugucaagagaagaacgcaaacaaugacagaugcaggagccugugccuuagcaaggggauggcauucaggaagcgcgggaccaaguccuauccccacucuaaauguccaaggccucuagucccacugucuccccacagcuggaggcucccaacuaggguucaggccagcucaccuaggcaaagaggaggugaaaggugcuggcuggccuggggugggaggagagcaaacaggcugccuggggccugcccagacccuuccccggggcagccuggaauggccauuacagggccacuucuugcggcaccacgagccauuaaagcaggagugcucggggagccaucagcccagugcagaugacuuccccagauguggcagugggcaggauguggaagcccccagccccaacucuacagacaaaacauucccacacucaccauccucggaaaccccacagcccagagccccucuuacagaugcuuucuagaccauuuagcaggaggcaguguuuauuuuugaacauauguucuuccccaucucucgccuuccuucucccuuacuaguccuuccagacccaaagcugcucucuggaugggcugcuguugguugugacugccaagcuccaaggccaguguggguagcacgcuuuguuuuggcuuugugagugcuuaagcauaugcaugcaugcacacacaguccuacuugcucuaacuaccauuaguggaauguauguaccacaccagcuccaggagggcagggccucagagguuaucuaaguuugugagcaaauuauaaacuaagaucgaguuucccuacuuuccaaaauggguauacuagucaaagaugguccccgggcauugcauuccuuuugggaaggugacaucaagcacagaagguccccccgcccccccaggagggauguuucuaccugaagcucagauuggucucuacuugguucucucuguccaugcauagagcccagcccagugcugugcucaacuauuguccacccaccucaauuaaggucucucuuuucuucaauaaaauagaauccuccaguccuuaagugaccaguucgacuuuuacccccuucaagaagucuucuguaacucaaaugcucugaguucugcuucuucuaauagguauggggccucacauuuauugggugccuacugugugccaggcuccauguuaggcauuuugcaugucauuccauuuagcuuucaggacucuggauauuauuaguccuacuuuauggauaggaaaagaggcucuuagaaguucagcgauuuguccaauucagugaacacgcgacagagcuggaauucaaaccauguccaucugauucaaaucccaccauccuuccaucaugugauggagcuucccacauggaaauguuuugcaaacauuugucauggucuuuucuaaaguguggcacccaggaaagaaaacaacacuguagguuuagucuggccaagacagaguagagacaagauuuuucuuaauaaauccuaaaguugcggccaucuugcuuuguuguuucaugcauagcuggcaguugaccaaacacucagauuuucugagacacucagucuccccuucacuguguucccagacacauuggucuuuggugcuuguucucucugauuggaauacccacuucauucauucauucauucauucauucacucauucauucaguagacaucaauugagagccuauuacaugcuagguacuguacuaggcaguagaaauacacugaugagcacagggacaggucucuucaccgugcauacagucuagugggggccuugggcauugaucaagucauggcagaaauaaacaugaaucugcaguagagguaaguucuguacgagcgauccauguggccacagaagaugugaccucuucagagaagucaaggaagacuugccuaaggaaguaaugauaacaaugcugaaaacgcuaucucaccccugcccccacccacacccacagaggcccaacccuugacucugccuagaaaacuccagcagucuuucaggucagcuuauacaucacuuccucauagagugcuccucuaugguccugaccaggugaggucuccauuggacucuauauuguucucuacagcauuucacuuauauuugguuacuuguuuaaaauuugucaucccauguguaaacuccaugacggcaaagaaugugucucccugguuuccugcuuuauguccccugucaagcacaguaccuagcauuugcuugauaguccggagauguuugcugaauagauaucuugcucuccuauccuguacuggggcagcuaaaguuuuagauccaggugcaggaauucacauuuauuaaauuucaccuuaggugguggcucaugccugucaucccagcacuuugggaggccaaguugggaggaucacuugagcccaggaguuccagaucagccugggaaacauggugagauccugacucuacaaaaaaauaaaaaaacuaguugggcaugguggugcacaccuguaguccuaguuacuugggaggcugaggugagaggauccuuugagcccaggaguuugagguuacagcuagcuaugauugcgccacugcacuccagccugggcaagagagugagaccucaucucaaaaacaaaaacaaaaacaaaucacauuauuagaucaucccaguuuauuagcauuccuauaaauuccaauccaguacucacugaguguuugccaugaacaauaccugaugucggggauacaaagaaacuuguacagucuuagccuucaaggaguauauaaucuaguuuaggaaacagaugagaaaaacaggaauuauaauguaguuguuauguccagaaugauauagcagccuagagaaugaaacuguucaaucugucugggggaagagcaguagggaaggcuugaacuugaaguuuuacuuuaagaugggcaagacgcagggaggacucuuugagcagaggaggcaaaaugugucagggaaacccaaggcaggagaggcagauggcagggaguuaaguugcccaugaacgucagaacugagagucauguaguuucuuuucuuuuuuugagacggagucucgcucugucacccaggcuggagugcaguggugcgaucucggcucacugcaagcuccauguccccuguucaugccauucuccugccucagccucccaaguagcugggacuacaggcgcccgccaccaugcccagcuaauuuuuuuuuguauuuuuuaguagagacgggguuucacuguguuagccaggacggucucgaucuccugaccucgugauccgccuuucuuggccuccccaagugcugggauuacaggcgugagccaccgcgcccagcccgagacucauguaguuucuuacaaucucucucuuucucucucucucucucucacacacacacacacacacacacacacacacacacacacacacaaugcuggacuucagcaucuucuuaccauucuauuuuuuuccaguuugaagaaugccuucuugacagaaaauauagucccuucuugucaugucucugcuaauccauuuuucacacuagcccugaguuaucuuucuaauauauggaucugaucaugucaucaccaccacccucccaauuaaaaacuuucagugguuaccaacugccccuagaagucacccuccauuauggcagacaaggcucuuaacaauuugguccaagguuauaauuucaacccuacuuucuccucauuuccccucacacauccuacugugagucacagggacugacugacaccugcacuugacuuuccgugcaaucuauucuucucucuacauggagagauggagggaggggggucaaggagguucacaacuugggccgcuuacuacuguccguggagcaccuugagcucgacacuggauucccacauugcugaaccaucuggaguucucugagugcuuuucuuucuuuugcugcugggcuuuugcacaugcuacuuccucugcuucgaacacccuuucucuggcuuucagucuggcuagcaccuacuuccuccauuccucaggaugcaacugggguguuacuuuccccaggaagucuugcagccuccgcuucugaggccccacacacagcacccuaugcuugcuuugauaauggcaugagccacucugcauuuuaauagguguuucuuauccauuucccuuucuugacuuugucugauuuauuaucauauguucagugccuagcguagugcuugacauguauuaagcuuuaaauagauauuuguugauuaaugacuaaauaaauaaaugacugaaugaauaaacuucucauuguucucaaaacacaacacgcuuauugacaacugugccuuucucugcaugucauucuaaaacuaaacucuuuuuucauuucuccccaccccucccaacccagccaacaaaucugcucuuccucucccucaucuaccucagugaauggugccucugcccaucuguucaaauuagaaaccugugaguuucucaugguucauuuguucguucauucauuauuuauugagcaucuacccugugccaggcacuuuacuaaacaaugaagacauggccucuagcugcaaagaguucaccuucuaaucaggauuaaguuuuuuuuuuuuuguuuuuuuuguuuuuuagacggagucuugcucuguugcccaggcuagaggaaaguggcacaaucucggcucacugcaagcucugccucccggguucacgccauucuccugccucagccucccgaguagcugggacuacaggcacccgccaccacgccuggcuaauuuuuguauuuuuaguagacaugggguuucacuguguuagccaggauggucuugaucuucugaccucgugaucugccugccuuggccuccuaaagugcugggauuacaggugugagccaccgcgcccggcccaggauuguuuuuaaaggcuuucugucucuucucugaaacaaacuccaggaauaccaugcacugccugauggccuguguuggauuuucccccacugaaugccugaggaagaggaaagaucaugagcuuuggcaucaggaagagguggguuuauuugcauauuuuuagagacaggaucucacucugucacccagagugaguagggugcaguggggugaucauagcucacugcagccuccaacucccgagcucaagcgauccuccuaucucagauuccugaguagcugggccuaaacgugcucaccacugcucuggcuuauuuuuuuauuuuuuauagagauggggucuuguuauguugcccaggcuauucucgaacuccuggccugaagcaauccucccaccuuggccucccaaaaugcugggauuacaggugugagccaccacacccagccuagagguggauuuauuuauauuuuauuuuauuuuauuuuuagacggagucuugcucugucccagguuggagugcaguggcacgaucuccacucaaugcaaccuccgccucccggguucaagugauucuccugccucagccucccaaguagcuggaauuacaggugcgcaccacuauacccagcuaauuuuuguaauuucaguagagaaaggguuuugccauguuggccaggcuggucucgaacuccugaccucaggugauccaccugccuuggccucccaaagugcugggauuacagguguggaccaccguaccuggcccuagaggcggauuuaaauccaagcucuucuuuauccugaacacauuuaauuuaauauuccuuuuuaacaaaaauauguaauguauuaaaauauaacauuuaagugcuuacucucuacucagugcugugcacaguguugaugacucuggaugacagagcaagacccuggucucuaaaaauauaaagaaacacagugcugcccucacagagcuuacacuuagugaacaagacagacaugaaacaacuaaacaggcaaauaaaugucuaacuacauuugucaaacacacuugaagacaauagauaagaaauagaaaagucggugaugacaacagucaaaggccagguuaaaagaaaaaagaaagaaagaaaaaaacaggugaaaucuuuuauagacugggacgaguucucugaggaaauggcauugaagcuaagaucugaaggaugaggggaagcagucauguaaggaggcuggagagagggaacugggcaggaugaaagaccccgaggagagauggggguccgggaagacagggggcaggucuugccgcguuaaggauuaugggcuugacucuaggggucauaucucuuaaaaagauuccuuagcugccagguggagaggcuagaaugggaaguggcaaggauggaagggagaaaucaaauagaagacaguuccagcagugacagaggacagaugcugaugccuggauuuugggcggugccaggcaagcuggggagaagggaaugcauuugagauaggauuuagagguagacugaggggcugaggaacagggaaaggcugaagagugauucccagguuucuggcuuggacaaguggauggggaggugccaugggaaaaggggagagggaacaguuuuggugggaaaaaugaugagcagcauucuggacuggugagggcagagugucuguuagagauccaugugguggugguaaauaggcaguguggagcuucaaagagaggucugagguaggguuagcaugagaauggggacaggagaggacaaaaaggugaaguuaggugaagaaaucauucaucucucugaaacacauugacuuaauguauggaauggaaauaauaugaaaugagaucauguaaaaccacauggcauauaauagacacuccauaaauauugguuuccuuucccuucucuuccucuuucccuucacuuuccucccaucuuccuuucucuuggugguucuucgaucccuuucuuuuucucacuauccuuauacacugcacacagcuaucacaaaaaugaggacagcaaauuucuuagaagcugcuaaacauauuaaggaacaaggggucaggaauaguugacuuaaaauucaugcauccaacuaucaugccauguccuuugcugggaacaccuuuccuuugcucuuuggcugcguagcaaacuucuuaaagauucauuuuaagcuuugcuaauucugugaagucuuccuuaaggucucuaguugauuuagguguuugcuucuucuaggaggugcugcaucuuacaucuaucuuagcacuuaccauaguguuuugacauuaccucuuuggcuggccugucuccuugguagacuaugaauuccuuuaaaggagaacuguuuuuaaaccuuuguauuuccagcacuuaacuuagacgaggcaguuuauuuaaaaauauguugcaucaucuccaaggcucugagauuccauaauuuuaagcaaaaaguuuagaugagugaaaaagcaaacaacacccauaucuccuuugcuauccuuuuagaaggagaugguguagcagcuaagaucacauucaagggaggcagaucugaagguuuuagcgucucaucuucagauccgcacugacgggcaagccaagugauacccagaggcaccugaagccaagucauuuauuucagguccgggugaaaggacuguauuuuaggaaaguguauguaauuuacaauuuuaauauuccuacacagagguagcagauaaggacaagguugccaucucugugcuaaaugucaaaggaggaaacuucuguaagcugcugcuguuuccuagacucuuggagcaucuacagagcucggagaacucugagauugccaagagagccuucucauacugugugauuuucauggauggaauguuagccauuuuccccuauacuggcacccucaguucaucacacaaagggaaaauaaaagggaagugacucaaauuaaauaguaggucugaagagcuuugacucagcaugauaccuggaauagagcaggcauccuauaaauguugggacaaauaaaugguucugaaaccccaaaugccucaguuuuucuuuaagaaccuguauucucaccacaagcaaugacuucuucauuccuagagcaugccaauccuguggaucauuuacaacuuuaucugcuauuacuguaccuaacacaauaaucaccacacaaacuacaccuacauuauucaagaaccaucuacucaauuguguugaccucaguuaaucucagcaacugccacagcucuaagagccccauuuccauuugauucuauacccugcuacccuucucccguccccagugacauccaccccguguucuggauuccccuaguggucuugaaaccuccugguuugucugggcugagauuuucuucaaacauugaggcaaaaugggaagggaauagacuguuggcuuggucccugcugcugauagcuauacauuuccauucaacaccagccuccuggacuugccuuucagaacuuauuuccagccuucauagccacucccuggaacagucuugcuaggucuucccuuucuguguuuguucccccaugacugacccauuuucaaggacugguccuuguucagcccagcuccuaccccuuugcuucuugacuuuaaacucuaccugcccugcuggacgugccaaucuuugcaucuggagcaugagagguuacuguagagguuaugcacacaacuaguaaagcaugaacuucagaaccucuaaagccacuccccaaucugugguucugugacucggguacuucccuugagcucaugugaauaaaacauucaauuuuguuucauuuaugggucuuguuaucauguuagccaaaagauauaucuuuuuuaaaaaaaucuaaaaaguagcccaauagcuggcuaguucuuagcuuaguccauagagaacaccuaaaucccaaguaaaacagggagcagcaggacauucugcaggccggaagaggagaucguuucaacacuagcauggucaucagcauuaaagagucaguugggguuugacuguagagcuucuagugaagcucacaauggaggaagccuaaaccauucugaaccagggacgaaugccuaauauucuagcuucacugcaaccccugaagucuuccucucaggcuacauuuccaacaggcaaugaagaaucaauuaucugaauauucuaguauugucuaguuagacgaaagucugauugaucagcauuuucuacucaggaaggcacgggcuuccaacaucgcagcugucccuccauaauuccauuauuuuaggccgcucauuuaacaaauccugcaagccugcuacgugggaggcacugugcuaggugcugagauuauggcacuuaacaagagaaacaggguccugcacucaaagagcucacaguuuggagugggaguuagacacuaaacaaauauagcuacuugaucuauuacuugguuauauuuaggacuaagcgauacaaggauaaauacaagaugcuacacgacuauauauugaauccaaacaaggucugcuguggugauacuaugaaggguggccugaucuauuacucgaaugguucuuuucucccuucuucucuuaggcucuuucugcuuccugaagggaaacuuccaaagcuaacaaacgccucuauuccaggaagagcggaaguagaagacauuggcgauguggcauaagaugcccauauaccuggggagacagcugcacgggcaugugugcacacacgcacacagacacacgcgcacacaugcagaggaugacccaugaaacaugcccuggggggaagaagaggaagaaaaaaaaugaaauccaaacagucuuuuucaccccgaaaacauauaauuuuguguaaauuuuuacuuuaaacaucucucuuuuccugagcugugauaugggcccugucaaagccagggccaauuacugccauuagguucccaucaugucaccgcuucuccccccgucuggaaggcccucgccucacaggccuauaaucugcacucacuuucgcuccaucacuuucagaaggaacaaaauuguuuuguguguuuuuuuuuaaaagggccuuuauuuggccccugucaacucugaaaagaagagagugaaagagagagaggaggagagagaaaagaggagaaagaaagauuguuuaaguguuuaaccaugagauugccaacagcaagcaugcgggaggcagccuggcuggcccccaugggccaggcucgggaccccagggacgccacacccugggccuugccacuugcuuccccuuuuggguaaguuauuuccauucccagaagagcuccucgcacagguucugaucucauagccuuggaauaaucuaucugaagauaucaucaaagaacaggcagguucugaauugccaaaccagcuacugcgaaugucuaucacaggccagaaagugggggaaccuuucuggacuccaaaucccuuaagggauuggcugcagugggggcagagagucagagaagacccuugggaaugcugaggaugcugcuagcaaaaggcaaaaugaaagcuggucuguugggacagugccuggaccauuggguggguuggcuuggucccucccuuggcucagccgggauguuccuaauccuugcucucucuuccucaggucaacuggcugcuccaggagccaccgagcucacuguugggaaacucgcugccgaagggugaggccccugugccaccugagacagccgcucuucuuccaccguaguuacaccuuccugaaaucugcagacgguuaucacaccccuccgcuuggccaggcugcccagcaugccucuccacuccugccgccuccgucgucacuuagccaagcuaaacagauuuagcuccuuuaaucuuuccucauuagcuggcaaucuggaaaggaaacaaaugcucaccccauacagguucaagcuguugcuuuaaccuuguaaaaguguguagggcgcuggggcuguggagucaguuaggaucauuaccaugaggagccacucccucucagcuaacccccuuaggggccguccccauucuuuuugaaaccaccccagugugucaccucccuucuaggucccagagcuccacauccaaauugugugcaugcaacccccaaagcaaggcagcuuccagggccuuccuauggcuuuuuuggaugagcagagauuuccucccaaauauguucauuuguuucaacccaccgccuccccccauaauuagguguucaugugguuguugacuucuucagguuccugaauuguuccucagccacaccuaccuaucagcuuuuucaguuacaugcagcuuucuccccauccaaaaugagaccuuauguuaaauugguucagaauacucuguucauccagagagugucccucucucugaaugauucccugccaucgauuuuucuuuucugugcaguuuucauuuacauaccuacaaccacagcgaaaaccugaaccuguuuuaacaacagccacuuguggcacacccauuacaacacaucuguuuuucuguuuucaauuugaucacuuagcgcuauucuguuuggugugguuuggcccuuaggcauacuuacacacacacacacacacacacacacacacacgcacacacacgcuucucaauuuuacuuuccucccggagaugacagauuuuuucccccuuucauuguaucuaguuccaaacugacuggaugaacauuuuuaggcuuguuuaccauuuuuuagaagacaggagucacauccguuucacuucuccagccuccugauggccccuuuuacuuucuaugauuuuccagacauaauuauaagugguucaaucagcgccccgcuuaguauguucccagaacacuagccuuaauaucucaugauggaugucauccuggcuugcugauuugugaaaccuuuacauuuucugaguauucuccuaccugcuuucuaucaggaacgauuuuugcacagucugcauuuacuuccuaauuauccaaauuccuuuuugucauuuuucuucuuaaagacugaucuaaaaaaugagcugagcaucucugcccuguaggagguaagaugaaucucccacuucucuucauuuauuagcagucuacaugcucacuggucugucccccaccuuuccuuuccccucacccucaauauauugcuaaacauauuuauucccuuuaacccuucgcuagugaaaguuucucucuaggguucaacuucuugcccgcaggcccggggaucucucuucugguggcuccuguagccaaucccuuuaucuuguagaaaacuauggugaccucacccaaagcuauuccagcaggcaaagccuuuucuuuucccuuauucuuuaucagaauuggcuguagucuuuaguguucucccucuagccuucucuuccucagggcuccaaaaauggacuggcaccuuugaaaaauaaggagaaagcugaagugggcugcaugcuuccuugccucaccaaaagguccucaaacaucacuccccgucauccccccacugcgagaguguucucugcaccauucaggccaacuggccuccauuuugggggccuaaagaaauuuccuagaccucggagcaacaacccuuucucaccuuuaccucugggaaaucuugguuuucauuuugcucauuuucucugugaguuacuaccuuucccuuuucuccuuucauucauucauugaccguauuaagccccuuagugccucccagaagcacugggaauagaguagugaacaaaauagcaggacaccugugcucacagugcguaacgacugguaggggagacaugguaacuacugccccaccucaucgugccacuagaaaccaugauacguuacaucccggaaggacagaaugcuaugagaaaguguaaccggaagacaaaauguacauugggacagaaaggcuucuuugagcaguaaaauucacugagacaggaaggagggguaagagucagggagggugauguuaauguccugaaaagcaaagccugcguauuagacaaacugaaggaaaagcaguuuggcugaacuuagcccaggaagaggagagugccccaagcugaggcuagagagcaguguccuuaacugagcaugaaauacaagacaaggaacagguuuggggaggaaggugcugcuccacugugcccugggguagcugagggagcagcucaugucauauccuuccuuccuuccccucccucucucccucccuuccuuccuucuuuucucccucccucccuccucucucucucucucuuuccuuuuuuuuuuuucagggucucacucugucacccaggcuggagugcaguggcgugaucucuauucacugcugccuugaccuccugggcucaagcaauccucucaccucagccuccugaguagcugggacuacaggugcacaccacuaugccuggcuaauuguuuuauuuuuuaauagagacagagucucgccauguaccucaggcuggucucaaacuccugggcucaagcgauccucccgccuuggccucccaaaguguugggguaacaggcauugaaccuguaaucauucuaugcugauuuucuuuucuuucuuuuccuuuucuuucuuuccuuccuuccuuuuuuuuuuuuuuuuuuuuuggacagggucucgcucugucacccaggcuggaguacaguggcacaaucuuggcucacugcagccucugccuccuggguucaagcaauucucgugccuuagccuccaaaguagcugggaugacaggugugugccaccacacccggcuaauuuuguauuuucaguagagauggcguuuugccauguuggccaggcuggucuugaacuccuggccucaagugauccgccugcuuugggcucccaaagugcuuggauuacaggugugagccacugcacccagccuaugcguauuuucuuuuucuuuucuuuuauuuauuuauuucuuuuuuuuuuuuuuugagacagagucucacacuguugcccaggcuggagggcaguggcaugaucucagcucacugcaagcuccgccuccuggguucacgccauucuccugccucagccuuccaaguagcugggacuacaggcgcccaccaccacgccuggcuaauuuuuuguauuuuuaguagaggugggguuucacuguguuagccaggaugguuuugaucuccugaccucgugaucugcccuccugggccucccaaagugcugggauuacaggcgugagccaccacacccggcugccuaugccuauuuucuaauaccauccuccuuguugcucggauaaacaccaggacuggugaaaacccaaaugaaaccauuggcuuuauuaccucuuuugccucagcucacuugaguagacuuccugauuuuucacacccguaaaugggacugucuguauuuagcuaaaggaaaacgcaaaagauauaauuucauuaagaaacccuacucuggggugaagguaggggcaggaggagugaggaccguggaaucucugggugggauggacaacugaaaaagaccccuaagugaugcugcugugcccuccaggggaugccccauuuuucaaaauuaaucucucuugagucccaguuucuucaucauaaaaaagggcuuacuccuuuccaucuguccccacagauuaaaagaagacucucaugaguucuuugcaaacuacagaguguucuucagguacaaacagucauuauggugacagaaguuuuccaccacgagggucuaaagaagaggugaaagcccucuucuggucacuauguggagugagaaagagaucagagaggggugaggaagaccugcucccaguucucagggaaaauggagaaggucagggcaugcagcaacaagaugugagaaggauacacacuggacucugacucugacuucugguuguguuacguucuguggugccaaugagacaggaacagaaaggccuuuagagcaaacgccaccuacagcagagucccuucuacggauguucuuccaucuuuuggggcacccagcccaagagcggaaacuaagaugcaggcguuccugagcagcagaagggaagauggguagagaaaaggggcagccuuugagggagaggugaaaaagauuuccauugcucggcaguaagccuucauccaccugcugaccccacacgacucgcccaucucuccuuacaacgaacacccuggagaugcacuagcaaacccucucucuacacagaugggaccucaggggccaaggacaccaagagcuucuggaauauucaccaggagggggucccccgccuggcccgaggaaacaguuccacugcuccccacccccgcccaacccugccucgggaaagaaaggucauucccuccuccucugcuccacacagcuuuucaaagguuaaauucaaccagccugcuccaccacccccacacgcccacccccaaacaagagaggaaaaguuaauugaaaaugcuguuuaauuuuucagcuccaguggauccuaccccagcacagauggcucccccaggacugucugucccgagcccaucuccaccacuccaucgccucccgccccaagcaugggggcagaggcacagccagcaguggcucaaagggagaaaaagaagggggaguguggugaggggggggcaccuccacacaaaagagcauucugagcccuugguucccuggccagagaacaaugcuaccgacuugauccuuucauaaagagaguuucuggugucaggagacagccgcccagcgcccaagccgcccacaccggccacuucacugcucaccaccaacugcugugcuggcggggcuucauuccguaccccccucugcguccagcuggaaguaagugugguaucaacccccacgccacuccaagccugcccgcuacuuguugcccccuaaaggcucugacagggcccccgagaggccggccagcugagaugaaaggcugggacucuaacuggauuaccccgaccaaccccaggacugacgaggccaagaagcccuaauuaaagccauccccucuucccccuucaccccacccccaaucaccgcagcauuucuccuuucaucccagguucuccacuuuguucaaauuuccgcuauugaugaguuacuaggcucuggagagguggaguaaguggagagacacacaaauccucucagccuccuguagcuuaaagccacuggauaucaacuugcuuggacuuuguuguccccuccauuguagccaaggagaagcccuagaggaagaggaggaauggcaagagaaagggccaaagcagaagaagggguuuuggcuggagggagggaagagauccggccgcuagaagaaggcauuccucuaagguggguuacagccuguggucugcccugaugccugccccauggaggacagcaacacugguuuucugcuccaagauagcuauggggcuggaggaucucugccuccuucuucuccuugucauuguaccaccccagcugccccuccagucccaccugcuucucauacuuacccagaaauagucauuggccuuuggccugagggcaugauggguuauuugagacuccgugaucaacaaucuaugauugguucuggagucuguagucacucauuagcuacuuuugaucuccccaauaaucccauaaggcagggauuuuugcccucauuuuacagaugaaaccgaggcagaacguuuccaaggaacuucugugucuaugaauuuaccacaccgggcaagucaguggggaagcucagacaagaccacaggacuucuggcuccuacuccaguguucgugcuuuggccaagcucucugaacaucgaagaagcccagccagucagagcgcccguuuugggagaugcuggaccugcuuucugcuacagggaagagguuucacuuggcuugggccauccggccugcaggguauugcuggaggcugauagaugacccccaggggcaaacagaugaaggccaggaggauccacuucuggcaaaccaaaaggcugccccgaguggagaggcccucaccccaccccugcccucacuccacuccugugcagacaagggaaauauguguauggcacauggcggccagugccaguggccuuccugccuuggugugauggaccgaagagaagaggaagagucccacuggccacugaagaccaucgcucucucccacuaucaggaaggagcuggcagacucugcccccuucaccccuccacacccgccaccagcaacccugccacccucccaaguccuucugcauacccagcccucucugaccacugugaugcugggcacuggccaggauuccacauccuuuuaagaaauguaagggacaauaacuucugggcuagagugccugggcauugcuugggcaccggguccaugaaaagaaggcaucuuuuauguguuuaucuuuuuguuuugucuuguuugcugcccagagaagagguaaggaauaggagugcucuauuaaccuuauuuucaacaaaaggaaauaaggggguaugaugggcuaccuucuagaggugucaaggaugggggagaaugauucucccaaccagaguagggcggagacuggggcagggcauggggggaggggagcggagaggauuggagggaggucaagggagaaacgaagaaagaggaaaaaagaaaaacccagcagugcgccaugucgcauuguucaugcucagcccuucaauuugcucucugcauucuccugccguggggagaauguuacgcuggcuuaagggacaaaucagacacaaaauaaagaccaacacucagcagugaagcaauuaucgcaacauuuuaugccaggacuguuccuuuugaaggcagccuggugcuacccgcauguaccuuaacccguuccuaauaaccauaaaguuaccauuauuuacgguacaagacauuaaauaaauaaugcaaacucaggcaagcgagcaguccaugcagagcuaggcaagagggcuucccugcugcgggccagccgcagggguuaacgcgugauggaacggaugcugacugcaaccuguccagaggccugguggcuucacucugccuucucccucaggagcccacguagagccaaggaggcggagaggccagcuggccaggagaaaucagggaaggccugaccagagucuaaccaagagggaauccagccaggaccuacaaagcucguggacuuggccagaguccuguuuccuugggguugccugggagggagccaggaccuagaggaucucuccugauacagugugguaaagagcagcaaacacgugcucugaagucaggcagaucuggguucaaauccugacugccacuuagaagcugugugaugcugcacgagggacaaacucucccaacuccagcuuccuuacuuauaaaaugggggaaguaacauauaguguaugggguugcuguaacgauaaaugaggagcaucauggaaagcgaggggcacagugcuuggcuauuucaugucuaguucaugauaguuuuucuuccccucugaaaggaauucuuagccuuuacuuuuacaggucagaaccagugaugugguugcaucaaucugaaauggcccugaggauaccacauguuucuagcucaaggugaaagggaacauugggagagggaagagaggccagagacaaauuugaaaaaaaggauaggugccagcuucuuaagacagauauggucacgugcuuuuggcaagggaauuuuccaaaaagagauucucggucugugccaaaaaagauacugaugccaaugagacacaggugcugggaucuugucacugagguaucagaagcugcuuacaaaaucagauauggaagaggggacuuugcucucucccucacugcucuuuccaauucuaaccauccuuucauuauacccgcccacccagaagcuccagagagccaaaucgugucaugugcugucacaaacccggaucccuaagaggacucucaaagggaccugccauacuggaucagccccucgaacuucugccaggucccaugcucugaauaugagcacagggggccagucaaggcucagaagggucagggcccagacaucccagauaacgggguccuuaaaaguguccgugucccagccauucauauccacauccuugggcagauuagcccaagaacuaaccaaaagacuuaggugcugggcuggauuggcccccauuagcccccuggcuucuaccagagcaaguuauuuuugaagugcaucaggaagaucuaaccaaggguggcaacauugaucagcauaccuagaacuuuacggagcaucagaaugaucugagagccuguuaaaacacggauggcggccgggcacgguggcucaugccuguaaucccaguacuuugggaggcugaggcagguggaucacaaggucaggagaucgagaccauccuggcuaacacagugaaacccaucucuacuaaaaauaaaaacaauuagcugggcaugguggcacgcaccuguagucccagcuacucaggaggcugaaucaggagaaucgcuugaacccaagacguggagguuguagugagccgagacugugccacugcaccccagccuggccaacagcagacucugucuaaaaaaaaaacaaaaaacaacccacggauggcugggccccacacccagagcuuucaguucaguaggccuaggguggcgccugaggauuugcauuucuaaauucccaggugaugcugaugcuguugguccaagcuuugaaaacacuagccuaaaauucuuccuuggguuaacuuucucaaugccuucucuucaccucagaucuggccuugaaaggggaacagaauggccugggauagcuguuucucuccugugggaggugauguggcagagggcggaacagggggugucugagauuauauguggcugcaaaucagauggacaaguaaaccagcaaaauacuuuuaaugugguauuggaugagggcagugugggcauggaggucuucccagcacacuaauguaugcacacauggacauucuccucuuucuucccuuggccugcauuuggaguccaauccucuuuuugcuuggugggacacguuuucaccuccaaaaugcuuuccuugguaaacgcuucuuuuuuuuuuuuuuuuuuuuuugagacagcaucuggcucugucacccaggcuggagugcaguagcgcaaucucgguucacugcaaccucugccuuccagguucaagugauucuccugccucagccucccaaauagcugggauuacaggcaugugccaccauacccagcuaauuuuuguauuuucagcagagacgggguuucaccauguuggccagacuggucucgaacuucugaccucaaaugaucugcccaucuaggccuccaaaagugcugggauuauaggugugagccacugcgccuggcccuugguaaacacuucaaaugcacccaacauuaaaguaaaaaauaucaaugaaaucuuaaaaaaugcagccugggcaacacagcaagaccccaucucuccaaaaauaaaaauagaaaaaauuagucaggcaugacaacgugcuucuauagucccagcuacuggagaggcugaagcaggaggaucgcuugagcacaggaagucaaggcugcagugaguuacgaucucaucacugcacaccagccugggcgacugaguuagcacucugucucuaaaauaauaauuuaauaauaauaauaauaauaauucacacguuuuucuguaguauucgcuugucaaaugaaguuaaaugugauguauguuacaauguauuguguggcaugugugauauuaucucauuggauuagaauuauuuauucuccauuugcuuuucuguuuaagaauaagcuccuucagggcagggacagcucuuauuuccucugugucuccuagggccuggcacaaugucuaacacaaggaaugcugagcaaauuauuuagugcaugaauauuugcuccaggaagaugaggccuaauaccaugcagaugguuauuacaugucaaaauaagaauaaucccauuuuuauauucucuuucccucuuccucugaucuuucuccucucaaauauuuucaggcuggaauucagggauugguucuggaguuaucuuuaugguuguagaaccccuagagcugagaacacacaguggugccauuuagagaacugacugccccaguagacucccagaauacacugggacucccagaacacuggaucaugcggcagccuuagccaggagccucauaaaguguaugugugugugugagcguguauggugugugugugugugugugugugugagagagagagagagagagagagacaaaggaucauacugcagccaggagccuuacaaaguguguguguguguguguguguguguguguguguguguguguguguguuucaguggugugaagucagcuggggaaugccaggugcccacuccccaacuuggaauugcagaucucuagccugcugcguggcuguagcucccuuccuccuccuucuuuuucucccaacauugagaaagcaguaugcugccuauuucaaagaguauaauagcuccacauuuuuaugcuucuuuuuggagcaauuagagugcagaggagggucagcagaggguaagagcggagaaaacagcugauuccugagcacuaagaggucccaagccacccagccccccucuccugcaccaaccaagccugcacuugucacaaagucagcccugacaagugcucugccgccgccgcugugcuuggguggaguagaaacggaggggagagagggagggaacuucauucuuuccuggcuuaaaaagucaaaggcucuguaaggcaugcaaaaggaagaaagaaauuguccugcuuggccgcauugcuuuccuuucuugaccaguucugcccacacccaauaaccccaugcuucucugcccagccuuccuccaccugggcccgggaagggaaaugggacgccugcuccuccucugcucacccauccccagccuuucugccagccugggugucccacagcugaccggccugcaaacaggacucuaucugcagaauccacccccucccccucaacucuagcauuaaccuuucucuuucuuucaacaaaagccaaacucuuucaaagccaaccugauugaaauucaaaaacuuuccagggccucugcaccacucucuacuccuccccauacugacagccgcuggucacccccccacacccuucccacuccccacccccagcaauguagaaaauagcgggacaaagggcucuccccacccccucccccaagcacaagacucucccuuugugucacugugucacucgggcugguggaaagggagagcuggcucugggcucuccuauugucucccgauacccccacccccacccccacccccacagccuucugcagccuggaggccuugugcugggucccgcucaguuggccaaaucgaggggccucuauggggcccccaggcccacucucugacaggacagaagagccaagggcccgucuaugcccgaagggugcuucgccccuggcucccgagccccacguuguggacuccaggguggaccuggagccgcagaccaaagcuggcucccuuauuuuccuggacaccagauggagcuccucccucccuccucucucuuuagagacucccucccucagcagcagcggcaauuagaauggucuggcaggcucuggggagggggaugcccaggugguggccaggaggcuauuagagaauggagacaggcagccugggacaccuccuuguacagagcugcagccgcuggggaggaaaggucuaaacacgcuuccauuaauuaauuaauucaacaaguacucauugagcaccuaucauacacgcucauuggggaaacagcagugaacagaacaaaguucuccuugcagcgcuuacauuccagugggugagacagacaaucagcaaaucaauacauauuucagacacaaguccacccagaaaaagagagcaagacaaggagccagagagugccagguggggaguaugugagaugcggguggcagcggggguguguuagggaagucuccagauacaggcagaauuuagacauaggaaggagcgucugagaaaagagacuuccagcccaagggaacugcaagagcaaaggcucuaagcuguuaauuaaggaacuaaaaggcuaagguggagacccaagggcagcguguguagccugugagcccagagggcagggaggccagagaggguaggucucucaugccuguagagagguuuggaucuuacuuugaacgaauggcaagccagaggagucacagaauuugauuuauguauuaaaagggccggaacaaggguagaagcaggaaaaccuaaggacucuguugaaauugucuaggugagagauaguaguaguggcuugguccagggucaugugguagagauggagagaagcugucagauuugggaaccaacaggauuugcugauaggcaguaugaauggugugggagaccagaguccaggauaacuucaauguuuuggccugauccaacuggaagacuggaguggcuauugacgggcaggguagagauaaaggacauaaucauuugauccugugcaguuagaauaaggaguucaguuuuggacuuaacauuugagcugccuguuagacauccaauuggagauguccaguaagcaguggaguuggugaauuuguaguucaggggagaggucuaggcuagagauauaaauuugggagucaccauggagcugguaugaagcccuggagggaucaccugggaagguagugcggauaaaggagaagggaaaucugaggacuaagucaaggguacuccaaaguuuagcaucacugaaaggaggaggaaccagcaagaggaacaagcagugaggaagaaggagaaccaacagaggguguguccuagaagcggagugaggaaaguguuucuagaagacgggagugacagauugaguaugauaugcacugaggacuggcuguuggauuuggcaauagggaggucacuagugaccuggacaaaagccauuucacaggaaggauagggaaaaaucugacuagugaggguucaccugagaaugaaaggagagggggugaccuaaaggggaacagagaaauggagagguagcuacagggggaaauggaaggcuuuuaaaauagaugguaaauauuuuugcacguuugugugcaucagagcuuccagcagaaagggaagcucugauggugagauucagggagacaauuacuagaagauaaucuaagcuacauuaggaaagaaguuaggugagauggggugggggacaugaaaggcaggcagggucaauagggugcaguccuucccauuggaguuggaauugggucacuaccaggaguaaauuggcaguuggagagcaggauguuuaaguugguuauuaggaagggguauaauuacugguaaugacaagauuucgggaugaauaucagagucugugacugaggugggauagaggacaaguuuauugggggagagaaggucaaggaaccaaaugagcaggauauugaaaacgauuaucugaguguggcccuuggaacagcagcaccaucagcaccacuugggaacuucucagaaaugcgcauccuugggggucucuagaccuaccgaaucagaaacucugggcguggggcccagcgauccauguuuuaacaaguccuguugaaagacuugaugauaguaaguuugagaaucccugguauagaggguuuugauggguuguggcaguugaggggucagacauggggucagaugagggcagcaggucucaaccacggcugcacaacauuaggaucaccaggaaaaugaaaacucccaguugugagccugcgcuccagaaucaauuuccuuaugaucuggcagggagggggacuucaaggauaucaguauuuuugaaaguuuacuuagugguuccaauaugcaagcaagguugagcaccacuagauaaugggguauacagagcccuacaggaacgaaggcuuccugggagucagggagcuuguguagugacugaagcaaauggagagcuuggugacaucgguccugguacacucuugggcagaauuggguggugaggcugugugugcuggagcuugggguaggacgguauuaucaagagcauguggaccucuggaguuacaccacacaucugccaaugguucuuucuuuucuaggaacccagaaaaaaguguagauuggaaggaugaaucuauaaaugaaagaaauagggaccuucgccacucaccaaauauaucccauaguaaauguugcuuuccuucuggcacgccugggucuccggaagcaaccacugucagagcucggucggggccaggccauggcugauccauggcuccagccagcagccuacuuggccaggccaggcuuuuccccacugguuuuugcuuaacguggaagcacaagcagcuuuccaaguaucaagcaccuuugccuuuggcgccaguccagaucccucgggaguucagaugagaagaauuauaauuaccuuugcagaaagauuuauccuaacaauuaggaagcaacuuccagcagaaagaggggagacacgagaaaaggggugcuugcagcaguauaguaggugcucaauaagguggcuaguaaaugaaccagggaugaggggaauuguugaacuugggggaauggagagauuugcauguaccaaggaaagggauggggaugaucacauacucacgaggucugaccuuaacacaggaagaccuguuuggacagauugucucauacaauuagacaauauuaaggcuggaggcgaggauuaucacaugguggugaugggacaagaagggauugucacccacaggcggaugaaaggaacuggcacaaacugugggcugaucacacccugaugagaccugauguucccucaagacuugaggauauuaucccacacuggugguugagacuccuaggguuguuuuauacaggaaaaccuuggucucuaagcacagaaugaccagguauuaacaaugcaauacucugugugugugugugugugugugugugucagggaaggggagauuaucauauagauacgugccaagaaccaugaagacccuuaugaaaguaucuggacuguggguaggguaggcacaacuggaaaggaugagacaaacauaucaaauaugucugucaugauggcauuguuuuaacgggaccucuagagaugccuugggaauucuaggcuugaaggcccagaauuuauuggaaaggggacacuaguguaaccguugcuuagcaucuagggaaaauggcagaacuggccagagaagaaacugucccagggguccuauccccaucccuaggccagugucacagaggagacauuacaggccaggacucuucaccuuugaggcaaucaccaagccagcaggaggcaggcagcacaguuuuuccauccaacaggaguuuggaggaggaccacaagaagguggaggugccgcccgcagcucucacacugucugccccagcaguucccugcucucuggggugagcugcaaaauuauuccacauccccaagugagcuggcuugauuaaguuuuaauuuuagcaacuugcuaggaggacggggaggcuguuucagugcuggggggaggggaagagcuagagaagagcugugcucugggccaucagcccacaccacaugcaucugcuacacagcagcaccacccuggacuagaaaaccaugccacuguggagguggccaagggcaggggugaaaagugggaccugcugaagugacaagucacccuuuccuacgccggggcauguggcuuuuuccccuuggacucagcucugcagcaugggauugagagggagcagugguucauuaauuuaagucuuccccuuuuuuccuuagcauuaaucauuccucaggucuuuagccaaagcuguucagagcagggcuuugcauuucauucauucaugaauucauucauucucaugccugucuaucccucuuccagagauaucucauucacucccacagcuucaguuauaaauauuagugacucugacucucuaucaucagcccagaucccucugauuuccauccucacaaaacucucuguauccccagcuucacugggauuucccauaggcaccugaaauucaguuugucaaaagcugagcucauucuccccuucaaauugauuuguccuuccaccuuggaggauggucccccuguccaccccaucaccugggcuaucccucagcuacucuuuauucuccacuuugcagcuacacggcuccuucuaaaacccagaucugagcauguucugccccucuucaguagcuucccguagucuuuaggauucaguguaagcuucuuagcaaggcauauauauaaaagcccugcacgaacugacccuugucuaccucuccagcaucaucucuugccacugguucauucacucauucauucauccauccaguaagcauaugcugagugguuacuaaggugcuagacacuacucuaaaugcugggauacagcagggagcaaaacagaugucugucuucccagagcuguagcucucccgaucuauuuucuguuacccucuuaccucugggccaauauauacaaaguuuauucugcuagaaagcucuuugucaggccaggcgcuguggcuaaugucuguaaucccagcacuuugggaggccaaggugggcagaucacaaggucaggaguuugagaccagccuggucaacauggugaaaccccgucucuauuaaaaauacaaaaauuagcuggacaugguggcgcacaccuguaaucccuggcuaacuuuuauucauuuuuuaggucuccugcauucuccuaacuaaauuagguuacguucccuuacuaacuacaugcuuccaaagcaaucuguaccagccccauuucauuguaacuacuuuuuaaguugucuguauucccauuacacuaucuauucuuugaaagcagucuuagagaucaucuugcuguaaccuucgugccuagcacuacugaauuaauuaaguagauauuuaauuaucaacugcucugugccaagcacugugguagucuaaaaauauuuaucuugccagccaaaucuauucuuuuuuuuuuuuuguaucuuuuguuucugguuuuauuuguuuauuuguuuuuugagacagggucucacucuguuguccagguuggagugcaguggcaugaucauggcucauugcagccucaaccucccagccucaagugauccucccaccucagccuccggaguagcugggacuacaggugugugccaccacacccagcuaauuuuuaaauuuuugguagagaugaggucuugcgauguugcccaggguggucuugaacuccugggcucaagcaauccuccugccucagccucccaaagugcugggauuacaggcgugagccacugugcuuggccuguuucuguuaauggugcuauucauuacucccaggcacgcaucuuagaaauuucauugugaagugauucuucuuuuuaaaagacaaguuagagauuuguuuuuauuaaauucuaucuacuuuuuuugauagguaauaauacauugacaggauucaaaauucuaaagguaccaaaagaaagagcaaaagucuucuuuuuacccagauccuggagucugcuucccaagaaacaauuuuaucuguuucuuuugcagauauuuuuuucauaugcaaacaaauacauuuccacaaauggaggcauauuaaaucuaguguucuguaucuuuuuuuuuucuuuuuaacaauaugucuuggaggucacugcauauuaguaaucuaaacagcugucucauucauuuugguggcugccuggugcuccauguuaugccuguaccaugcaaaaaaauuaugauuuuuuuaaccugcucccuagagaggaacauuuagguugucucaaacuuuugcuguuucaaacaaugcugcaaaugcuauuucaugcaugucugagaauaucucuaguugaauuaauuucuuuuucucgcuuguacaucaaucauauuuuuagcaagucuaauagauugucuagccccguaaugucucuuaaguuuaucccuucaucccuucuccaccauccccaccauuacugcuccaguucaaguccucaugauucuuuuuuuuuuuuuuuuugacagaguuucugcucuuguugcccaggcuggagugcaauggugugauuuuggcucacugcaaccuccgccuccugaguucaagcgauucuccugccucagccucccaaguagcugggauugcaggcaccugccaccaugcccggcuaauuuuguauuuuuaguagagaugggguuucacgauauuggucaggcuggucucgaacuccugaccugaagucauccaccagccuuggccuccuaaaaugcugggauuacaggcaugaacuaccgugccugggccauuuuuuuccuuuuuuaauagauaccuuuauugacauauaauucauaugccauacagagacccauaugaagcauaaaauucaauaauuuuauuugaguuuuuacuuuuuuuugaggugggggaaucucccuauguugcccaggcuggucucaaacuccugggcucaaaugauccuccaaccuuagcuucccgaguagcuggaacuacaggugcaugccacugugcccagcuaaaauucaguaguuuuaguacagguugcauaucccuuauccgaaaugcuuaggaucacaaguguuuuuggaucugggauuuuagaauauuuauauauacauaaugagauaucuuggggauaggauccaagucuaaacacaaaauuuauuuauuuauuuauuuuauuuauuuauuuuuugagacggagucuugcucuugucacccaggcuagagugcaauggcacgaucuuggcucaccgcaaccuccaccucccagguucaagcgauucuccugccucaaccucccgaguagcugggauuacaggcacccgccaccaugccuggcuaauuuucguauuuuuaguagagacggaguuuuaccauguuggccaggcuggccucgaacuccugaccucgugauccacccgccucggccucccaaagugcugggauuacaggcguaagccacugcuccaggcccauuuauguuuuacauauaccuuacacacauagccugaagguaauuuuacacaacaauuuaaauaauuuugugcaugaaaguaaguuuucacuguguuuugauuaugaaccaucacaugaggucaauauggaguuuuccacuuguggcaucguguuggugcucaaaaauuuuggauagccaggcaagguagcaugcauuuguagucccagcuacucaggaagcugaggcaagaagaaugcuugagcccaggagugugaauccagccugagcaacauaaugagaccucauccauauauaaaaaaaaaaaaaaauucagauuuuggagcauuucagauuuuggauuuucacaguagguaugcucaaccuguacauuaaaacaguuggcuugccgucacuacaaauggcuuuuagagcauuuucaucaccccugaaauccauaccuuuaaacagucacccccaauccuccccucaccccagcccuaggcaacuacuaaucuacuuucugucucuauaaauuugccuguucugaauauuucauauaaacggaaucauauaauacauggccuuuuguaucugaugucuuauaauuagcaugauguauucaacguucuuccauguuauagcauguaacaguauuuuauuccuuuuauggcuaaaaauauuccauuguaugaacaaaucacauuuguguuuauccauucaucagcugauggcuauuuggguugcuuccaccuuuuggcuaucaugaauaauacuucuaugcauauuaguguacaaauuuuuguguggaccuaauuucaguucuuuuggguauauaccuaggaguggaauugcugggacaaauggcaacucuaucuucagcuuuuugaggaacugccagacuguuuuccaaagugguuacacuauuuuacacccccccgggagcauaugguucuuccaauuucuauacauuuuuuaccagcacuugcuauuaucugacuuuuugauuauauacauccuaaugggugcaaagcagacucucauuguggauuugauuugcauuucccugaugacuaaagauauugaauauuuuucguggguuugccaaguauucauacaucuucuuuagauaaauauucagauucuuugcccauuuuaaaauugagucauucuguuuauuauugacuuuacuucuuucuuuccaaucugaugacuguuauuuucuugccuaauugcccuagcuaaaaccuccaguacuauauugaauacaaaugguaagaguggauauccagccaggcacaguggcucacaccuguaauuccagcacuuugggaggccgaagcggguggaucacuugagaccaggaguucaagcccagccuggccaacauggcaagaccucaucuccacuaaaaauacaaaaauuagccgggcgugguggugugcaccuguggucccagcuacucgggaggcugaggcaugagaauugcuugaaccaaagagacagaguuugcagugagcugagaucaugccacugcacuccagccuggacgacagagugagaccuugucucaaaaguaaaaaaaaaaaaagaguggacauccuugucuuguuccugaucuuagggaggaagcauccagucuuucaccauuaagcauggaggaaggccccuucuauuccuaguuuguugaauguuuuuaucaugaaguggugcugaauuuugugaaaugguuuuuuugcaucuauugagaugaucauauagcuuuuguucucucuuguauuaauaugguauauuacauugauuuauuuuguaucuuacaccaacuuugcacuccuggaguuaaucccacguggucacaguauauaauuuuuuuuauacgucacuggcuuugguucacuagaauuuuguugcagauuuauauauacauauauauauauguucauaagaguuauuugucuaaaguuuuauuuuuuugugauauguuugccugguuuugguaucagaguaauaguggcuucaugaaauaauuugggaaagguucccucuuucuuguauucuuuggaagacuuggugaagaacugguauuaauuguucucuaaaauguuugguagaauuuaccagugaaguaaucuggacuuggacuuuucuuugugggaaauauuaaaauuagcaauucaauuuccuuaauuguuauaggucuaugcagauuuuucuucuucuugagucaguuucagcaguuugugcuuucuagaaauuuguucauuuuaucugauuuaucuaacuuuuuggcauauauuuguacauaauauucucuuauaaugcuuuuuuuauuucuguaagucugguagugaugucuccucuuccauuccugauuuaguaauuugaguccucucucuuguucuuauucauucuagcuaaugguuuuucaauuuauugaucuuuccaaagaaccaauuuuuggguguguugauguucuucuuugucuuucaauucuauauuucauuuauuuaugaucucaucuuuauuuccuuuuuucugcuugcuuuggguuuaguuugcucuuuuuuucaguuuuuaaauuggaagguuaaguuauuaauauaacaucuuucuucuuuuuaaaguauaggcauuuacagcuauaaauuucccucugagugcuguuuuagcuguaugucauaaguuuugguguuguguuuucauuuuuaucuauuuaaagguaccaauuucuauugugauuccuccuuugauaccuuauuauuucuuuuuuuuuuuuuggaaugaaguuucgcucuugcugcccaggcuggagcacaauggcccaaucucagcucacugcaaccucugcagugaaccucuggguucaagugauucuucugccucagccuccugaguagcugggauuacaggcgcucgccaccacgccuggcuaauuuuuuuuaucuuuacuagagacgggguuucaucauguugaccaggcuggucuugaacuucugaccucaggugauccaccugccucggccucccaaagugcugggauuaccaggcaugagccaccacgcccggcugauaccuuauuuauuaucuuuaacuauccuuaagaaacauauccaguauuucccuuucuaguugauuucauauuuugcuacucaacuggucuuacgaagaacgguuuaguuuaauaauauagaaauucaaagauagaauuauguguaaaacaaaaaagaacauagaaaaaaaaguaauuaguucuaacaaaguacauuuuacaauagggauaacgacugagcaggguuuguaaggacaaauaguaacacaccagcuaggcaaagagaugauagaccauuucccaggugguagaaacagcuugaguaaagacuuagagcugcgagacaaaaggggauauucaagacuacccuuuccccuauuucagccaaugggauucuggugaagcagauucugcccuugcauucaacugcggggucaugaaugugacccaggcauuacacaguugaaggaugacuucucccuggccucaaugauugguucaggaaugggcgugaaucaaagccaaaggaaugcaccaggacuuucccugagauuucgagaaaaagacuuuugcuuuuucgugcugaaaaaugugcaacaggcagcugaaaaucuaagucauccucaugugguuuuaaccagguagauggaugacagccaagggcaagugccuggcacauagugggaacucaauguguauucacuaaauacaugaaugcaugaacaauuguauaacagaaucucaaagaauacgaggagcucccagcugaaagccaucucccuuuccucugaacucccaagacagcuuaucgaauuguucuuacaguguuuaccaucuucugcuucauaguauguauaguuauacggaaauguguauuaucucuuaguaucaaaugcuugucugaugcuacuuauuuguagucuauauaagauuuuauaucacguggccccuuaccuaccucuucgguacaacuuuuuuugcuccagcaguguuuuagaacuugcuguacccugaacaugccauguucauguguuccuuuuccuccagaauacaagaacgcuucaacucaauuacuaaccaagugccuuuugcuugcaaagugagauccauuauugaaggaugauaucaaccuagagugguaaugagcacuuuuuaauuaaauacaauagaauagagccaggagugguggcucacacuugcaaucccagcaaucugggaggccaaggcuggcagaucacuugaggccaggaguuagagacuggccuggccaacauagcgaaaccccaucucuacuaaaaauaggaaaacuuagcugggugugguggcgugcgccuguggucccagcuacuugggaggcugaggcagaagaaucacuugaaccugggaggcagagguuagagugagcccgauagcaccacugcacuccagccugggugacagagugagacuccgucucaaaaaaaaaaaaaaaaaaaaagaaaaaagaaaaagaaaaaggcuaaguacuauuuuugugaaacuuuuguuucaguuguucauguguacugagucaugauguaaaacauauuucuuacuauagagcacagugcaggcuggguaugguggcccacgccugcaaucucagcacuucgggaagcugaggcaggaggaucauuugagcucaggagcucaagaccagccugggaaacacagcaauaccccaucucuaguaaaaauaaaaaauuaugacauggcgaaacccugucucuacugagaauauaaaaauuagcagggcauggccgggugugguggcucacgccuguaaucccagcacuuuggggggcugaggcggguggaucaccugagguaaggaguucgagaccagccuggccaacauggugaaacccuguccucuacuaaaaauuagucgggugugguggcgcacgccuauaaucccagcuacucgggaggcugaggcaggugaaucacuugaacccaggaggcgaagguugcagugagccgagaucgugccacugaacuccaacuugggcaacagagugagacucugucucaaaaaaaaaaaaaaaaucagcaaggcauaguggugcuugccuguaaucccagcuacucaggagacugaggcagaaggaucaccugagccuugggaggucgaggcugcagugggcugugaucaugccacugcacuccagccugggugaaagggcaagacucugucucaaaaaaaaaaaaaucgcagugccaaaaggcuaccacucuaagauacuccuauuacuaaagugagcaggucccuaguuuauuuauuuuuauauuuauuuauuuauuuuugauacagagucucacucugucacccaggcuggagugcaguggugcaaucucggcucacugcaaccuccaccucccagguucaagcaauucuccugccucagucuccugaguagcugggauuacaggugugugccaccaugcucagcuaauuuuuguauuauuauuauuguuauuauuauuauuauuauuauuauuauuauuauuauuuuaguagagaugggguuucaccauguuggccaggcuggucucaaacuccucaccucaagugauccauccuccucagccucccaaagugcugggauuacaggugggagccaccaugcucggcccacgucccuacuuuauaacucaaacaaacaaggaugcccaggggcuucucucccuuuaucuccauccuaaauuuugagacuuuacucucaaaacccaaauucugcaaaagggucacaaaucaggguauaguccuuacuucuguugcagcaaccaccauuuuauuuuauuuuuuauuuuuuaaaauuauuuauuuauuuauuuauuuauuuauuuuugagacagagucucgaucugucacccaggcuggagugcaauggcgcaaucucagcucacugcaaccucugccucccagguucaagugauucuccugcuucagccccucaaguagcugagacuacaggcaugcaccaccaugccuggcuaauuuuucuauuuuugguagaggcaggguuucaccauguuggccaggcuggucucgagcuccugaucucagaugaucugcccgccucagccucccaaagugcugggauuacaggugugagccaccgcaccuggaugacaauuuuuaaaccguccuucuaauucuaacacacaaccugggcuaaagcaguuugcugcuguuaauuguguuacuuauaauaauaguuaacauuuauugagcacuugcuguuugccaggcauuguucuaggcuuuuugcauggauuaucuuauuuauuccuuagaacaacccuagagguggauaauauuauugccaauuucauuugguagauugugaagauugacuccuggagacauuggcucaacuucccaaguccacacagcuaggagguggugguggagcuaagauuugaacccaggcagucaagcuucccagcccacucuuagccaugaagcuccauggcuucccaagugggcuuuaccguucaacagacacauggacgugucauggaacagcucuucuggaauggcccuagguagguauugcugaagacuauucuauacugugaugcuuauuuuuccuaaccaaccauuuugauaaaaaaccagccugauuuauuuggcccuggguccauagaucaauguuaaucugcauguugguuuaagcucucacuaguaaccuuggagagagagaaaagaagaagaaaaaugaggccaaaauucauuuuaaauuuuaaaguuauuuuuaaaaagaaagaugacgggggaagagaacauaugucugucucuugaaaggaaugagccucugucuauugcccgugauuuucucugacuuugaagcucuggccccugcuggagccucugagcucucucagccuaugugcuccuguuaaaggugaugaggacaaaauugggacaggucgcccaaaggccccccccuuucacuuuguucugggcgaaugcucuuucugaacauucucagcuuuagcuaagcaaggaaagggcagccccuauuucauaagaagaaaggaagacggucugggagacuguuccuuccccaaguauucagagaguugcugaauaauagggagaaaagagucagagaaaggacaaaaaaauaaaaaaguaaaaauaaauaaaaaauaaaaugacacagcauagcucuaagcccucuccuaucagguuuuacagaggggcaauagauuuucuucauugccaguccugacuuaucacagccuuguuuuuaaugagguauaauaaggggaacauuuuguaacaacacgguuccccuauuuuaucccgcaaacagcugugucaugcuuguggcuggaagaaugaaucauaucucugccugcauaugcuaacucccauguaauuaccccagcaucuuaaauaaagcaggcccuaaaccugucgcucacauuacaagcaaacggugcagaccucguaacuggggccucuauuauuacaauuaauuuaucacagaagcgacugagauuagaggcuagaauuaaaacccagagcauggagagucaccgcagugacacugaaaaacaggcucuugagagguggcuggcuccagcggcugccugacuaaugccuuuccuggggaaaaacggccuuaguuggauuuuguuuucuuuauauuuuucccacucgaagauuuuacuacagugauuucggugccucucuugauucaaaaugauguuggaaaaauucuaccugcuacuuaaccagaacccugagcaggagucacuguuuucucauucuuacacaaccacugucucuccauaggaacaaucccgggagaccucccauuuguuuuuguuauuagaaaggaauuucucaugacaucaguuuguuuccuuucagggcgcaggagauuggggggagggagagaauagucuagagcauuugccucaaauauaaaaugcuguuugcaucucuucaggcagggguuucucagccaggguuccucaacugagccacaaagacagaacaauuaccuaagcaacucuuuucuuuucuuuguuuuuugauggagucucgaucuguugcccaggcuagagugcaguggcacgaucucagcucacuguaaccuccgccucccggguucaagugauucucagccucccaaguagcugggacuacaggcacgugccaccaugcccagcuaauuuuuuguauuuuuacuagaaaugggguuucaucguguuagccaggauggccucgaucuccugaccuugugauccaccugccuuggccucccgaagugcugggauuacaggcgugagccaccgugcccggcugucagagcaacuauuuucuuaguucucccaaggauaguacaacuuguacaucuagacuguacaauccagaugcauaggagagaaauucauuaauuacagucaauggcuuagggcauucgugcuuaccaugguugaaaaagguugaagagagacaaucagauugacccaguuacagcaauaccgagggaccccaccugagaacccuccuccagaugugagucagcucccauucuguucaaaacaguucuuacucagccccuggugcccagccuccuuucguucauggaguggccucugccaguccucccaccuaaagccccaaguacgugcuaugucuccagacacggccacagggggauccuguggcuguugccuucguacucacuggugcucagcagucuacugucuuugucaguucuacccacugugcggcaguuugcuaugugcucacuucuuccucuucuuccugggcacacagcucgacugcauucccagccucccucgcaguuagauaggaauuccacucacuggaucguagguggaggugauguaagccauuuccccugggccaauaaaagucuccuacuugacccuucaugcucuuuuuuuucuucuaugccaguuacagcauccagcagggggauccugaacccuaggggacggcucaaccugaauuccaaaggcaccgcuaugugacugccuucuaaaaaggauuuguuggauguagucauuagccuacccuaauaaacccugaaaaugagaugccucgaccccaccucaggaggcucuacagcuugugaagaacaaggaaggaaggagaaccagcccaaggcugggaaacaguuauucccagauuuuggagacauuucacugcuugccuaggaaaagcaaggguaaggggcuuaggagggccaaggcuagcagugagcccagacuccuggaaagggggcucacagcuucagggguuucucacacaccagacaagcugcauucugauacguuuuggaaggcucaaggcagaaaaaauccuaagagggaaggcuaugaacaucugauuuaaacaaaauaaugaaauaugcaaaagcaaacuauaaaucauaaucucaaaucagaucaaguugcaccacugcuuauacucuuuggcccucucugaucugaccccuuaucuagccugccaccgcuauguucucauagcuccucagacauaucuucauugaacaccucuucagaguaaccugcuagcccacuagcucaggaguucuucaaggucuggagaagagccucauuuaccuccauaccccuuuagcuagcucugggccuggaaccugguacuagcucaguaucugcuaaaugaaugagcacaaagcacuguacauguuaguaugaugaguauauuuucugauaugggcauggcacuucucccuuuccugacuccauuguugagaugcuuucuaaaauagugcugugagccuggacauaguucuuccacacauuuucauuugguuucccuucugaucuagaacaguauuuaaaagcugggcuucugacauugagcaagguagaacaggucuaaccggcugcaaagggauggaacucauccuuuuaaaagguguguauuaauacuaugcuugggcugggcaugguaguucaugccugcaauccuggcgcuuugggaggcuaagucgggaggauggcuugaacccaggaguuugagaccagccugggcaacaaagcaagacccugucucuacaaaacauagaaaaaguagccaggcgcgauggugugcaccuguaauucuagcuauuccagaggcuaaggcaggaggacugccugaaucccggaguuugaggcugcaguaagccacgaucguuccacugcgcuccagccugggcuacagagcaauaucccaucuggacaaaaaaaaaaaaaaaaaaaaaaaaaggcugggugugguggcucacucuuacaaucccagcacuuuggaaggccgaggcagguagaucacuugaggucaggaguuugagaccauccuggccaacauagugaaacccugucucuauuaaaauacaaaaauuagccaggcauuguggcacaugccuguaaucccagcuacacaggaggcugaggcacgagaaucacuggaaucugagaggcagagguugcagugagcugagauugugccacggcacuccagacugggugacagagcaagacucugucuaaaaaaaaaaaaauuuacugaauuacccuagacuaugccaaggauaaaugugaagaauccuauuucagauccccuagaacucaaaugccucaugacaaccagagcauagcuccuuucuuccuacagaaagauuucuagcuccacugaagcuauucauugcucacugagagaaggaacacaaaaauucuuugaaaaauaugcaguaucuaaaaggugaacggacuggaguuaguaucagucuucucuccccacuuccuucaaaugucuucaccacagcaacugcccuccaccccuccugcuccccugagaagggagccccagggauccagacuagaccaggucuggucugcaggccguguauucuuaguuuugucucauuuuuugaacauuauuucucuauggaaaaaugaaucuguuuggaauagaaaucaaauauggguucauggucagauggaugggguuugaaucccaguucugcuacuuguaaguugagaaacuuuaggaaaauuaaccuuuuaagcuucuguuuucuugucuguaaaaugggaaugaaauaaaaccaaaaucaaggggcccaaguacugcaugcagaacuucuggugcaaugccugacacagagcaggcacccaggaaaagcgggugcucauuguuuuggcuucuuaucucugaauuaacuucaucugcuccuuguucucuccuguuacaacugagagaaugacccucuuacgacugaagucuaaucccucacaaguggucuggauuccaucccuucuugucuuuuaaacugcuucaucaucucuguuucuugacugucagucuuuuucuuugccuggaucacuuccaccagcacacacacacaugcacugcuaucuucucucaagaacaaaaaaguucucucucuugauuccacauccucuccacuugccaucauauuuuucugcucuucuuuuuuucccccuuuauuucuucuaaagaaaaacaaaccaaagaaaagggauacauguacagaacgugcagguuuguuccauagguguaugugugccauggugguuucugcuccuauugacccauccucuaaguaccccccgcucaaccuccagcucccaacaggcccugugugcguguuguucccuucucugggucuauguguucucauuguucaacucucaguuaugaguaagaacaugcgguguuugguuuucuguucuuguguuaguuugcugaggaugauggccaacccaggauggagugcagcagggcgaucacagcucacugcagccucgaauuccugagcucaagugauucccccugccucagccucccaaguagcugggacuacaggugcacgucaucaaacccagcuaauuuuuaaaauucuuuugcagagauggagucucacuauguuucccaaccuggucuugaacucccgggcucaugcaauccucccaccucagccucucaacgugcugggauuacaggcguaugccaccacgcucagucuucugcucuucuuuauccccagacaccuccaagguguugucuacaucugcugcauacauuuucucacccccuauuagcucuucaauucaugucaacuugaauuugcccugucauuccacuaaacuguucucaaagugaccuauugcccuccauauugccaaauccugaagacauguacaucucuguccuugaucucccaggagcauuugacguaacucaucauuuucuauuuuauuuuauuuuacuuuauuuuuugagacggagucucacucuguugcccaggcuggagugcaguguuacaaucucagcucacugcaaccucugccucccacguuccagcaauuuuucugcuuuagccucccaaguagcugggacugcaggcgugccccaccaugcccagcuaauuuuuguauuuuuaauagagacaggguuucaccauguuggccaggcuggucuugaacuccugaccucaagugaucccaaaguguugggauuacaggcgugagccacugcccccggcccauuuucucuuuuaaaacacuccuuuuuccuccuugguuuuaugaucucuauuguccauuccuucucagacuccuuucuucuuuuccucuaccacaucuuuaaauguuagaguuauccagggcuugggucugugcccuuuuauuuucucucuuuuacaccauucauuuucauuucaucuuuugcaaucacuuaauuaauuaauuaauuaauuuuugagacagagucacuuuauugcccaggcuggaguguaguggcacgaucagggcucaccacagccuuuacgucccaggcucaagcguuccuuccaccucagcccccugaguagcugggacuacaggcaugcaccaucacaccuggcugauuuuuuuuguauuauuaguagaaauggcauaucaccauguuggccaggcuggucucaaacuccuggacucaagugauccacuugccuuggccucccaaagugcugggaguagaugugagccacugugcccugccuuugcagucauuuuaaauagcaaggugcuguuauaacuagaacaacaaaacacaaagauaugugacauuggcuuugggacuaggcaagugggcagcaaggaagcugguauaaaagccgggaauaauagcaacuuguauuauuuagugguaaacuugugacuaaacuacaauaauuuggaaggcaggaaacguaucuuauaaacuagcaaaggugaaggaggggaucuuaaggcaaaacauugcaagcaugagcuggcugcuuuuagcuguauuugaugaagcacuaacaagaaagugauaaacucagaaaacuggcuaguuugcaagcaggauucagugggaauauagagaacccagaauuugugggguugaaaaauaaaacuuucucaucuccaaucucucuaguaagagauuuucaaauuaagauccauccuggggcuaaagaccuaauccagagugcggcaagaacgauacuguuuccaggugaagucaaaaucaagaguauuaagcucugaaggaaaucagauggcaucuaauaggcucuugcagcugaaaaugaagcuuguagaaaacuuaagagcaagguucuacagcagccugacauucccaguacuuaagucucgguagauucugucuuguaaaaauuguggguguggcuugugguacauagaguugaugaguauaaaacacauaaaaauccacaaaguuggccgagcgcgguggcucacaccuguaaucccagcacuuugggaggcugaggugggcggaucacgaggucaggagaucgagaccauccuggcuagcacggugaaacccugucucuacuaaaaauauaaaaaauuaguugggcacugguggcaggcgccuguagucccagcuacucgggaggcugaggcaggagaauggcgugaacccgggaggcggagguugcagugagccgagaaugcgccacugcaccccagccugggcgacugagugagacucugucuaaaaaaaaaaaaaaaaauccacaaaguuugugagagagcuguauuggugaaagacugccugcuccaacggaaagaaacagagacuauugaagauguaaaaagauuucuggggccccaaauuucuacaaguaggcaguaggcugaaaaaagcugcucacccacaaaaauuauuuaauaucuuuuucagaaguguccaugggugauguccaaggaugauagaaaaggaaggucuuccagaggagugcaccaacagccacggggaacaauggaugggagauccagaaucagagccuaaucagagagcauucucaaccccuaggaccgugggaccugucaacauuugcccaguagaauuucagaacugcuauggacuggcgauuucugauuucauuucucucucucucuuuuuuuuagagacagagucucgcucuguugcccaggcuggaguccaguggcaugaucucaccuugcugcaaccucugccucccagguucaagugauucucuugccucagccucccgaguagcugggacuacaggcaugugccaccacgcccagcuaauuuuuguauuuuuaguagagacgggcuuucaccauguuggccaggcuggucucgagcuccuagcuucaggugauccacccaccuuggccucccaaagugcuaggauuacaagcagaagccaccacgccuggcaguucuucccuuuuuuuuuugaauggaauaauuuauugcugcuauccuguauucuaccacuguauguugaaugggauuuuuuuaaguucuuaggucuucagaucaagagaaaccauauuuaggccugauauacagaugauaagauccuggaucuuaagccaaguaccaugauuugaguaaaaauugggggaggcugcauuugggaggcggaggcagggagaucacuugaggucaggaguuugagaccagacuggcuaacauggugaaaccccgucucuacuaaaaauauaaaaauuagccgggugugguggugcauaccuuguaaucccagcuacuugggaggcugagacaggagaaucgcuugaacccaggaggcagaggcugcagugagccgagauugugccauugcacuccagccugggugacagagcgagacccugucucaauaaauaaaugaaauaaaaacugggggagucuugggauugugggugaauguauuuugcaggugggagggaugugaauauucacaaagaaauguacuguuguagauuagauuauuguucaaaaacauuuacuccccaacuaccuccauggagaaguuuaccugcuucuugacuuuugacucaguuuugugauuguuuuggcuaauggcacauuagcagaugugacccaagcauguacuugugugcuugguccuccuggagagaagagcucuccccagguagcuacugucuauucagccuaagcugcagaaugaacaucuuuggauuagaccuacuacaaggagcagagguuccuggccaagcugagcuuagaucagaucaccuacagaugcaugagaaguaagugcuguuguaugcaaaggagauuuuuguggaugcuuuuuauguagcaauagcugauugguucucauucuucaaaugcaaacaagcauuuuucugccucaggaccauuaaaauaccuguuccuucuuuuugaaauguccuugcucauugcaggccuuaacuucaguucuuaauuuaaaugcauuucaucagagaccacucuugauagaucacccuauuauucuagauaguugugcgauuuauuucacagcauucauccgcauuuguaacaauaaauaauucuauguuuacuucuuuuccccacuggacuauaagccuuacaagggaagggaccauguucauuuauucaccaaugcauucccaaaguguaggauuaagacugguggauacuggacugcuaguaaauauuuacugaaugaaagaauuuuuuaagugagugaaugaacuucauaugcauauguuaggaaacacuuugcauacucuuugagcagcuuuagaaaauguaauucaauuucuuuccauuccucuuauuuuuaauaagaaugauuuuguucccuuccuaaugagcugugcuucccaaggaauuagguugcuugcuugguagcuuaaccaaccaauuuggccaaaacacauaacugaugggcucuuugcuuacacuuucccugcuugcuucuggaccagcauuaggacucugggucaaagaugcagcucaggccaucugcuguuucugcuaaggccagagcaaacuuuuucauaaaguuugauuagucuauccacccugaaaacacaagcacgcucacaaaaaucccauacagacacacagagcuugccucaaggcugugacagaaaccugaagcccaaggcuaucucuagccugaugguugcaagcccacaacccagugacucuaacaucugccuucccuaggcucucucaagcuuccucccuguaguauuugcugccccaacuacaaggucucaauaacagucuuugcaauauuucuagggccacagaccacacacugugagagaaagagggccugggaagccuggagaucuucuccuaaggacaggguagaaacagcagucagggcauggaucccgguacaacuacccagcuaagcucauuguuucuggagguuuggcuuucuggcuuuucuaacucuaaauuucuucaagucaagaucuuugacuuuaaucuccguacuuuucuauuuucuuuuccuucuucaaggcauuaaacuuuuauuaaacauuauauaugaguuacgugaaaguuaugaagcccaauaaaaugaacauuugugaaccaccaucccacuuaagaaauagaccaugacuacucacaguuggcaucucuuaugugcuccuucuggaccccaagucccuacuuccccaucccacccacagaacuagcaucucagauuuuucucccccucaggucccuauuuucuuuauagcuuaccaaauauauauauauguucuuaagcaauauauugcuuaguuuugcuuguuuuggaacuuuauaagcauguauaucauacuguauauauucuucugcaacugauuuucuuuuuucuuuuucuuucuuuuuuuuuuugagauggagucuugcucuauuacuaggcuggcgaucuuagcucacugcaaccucugccucccagguucaacugauucuccuaccucagccuccugaguagcugggacuacaggugugcgccaacacacccagccaauuuuuguauuuuuaauagagacaggguuucaccauguuggcgaggauggucuugaucucuugaccucaugauccaccuaccucggccucccaaagugcugggauuacaggugugagccacugcgcccagccucuguagagauuaauacacucaauaauggcacccaauagaugauaaauccuauuacagagaaacucucuuauucaaugcauuggaugauuaaucugaaaaguccuguauaucauuaaacagagauauauacuuaccuugaacuuuuuuuuuuuuuuuuuuuuugagaccgagucucacacuguugccaggcuggagugcaguggcucgaucucggcucacugcaaccucugccucccagguucaagugauucuccugccucagccuccugaguagcugggauuacaggcaugcgccaccaugccggcuaauuuuuguauuuuuaguagagacggaguuucaccauguuggccaggcuggucuugaacuccugacuuuaagugauccgcccgccucggccucccaaagugcugggauuacaggcaugagccaccgcgcccagccugaacauuuuauuuuaacuuaaaaaauauaaauauagauucauucuccaaguuuuugauguagggccaaagguaugugucugcugacuggcuuuucagaucuuuccugcauaaaucacacccaaaacacauugucuacaauuuuaguuuuuaguggaacaagaacuuaaagcaauuagagugcaaauuccuagacuguugugauuuuuuuuuccucagucuuacccacauaucuuucaacagcaauuauuuuagggauucgccauaauuuucaacuuggcuuucauagaaaaaaaaaauucuccaauuguauaucacugcguuuacaaaauacaguugucccuucguauccauggcggauuaguuccaggagacccuccagacaccaaaacacuuggaugcucaauucccuuauauaagguggcauaguauuuucauaugaccuucacauauccuuuuguauauuuuaaauaaucucuagauacuuacaacaccuaacauaaugcaaaugcuauguaaauaguucuuauauuuauauuuauauuuauuuuuguauuguuguuuuuguuuuuauuuuuucggagacagggucucgccuugucacccaggcuggagugcgauggugugaucauagcucacugcagccuggaacuccugggcuuaagugacauuccugccucagcuucccaaguagcugggacuacaggugcaugccaccacacacagcuaauuuuuaaauuuucugaagagacagggucuugcugugcagcccaugcuggucuugaauuccuggucuuaagcgauucucccuccuuggccucccaaaguguugggauuacaggugugagccauaccacucccagccuauuauuauuauuauuauuauuauuauuauuauuauuauuauuauuuuuggagacagagucucgcucugucacccaggcuggaaugcaauggcgugaucucggcuuacugcaaccuccgccugccggguucaagcgauucuccugccucagccucccaaguagcugggauuacaggcacacaccacuaggcccagcuaauuuuuguauuuuuaguagagacgggguuucaccauguuggccaggcuggucuugaacuccugaccucagguaauccaccugccucagcuucccaaagugcugggauuauaggcgugagcuaccacacccggucuauuauuauuauuuuuuuauuuuuuuucuugaauauuuuugauccgugguugguagaaucuguggaugcggaaucugugaauacagaaggccgacuguacuuaaugaaauuagguaauugcaauaauaacuagcacugguauaaagaggcuuagaaacaaguacagcugaguuaugguaagcacacaagauaacgcaugggaauggcaguaaguggccauacuguauacuagcaaaaccaucagccaauaguaugucgugggcaucaguuagaauguuuuauacaggauauacagagugucgguuaaccaggcauguaaguuagguggaaguuggaugagauagcuacgauauuauuauucucuuuguuucuaccauugaccuaguuacagagcccaauuaucuucucagcugaccccucugaaggaaauuaucuucaaucaggcuugguucacuguugagguuugccccuggccagaaaggaacagaggaacacauagacuccccaagaaaugaagccuaguaaguuggaagagauuuuaaacuauuuaguuuucaaagaguuacuccugauuucugagacccgccccgccccccgcccccgccaucccugaugagcugagauggggagaaaaguuccaccuuucuacacuguccugugauggggcaccgcauuguggagaggaagaaggucugacuuuaauuagucagaccaucacccuacuaaacuccacugaaaccaaaacaaaccaggcagucccauaugucauaagaauuaaaggcaugguucccacuuccuaacgaugcuuuuacagaaaccguuccacuguaaaacuuuaugauuugaaucuuuauagccgccagcagagcacauguucacugccuuaaauuauaacuuaaucacaauagaagcugacuuuccagcccuuugcagucaagacgggagaaggaaggggccuccagaacaaacggcugcuauuccucugcccaccugccuccuccugcccugccuaguguagucccaggaaagcagaggacguggggaaacacacaccucacagcccaggaaaaccucaaagccagaaccuuccaguauggucuagagacaugaauaucauccuguccggaacguaugugaccuaguuagggcaaagugagugcugccgagaagcaaaaggcaagaaggaucagagggagaaaggcaagguggcagggagccacaggcacgcgcacccaucccgucacccugcuggcccagcucacugcauuccuuaacuuugguugacauccucuauuguugcagacuaguuugacaaaaaaaggaaacaaaagcaaaauauccccaccucuccucaguucaacacagcuaaaacagaaagugugagaaggagagugacagaagcuguuggaccggaaggcugaggccagauccugaagggccuuguguggcacacucagaaauguuuauuuuauccuguaggcaauugggaaccauucaaaauguucaguacugaagcaaccugaugagauugccuuucaaaaagacucuacauucaaagaagauacacaaacggccccaaaaugaaaagaugcucaguaucauuagucacuagggaaaugcaaaucaaaaccacaaugagauauugcuuuacacccacuaggauggcuauuuuuuaaaaucccaaacaaaacauaacaaaaaaacaaaccagaaaauaaguggcacccaggaaaacuggaacccucaugcaaggcugaugcaggaaugguguaaauggugcaguggcuaucgaaaagaguuuggcaguuccucaaaauguuaaacauacaguuaucacgugacccagcaauuccacuccuagauauauacccaagagaacugaaaacauauguccacacaaaaacuuguacagcaaugugcacagcaacauuauuauaauagccaaaagguggaaacaagauccauuccaucaacugaugaauggcuaaaccaaauaugguacauccauacaauggaauacuauuaaaccauaaaaaggaaugaaguauugaaacaugcuacaauaguaguaaaacuugacaacauuauauuaagagaaacaagcuagacacaaaaggccacagguuuuaugauuuuauuuaugugcaaugucuagaauagguaaauccacagagaugguaagcagauuagugguugccaggagauggagaagagggggaauugagaaguacagggcuucuuguuuuuguuuuuuguucuuuuuuuuuugagauggaguuucguucuuguugcccaagcuggagugcaauggugcgaucucggcucaccgcagccucugccucccgggcucaagugauccuccugccucaggcuccaagaagcugggauuacaggcaugugccaccacgcccagccaauuuuuuguauuuuuaguagaaacaggguuucaucauguuagccaggcuggucucgaauuccugaccucaggugauccgcccaccucagccucccaaagugcuaggauuacaggcaugagccacugugccuggccaguaugagucuucuuuauagcgugaugaaaauguuccagaguuagaggguggugauaguugaaugacauugugauuauacuaaaaaccacugacuuguacacuuuauuuuauuuugagauggagucucgcucugucacccaggcugggagugcaguggcacgaucuuggcucacuacaaccucugccucccagguucaagcgauucucccgccucagccuccugaguagcugggauuauaggcacccaacaccucgcccagcuaauuuuuguauuuuuaguagagacgggguuucgccauguuggccaggcuggucucgaacuccugaccucaggugauccaccagccucggacucccaaagugcuaggauuacaggcaugaaccacugcacucagccaaugacuuguacacuucaaaaugauuaaaauggugaauuuuaucuuuuuuuuugagauagggucucacucugucacacaggauggagugcagcagcgggucacugcucacugcagccucgaaugccugagcucaagugaucccccugccucagccuuaguggagguggaggucaaugcugaaguccaguggguugggaaugaaugggagauaaagaagcggagaaggucaccuucucaaguauucauugaaugucuccuauuugucaggccacgauagagaggaaauccuuccagcaagcuuuugaaauaauaggaagggaagaaauaggaaaguaaaugaggaggaugcaggaagaggacgggagggaaaugagagagccaaaaggacagaaggguccagcuagagagcaagaaguuuaagguugaugaguucuuagugaugagguucacaguguggacaugggacuggacagugaaguggaguggugguaaaggucuauagaaauuaacaggccaagaaacuacaaaugugagggaucagaucauuccauccaacaaaugaggaggaguggagacugucagagaacagacaaugacagaagcgagaagacaguagaauaguggaacagcaagggucucgaagaagggggaauuguguguauccauuuuauuuuucuuuuuuacacauaaauaaaccuguauauuccacuacuagcuacuuaguagacacuccauaaauaaauguugccaacugacugauguguacucucaaaagcaucucaaagcuggcauguucuaaacugaacugugauucccuuccaaacuuaguucucuuccauuguuaucugucucaucuauuccacugcacaugccaaaaucuuaggaagcauuauugacauauuuccuuccucuuugucacucuugagauggaauccaucaucaagucuuaacaauuuuacuuccuaacaucucucacuuauguccacauugcucuacuucuaccaugguggucuaagcacccaucaucuccugucuacuuuaucugccuccuuacucaccucugcacaucugcucuuguuucccugcaaugcauucucuacucugcagccagagacauaguuucaaaugugacucugaucaggauguguguccuuuacgccuucaucccauucaaacccuuuaagggauucccauuguucuuaagaguaagaacuccuuaaugucagacuccucugcagccucaccucguacuauacuuucauacuauuuucagucuuuuucaaccuagugcuugucacuaucccuccugguagggccuuugcaccugcgauugccucugccuacuguuuuuccucucuguugccuaaacgccuauucauccuaaucaguucaacuuugcaaaaauuuuugucuggguaauaucauacucaggcucucauagcacugcauaauucuucuucacagugccugcuacaguugcaauguuacauuugacuaaugccuguuuccaugaggacagggacugugccucacacauagaaggaacucaguaaauauuuagugaaugaaugaaugaaugaauaauauaccaauaaacuugcucagugguguuaaguggcagaucugggacugugucccaagaggaaauguauuaggggggagguuugaaaaaugaacuccaagaucccuuccauuucugagauuugugcuuucuaggugaacuucuauuauuuuccuucccuuccuuuucuuaggcugguuugccuggccuuaucuauacaccuccacuggguaccauaaagaauuaaagacccuacggauuggaaggaauuaguuccuucagauguuggaaaccuuuccuuuaucagaugauucaaagagacuccuuaacaacaaccuuaauaauugguuauuuauucucuacuuaaacacaucuaauaauagaguucaauucuucuccaaaggauucccuguggguuuucuuuccuuuaauaauauauaaauuaggcaucuuuuucauaugauuauuggccauuuauauuucuuucuaaaaugaguucucauauccuuuacccucuucuguuaauuuuuuagacugauuuauaaacucucuguagauuaaagaaauuagcccuuugucauauuauguuguaauauguuuuccaguuuguuguugaucuucugauauuguuuuuggcaucuaaacaauucuauucuuuuuuuuuugagacagagucucgcucuguugcccaggcuggagugcaguggugugaucuuggcucacugcaaccuccgccucccaggcucaagcaauucucgugccucagccucucaaguagcugggaucacaggugugcaucaccaugcccggcuaauuuuuuuguauuuuuuuguagagaccgaguuucaccaugauggccaggcuggucucaaacuccugacuucaagcaauccaccugccucagccucccacagugcugaaauuauaggcaugagccacugcgccuggccuaaagaauucuauucuacauggaacaaaauuuaaaagauacaaaagauuauauaaugaaaaauaaaucuuccuucacucuuguuuuccagcucaauuccccuccccaaacgcaaguacuauuaaaguuucuuguauaucuucccagggcuugccuaagcaauaacuuauauauauagcuguuuaucuuccuacaacacacacaaaaggcaauaaugcacuccgcuuccacgucuugcauuuucacuuacgacacaagauauaucagagaccuuuccauaucaguacaggaagagcugauagauauugccaaauugcccuccauagagguugaaccaauuuacacucucauuagcaauauaugcgaaugucucuuuccacaccuuucaccgguacaggcauaccuuguuuuauugcacuuuguagacauuacauuuuuuacaaauugaagguuuguggcaacccuguguugagcaaaucuaucagugccauuuuuuuaacagcacgugcucacuuugugucugcgucacauuuugguaauucuugaucuuugauguuaccauuguaauugaucuggcgugccaugaaccacacucauauaagauggcacacuuaauaaacguuguguguguucugacugcuccaccgaccagcuauuuccccaucucuuuccuugggccuccguauucucugagacacaacgauauugaaauuaggccaauuaauaacccuacaaggaccucucaauguucaagugaaagaaagagccacacaucucucacuuuaaaucaaaagcuggaaaugacuacgcucaguaaagacggcaugucaaaagccaagacaggcugagagccaggccucuagugcugaacaguuagccaagcugugaaugcaaaggaaaaguucuuaaaagaaauaaaaaaaugcuaugcuagugaacacaugaaugauaagaaaugaaacagucuuauugcugacagaaaguuuuaguggucuggauagaagaucaaaccagccacaacauucccugaagccaaagccuaauccagaccaaggccuuaacucucuucaguucuaugaaggccgagagaugugaggaagcugcagaagaaaagucugaagcagccaggugcgguggcucacgccuguaaucccagcacuuugggaggccaaggugggcggaucaccugaggcugggaguucgagaccagccugaccaacauggagaaacccugccucuacuaaaaauacaaaauuagcugggcgugguggcgcaugccuguaaucccagcuacucgggaggcugaggcaggagaaucgcuugaaccugggagguggagguugcagugagcugagauugugccauugcacuccagcuugggcaacaagagcgaaauuccaucucaaaagaaaagaggaaaaaaaaaaguuugaagcuagcagaaguugccucaugacguuuaaggaaagaagacaucucuguaacagaaaauuacaagguggaguagcaagugcugauggagaagcugcaaguuaaccagaagaucuagcuaagauaauugaagaagguggcugcacuaaacaauguguuuucaauguagaugaaacugccuuauauuggaagaugccauucagagcuuucaaagcuagagaggagaagccaaugccucaaagcuuuaaaggacagauugaccauguuaggugcauaaugcacuuggugacuuaaaguuuaagccagugcucauuugccauuccaaauauccuagggcccuuaaaaauuaugcuaaaucuauucugccuaugcucuauaaauggaacaacaaagccaugaugacagcacaucuguuuauagcaugguuuacguaauauuuuaagcccacuguugagaucuacugcuaagagaaaaagauuccuaucaaaauauuucucuuauugacaaugcaccuggucacccaugugcucugauggagauguacaagaauaugaauguuguuuucaugcccgcuaacacaacauccauucuacagcccauggaucagggaguaauuucaacuuucaagucuuauuacuuaacaaauacauuuuguaaggcuauaucugcuauaaauagugauuccuccgauggaucugggcaaaguaaauugaaaaucuucuggaaaggauucaucauuuuagauuccauuaagaacagucaugauucaugggagggggccaaaguaucaauauuaacaagaauuuggaagaaguuaauuccaacccucauggaugacuuugaggguuucaagaccuuaguggagaaaguaacugcgaauguggucaaaauagcgagaauuacaauaaguggagccugaagacguaguugaauugcugcaaucucauaagaaaaccugaauggaugaggaguugcuucuuauggaugagcaaacaaagugguuucuuaaaauggaauccacuuccuggugaagauguugugaacauugcugaaaugacaacaaagaauuuagaaucuuacauaaacuuaguugauaaaguaguggcagagauugagaggacugacuacaauuuugaaagaaguucuacugugaguaaaaugcuaucaaauagcaucacaugcuacagggaaaucuuucauaaaaagucaauguggcaaacuucauuguugucucauuuuaagaaauugccacagcuacgccaaccuuaagcaaccaccgugaucagucagcagccaucaacauuaaggcaaaacucuccacuagcaaaaauaugauuugcugaaggcucagaugaucauuagcauuuuuaagcaaugaaauauuuuuaaguuaagguguguacauuguuuuuuagacauaaugcuauugcacauuuaauagacuacaauauagcauaaauguaacuuuuauaugcaccagaaaaccaaaaguucaugugacucgcuuugaugugauauuugccuuacugugguggccuggaacugaaucuucaacaucucuaagguauacuugugcacuauuaaaaccuuuuugaucucugccaaucugauagguaaaaaauggcauauugcagccaggugugguggugcaugccuguaaucucagcuacucaggaagcugaggcaggaggaucaccugaacccgggaguuugaggccagccucugaaacauagcgaggguccaccuaaaaaaaaaaaaaaauggcacauggauuuaucuaagaguaaaguugaucauuuuuuuauauauuuaauauaauauauuuaauauauuuauggccauuaaaauuuuuuuauggcuucuagaccuuuccauuugagaggaauuaggauugggaaggauuauugugacuaugggaggaagaaucuuuaguuaaucuagauucaguaaccugcuuuuccacuggugucgcagugggaggguuugagcuguguccuuauuuuuaucagcaacacagcugugacuaaagauauauuaugauaguguagaaacaguauggguuuucaggucacgcagacuugaacugaaaccccaucuccuuucuuugauucuuucuuuucacauuaauuuauugaaguuuuacuaugugucagacccuguguaaggugcuggagauucaaagguaaauaaaacacauuucuugccauccagacacucucaguauaaugaaggagccaggcacauaaaccaguaaguauaaugcaaaauagguaacaauaaugaugauguggaugcugaugagauacggauaauagcuggcagcucuaugaaugaugaaucaggaaaggaugagaccagagacaaggagagcaguuaguaggcuauagcggcaaucuaggcaagcaauguagugagaaugaagaagagaaaucagauucuagauggaaugaggcagucaguaagagaaugauuuugguaagaguggggagugaggauaggcuuucguggguugaggacugaaugagagaugaggaaaguugcuguuucuuugauauaauagcuauuguggcauauuagcucaucaaauauccauucccuucauuccucugccucccaucuucucugccacacagaugugcuuuacucauaugacuugcuuagucuucaaagcaggaugaagugacauuccuacccucugacuuugggcuuggccaucgacuuccuuuaaccaguggaauguuagcggauauaaugcaaguagagauuuuagauaugcacaaaaaaagaaaaagaaaaagaugcacaugcaaaguuugccuuggucucuugggcuucugccucucaccaugagaagaacaugccucuggcagcugcugguucaaggacaauaaaggacacauggaacagaccuggaccuaauccacagcuuagagucaggcccaucugaccucagccuagacucgcugaaucucaggugaucuauacaacuguacacucaagaaauauacauccaucaucuaugacacugaauucugaguaaguuuguuauacaauguuguuguggcaagagcugcugacauaggacucuaaaagugguaucuuuucucuaggcuaaauaucccuauuuucugcaacuguucauaguaugcccccuccuuucuuauuucugucagauuucucugcaagauaugccaacugaaccaauuaggaggcaccccuccaaagaaucaccagauuagaauucugcacacaugugaccuucuuccucuccucuucaacugucuccauucuagagguuacccuguggaaaaggaaagacucugucccuggagccugggcucagggugagucuagaaugaggaggcucaggaagauuaaagcucaaacuccaugagugaauuagaagggaguggcucucagcuccugguuaauucuggaaacucaaguuagucuaaaaacaaagaaagaggucaggagacaucuaaaaugucuacauggaagccaauuauacaccaauugucuauaguuuggacucgagaugauauugcuuuacagcccaaaccaccuaaagccaggcagauaaggaggauauggggcagauucacauucuguggcauccgaagcuuagcauaugacuuugaggacucucuuaaaaaaaaaaagaaacaaaauuacaaauauaaaauuagguucaaaagugaguauuuauuagaacgacaaaucauuucacaacaauuacaaaauuuuaaagguugaggaaaaugagaaacaucauaaaaauauuccaaugacauaauuuuaaauuaauugauacacuucuaagugcuuauuuccuguauuuucuuucuuucuuuuuuuuuuuuuugagacagaguuuugcucuuguugcccaggcuggagagcaauggugcgaucucagcuaacugcagcuucugccucccggguugaaacgauucuucugccucagccucccaagagcugggauuacaggcaugugccaccacaccuggcuaauuuuguauuuuuaguagagacgggguuucuccauguuggucaggcuggucucaaacucccgaccucaggugaucugcccgccucagucucccaaagugcugggauuacaggcgugagccacugcgcccggccuuucuuguauuuucuuuuuuuguuuuuugagauggagucuugcucuguggcccaggguggaguguaguggcacaaucucagcucauugcaagcuccgccuccuggguucaugccauucuccugccucagccuccugaguagcugggacuacaggcgccugccaccucaccuggcuaauuuuuguauuuuuaguagagacagggucucaccauguuagccaggauggucucgaucuccugaccuugugaucugcccaccucggccucucaaagugcugggauuacaggcgugagccaccgugcccggccuuucuuguauuuucuaagcuguggacucugacucuucaugugaacaauuuugaagcaucuauacuucauuuuucuauaaagaaaauagaaaauccugucuuuuuucuaccauuguugaccaaaauuuguuuauaacugauagcuuagagaauuucuuuccacuucaaaaccccuuacuaguacuguuauauaaaugucaaggauuaaugugaaauuuggggaaaccucuaucaaguuucuuucauauaggaguuguaagauuucauggccuuucaaauuuuccuuaauauucucagacuuuauugauacucuuuuacagcuuauuauugguguccugguuauagcgacauauuaugaguuuuauguuaccuuuggucaauauuuuggagauguguauauacuucacauaagaaugcacucauuguuaguaguauugcuacagacuuauacacuauaaacacaggaauuuuaauaaauuccauuucaugugauucccauuaaaaaauauauauauguccaggcgugguggcucacaccuguaaucccagcacuuugggaggccgaggcgggcggaucacuugagcaggaguuugagaugagccuggccaacauggugauaccacaucucuacuaaaaauacaagaaaaaaaaauuagccgggcauaguggugugccccuguaaucccagcuacuugggaggcugaagcaggagaaucgcuugaaucugggagauggaggucacagugagccaagauggcaccacugcacuccagccugggcaacagagcaagacucuggcucaaaaaaaaaaaaaaaaaaaaacaaagaaaaaagaaaagaaaaaaauaugauacauuuacaauuguauacacugcauuaagauguauuccugacagaugcgagguuucauuuugaccagccauuaacaagaacuaaaauuuucacuuacaauuuuacauaugugaggacuaguuucuggauccauacauuuuaagcuuuguuucucuuccauugcagagcaucauaggacacauucauguccccugacaagcucucaucaugcaccuucauggccugacccaguuaauuagcauaguaggcaguagcaguacuccugagagccauuuauauaccaggacaggcaggaguaaguuaacucuacacagaagagaccgcaaaccacauaaacagaugcaucaacuaaauacaaaauauacucaaauaaacuaaauauaaaauauacucccaacucugcuuuuccugaaacagaucaccaaaacauccacagccacuccaacgccgcuccaggaggggaaauaugaacucagacggaaaacaagagucuuaauuuugauuaaaguauuuuauuuuugcaacaugaaaaaauguaaccauguaaaaauaucacuaaggccucuuccagggucuuuaaaggaguucaugcaaguaagggaccuguaaguuuaaauucauuaacugcauagaaaauccacuucuagaaggauaaaaauccugguuuuaccuuuuucuugguguaggcaccaucaauagacagcauuaccuguugcuggguauuuuugcauuaaauaugcaauauuuauugaguacugacuaggcaccagacucuagggauacaauagugcugaaaugaauaccgucccugcccccgggagcuuaagcuuuagcuaagagagagacaucaaucaaagaguuauuuagaugaaugucccaggaagguuccuucuauggggcaggucuguuacacccaaaccaaacuaauuauugagaugugcugacagggaagggggaaggccaggaaugcaaggagucccucagcagcggcagaccccucagaaggucuccucugaccuugugguucuccuaggguucagaaucuggccaccguguuccacacgugucccagucugcucugcagcuauauucaaucuauuccucuggcacuucaggcuuagaauugcuagcaugugaggcuguaccagcacggccucuuuagcuggggaacccaggacccaaagucuagcagaggaaacacugggcgcuugucuggggaagcuaaaagaggauccugaaguaagaagugguuagugcagcugaccuccucuccccuaacuaaaaacagggaaguuuugugagaacccucaaugaacccucaaugaucgaagaacucuccgaucucccauuuuacccuguuuuuuccuacccuucgcagaaucagccuacugacauauuuuuuaucuuauuuuuucagccaaacaucuugaaauaguuaccuacacccauuuccuccacuucucacuuccaauuuccuacugcuccacagcagucuagcuucugccagugaaacugcagguaccagguguuagaggaugucacugcccuaccaguauccccugcccuuacuacuucagugaaccccaggcuuccaggcgcugguaccugcauucauucaccugagggauuucucucacagccggggucuguucugcugcccaagcagcaggcuggaaaugucagugaauuaaugcccucuaagaacagcccucaaccaaugaccugaaagagcucccucaccccgugagacgaggaacgaugagguggguguucugcacugacucccugaacuuucccguugggauuaagcuauaauugcccaggguggcugcuggcuuaauucacccuuuacuggccguccccucccuguucaucccccucucccacacacaccaguguucuucaucuuucaaauagacuaauccucgucucaggguccacuuuuaggaaaacucaaacuaagcaccaagaucaucagugacuuccugacuguuucggucuuggugaauccaucaguuagcaaguaugcauugagaaccuacuagguucuagguauugucuaaucugaccucaccucuuuaauacacuugacauccauaaucacuccuuccugaagcucuccuuccuuggauucaggcuuccuugcauguggauauucccucuuucaucggcaguuccgcuccaccuaccccuuacacagugguguucccagaguucucaguccagcucuugcucuucccacucuacaugccuuucuuuggccaugugguccaccugcacaggaucaaaucucacuuuuuuguucgaagauccccaaauuccuuuaucuacccuuacuucgucuccuggguuucagauuuugugucugacuacuuuuuggacauuuuuaccuggaagcuacaaaguuaucucaaaugcaguauaccaguuuugggggguuuauuaggggggguucugugugaggacaaguguguaaggaaauuggguagaagacauuggcaagacagcauuuaaaagugguggaucaugagauguaggcucaguaggaaaggaaguaauucugggagaaggcugagagguugggaagaaauggaagcgucaaaggcagugcuggauuacucaauagauaaacacauucuuagggcauccaaaaagcaaagugaacccccacaacauauuuuuagaaaaaccuugaaauuaaaaaaaaacccaccaaaagaaucaccaugguaaaagucagaaauuuauugaacuuccuuacacuuauuuuacaaguuagaauuguuuucauuuuaaauuacauaagggaacauucucuuuuuuggugcuuugggacauuaaaggucuggcuuggaucuaggcagucaaugagaugaaagcacaguuauaacaggagcaagggagagaggaagcugcaagguagaggcugucguccaagaguggaugcucucuuaaccagccucuucccuacugacuuacuggguuaacuaaaacuuuccauuccagcuguaauauguuccaguuaauggacacagugcucugaaugcucacggcuggcaggccacucuuccacacacauauacuacuuccacuuuuaccagcugaguguaagucacugugauuguuccaaaauuucuuuauuccugugguaguaguuauuacauuuacauaauuuaauuaaacauuauguaaaccaaucgugcgaaaagaaagagaacuguuguuucuaagaacacuaaaucagauacuuugggaaguuucauaaagguaaaucucuuuuuuaaaugcuauugaauuggguguggguaagacaacuagaaaacaguuaacauuuauugaauguuuacuauguaucaggcaguauauuaaggcuuuauauaaaauagccauuucauccucacaauaacucucugaagugguuacugaggaaacugaggcacaaaaaggcuaagcaacuuacccaaguuaggaaaugguacauccaggauuugaacccagguggucuggcuugagagacuguccuaaccauuaugauauuaguaaaaaaaaaaaaaaaaacuggaaaaauccuaacaauggagucugugcagaggcuauuucauaagaauauuuaaguuucuuguuauuuuuuuuuuuaagagacagugucucacucugcugcucaggcugggaguacgguggcaugaucauagcucacuguaacgccuggguucaagugauccuaccaccucagccuccuaaguagcugcaacuacaggugccuacaccaugcccugcuaauuuuuuuauuuuuuauuuuguguagagggagggucuugcuauguugcccaagcuggucucaaacuccuaggcucaagcaauccucccaccucagccucccaaagcacugggauuacaggcgugagccaucacaccuggcuuucuuguucuauuguaaagaagccgaagccaaaauccguagacaagucaauauggauaugguuguucaggaaucaaggacuccacacuugauaaaaggcccugacacucuacccaaagacuagcaagugguugugcauuucuaaguuagaaugcaauguugaaaguauauauguaguauaugugguacuuuuuaugauguaccacuuuaacugacuuugauuaagcaaccuaguagcaaugcugaaugagaaggacuucucuguuucagaacuuaaaauuucagacauggaacagcccuagaugaagaaucagcuaucuuccuaaaacgcagaucuaaauauaacgcuuccuugcuuaaauacuuuuaauuuccaccaucuaccccuacucucaaccagaaaaaaaaaaaauccaagguuauaaguaguaucccgccuaccuuuaccaucuuauuguaaaggagccagucccucuugcccgucuuucuagucaucugccaguuacuucauucaugcuucaguaucucugugucauuuucuuugccuggaauuaucuucacucccucucuaauuggagaaaucuuacucauaauuuuuuucauucauuuuuucauucauucaacaaauaguucugggcaccuauugagugaagaaugaacuaauauauuucuauaauauauauaaaaugauguuucccuauugaaauguuaugauaagcuauucuuuuccuuugaagcauuuaucucaauuuacuauuuuauauuuauuuguguguucauuuguuuaguguucaagggaaggggcagagaagaggaggaagaggagagaggaagguagaguguugggaggguguugggagaguauauauagcuugcagggaaggggaaacgguugggaaaacucuaaggaauuaacauuggagcuacagcugaaggauacguggguguaacugggcaagacuggcggcaguuggggauagguaggagcaggagggguuggggggacguguguuccagauccagggaacagcgggugcuaagacacugaggcagaaggaagggugacaugauggagaaacugaaagaaguccagugugaugggauugcaggauguccuaccccagauggaagagacagagggguaugaggccagagagggagagggcuagacccugcaggacugugcaggccauggcaauauaaguucgaucuucaucagaaaagcaaaagggagccauuggugagaccuaagcaagggaauaacguuuucagguuugugauuuuagaaaucuucuggcugccacguagacaacagauaggaagugcagcaaaugucacuccuuucuuaagacuuccuugaccccaugugcuccuaccaaaacuuacgaagcuccuugaggacagggacuuggucuguuuuguucacugcuguauucccagugccuaaaacaguucccagugcuuaguagguccuuaauaaauguuucuuaaauagugcaacuuuuuaaugucauuucucacaugacauuuauauaguaucucaacuccaugggcuuuccggcacucugaaaagugaaugaucuuucuugugagggaaggacuaaacucauaguuaauguaaugugaaagccaugcacaaaauucauauaaucugaagggaaaagacaucuguccugcuaccauuuuuuccuucuucuacaacaugcaguuaccuuacuucauaauaggaacauuggacccuugguaaccaaauaauuccauuaauucuucaguggaaaggaacuucuuucucucuuaaauuaaacaccuccagagacuaaugguaauugucuuggcuuggauuacccaauggcuuuuguguauucuuuccccuugaaggucuuagggccuuucuccaaauuaagagaauccuuauucuaagaauaugacacucuagcaauauuuucacaagcaucacaagaucugaaagcuagagggaucuuuggaggcauuuaauuuaccccuuacucccaccccaaagcuuacacucccucaguaccacuccuuccucaucacuuagcugucuggccccaggguguucugagaucgguucaggugucagucagggacagauggcacgugcuagagcuagagaacucagaaggucacccuugaucuucacuaaguucccguguuuauuccaaaacaaucuguguuguauuuauguaguuuuaugacuaguugauuaucuccagugccgaccccucuucuuauuccagaccauuagaucaguuuucaggguucuucuucucucucaacuuauucaucuuuccaugugguuuucaauguuuuuacugucuccaguucaugccuuugcaguucuaacaaacuuguuucuuauaaccuacuuaaaauaccaagcuccuuaaugaauuaaucaaucaguuaaucaaauauuuauuaaaucccuaccacauuuuuuccaucccauaaauuuuucuuugagagccccaugagcccccaggagacuggcaacaagacuauuagaaagucucacugcuagcuccaugcacucaccgcugccuuccuaugcaucauuuuauuuucauuucuuuucuuccccuucuuuugcucuccguuuuccucuuucuuauuuuucuccucucccuccuaugauuccauuuucccauccugucacugagguguccuccuuggcauuuugugcuugaggcauuuugguguguccuaugcccucgcuaaagggaaucauaguaaggagucuaaacucacaucccaaaaacagagauuugacagaagcaaaggaaagagcaaaacaaauaguaagcaaaucuagugaacagagaaugacaggaaaauggcuuggcaauuucuuauaaagucaaacuuaaacuuaccauuuaacccagcaauucugcucauuguucuuuacucaagaauaaagaaaacuuacguuugcacaaaaacuuguucauagauguuuauaguagcuuuauucauaacugccccaaacuggaaacaaucuaaauguccuuugacuggugaacgcauaaacaaauggcgguauauccacauaauggaauacuacucaguaacaaaaaggaagaaacuaccaaaacaggaaacaagaugccaggagagaagaggcugacuacaaaggggaaugaagggauuuuugagggugguaggacucuucuaugcccugauugugguggugguuaaaugauuauauguauuugucaaaacucacagaacuguacacuguaaaggguuuuuacuauauaugaauuauaccucaauaaaucugacuuaaaaaaaaaaacccaccaaaauaaaugaauuaguaaagauagacugaaaaacaaacaaaaaaacaauaaacuugaguaaucauaccaaaaaauguucuuuaaaacacacuaacacacagcaauaaaauaguuaaacccaaggcaaauccaaaugagaauaaaagagaaaauacacagguaaauaguauuagaaggaaaaaaagggggauuuaauuuucaauagaaaaucuaaaaauuguaauguaagcaugacuuuacucuuaaagaaaugaaaaucuacaugaaauuccaugauuuuccaguauacauaaauuuacaaauugacccaagaagagauauaaaaccugaguagaacauuaacuguaggggaaauggaaaugauaagcaaagauauaccauuccaaaaaccaucaguuucaaauaauuuacagaugaguucuaccuucaacacauaaauaauuucuaaguuacuuauuuuaguacauaggaagaaugguaaacucauucugccauaucagcagaucucaaaguguagguuagggauaugugaagaucccugagacuuaucugggaguccacacacccaaaacuauuuugauaaugauacuaagauguuuugacucuuucccucucauucucucauacaaguguaaaguggaguuuuccagaggcuaauggaaugccaugugaugaugucauugcucuggcaacuauuaauaacaaaaugcaugcuuguauauucuuguguuuuaaaauuuucuccauuuuaauuucuaacauugauagguaacuuacauaaacaaaguucucuguggauccucaauaauuuuuaagaggacaaauggguccuaagaccaaacauuugagaaccauugcacuaaacuaauauugcuccaauauaaaaaauagacaaagauagcauaaauaaagaagacuacuagcuuacuuaagaacauaaaugcaaauaucuuagacuuaacuguucuuaaaaaaacaauuuucaugacuagauaaaauuuaucuaguaaugcaggggaugguucuguauuuagaaaucuauuaauauaauccauuaccuuaauaguuuacaggagguaaaaccucaugaucaccaugaaaagauccuucaaaaaguuauauauauuuuaauauccauuccugauuuuaagaggcaagcaggaaaacaaauaaaaaacaaaauaaaaaauguaaaacucucgcaaaaccaguaauagaagaaaauuuauuuaauuuguuaagaauauucaccauaccuauugaagucaggaacaagauaaauauggcagcuuucauugcuauaguugcaacuacuaaauauggcacuggaaguccuaacuagugcaauaagacaagaaaaagaaagaccaucacaaagaaauacauaaaaccaucacuauuuacaagugauuuaauuuucaacuuagaaaaucuaagaacuguaaaauuuaaaacuaauacuauauuuuaguaaagccuuaauaaaagaucagccacaaaaauuaauccuuuuccuauacaccaacuauaaccaaauagaaagacaugguggaagauguacaauagcaagcaaacuguaaaauacaugcaacuaaacucaccaauauguccaagauuuauaugaagaaauuguaaauuuuauugaaagacauuaaaagaagacaaaaauaaauaaggaacacaucauauuccuggaugaaacucaaauuaaacuauaaauuuaaugaguuucugaucaaaauacuuauaagauauuuuauggaacugacagauuuauucuaaaguucaccugggagaagauguauaaaagcagucaagaaaaguaugagaacaaaaacuacugaggcaaagaaaaaggaaagauaauaagaagguagaggcugggcacaguggcucacgccuguaaucccagcacuucaagaaggccaaggcagguggaucacuugaggucaggaguucgagaccagccuggucaacauggugaaacuccgucucuacuaaaaauccacaaaguaaaauaaaauaaaaaagaagguagaauacacaguuuuuggccccauacgguuuauuauuuauuuauuuuuauuauuauuuuugagauggaguuucgcucuguugcccaggcuggagugcaguggcgcgaucucggcugacugcaaccucugccuaccggguucaagcaauucuccugccucagccuccugaguagcugagauuacaggcgcccgccaccaagcccggcuaauuuuuguauuuuuaguagagacgggguuucaccacguuggucuggcuggucucgaacuccugaccucaagcgaucagcccaccucagccacccaaagugcugagauuacaggcgugagccaccgcacccagcuggccucauaagguuuuuuaaaaauucuauaaugcuacaauaaucacaacagugugguguuugcacacaaauggaccaaaaauaaaaaaauccaaggaguagaacagaauucagaagcaaacccauguacagccuggcauuuuaaaucaguaggaaaaggaugauggacuauuuaauuguguugggacuacuggaaauucucuuaaaguuauaaaccuaauucacacuacauacuaucaaauuauugaaaggaaaauuuaaaacauauaacgucuucuaagggguaggaauacccuuccuaagcaaaacacaaacuucagaagccauaacagaaaagacugacagaagaguuaaggcugggcgcgguggcucacgccuguaaucccagcacuuugggaggcccaggugggcggauaacgaggucaggaguuugagaccagccuggccaacauggugaaaccccaucuguaccaaaaauacaaaaauucgcugagcgugguggcccaugccuguaaucccagcuacucggaaggcugagacaggagaaucacuuaagccaaggaggcugagguugcagugagccgaucaugccauugcacucuagccugggcgacaagagccagacuccgucucaaaaaaaaauaaaauaaaaucaaaaauaaaaaagaauuaaaaccuuauguaugauuuaagacaauguaaauaaagaccagcaauagaccaggaaaaaauauuugcaacacauaucacagagaaagaauuaauaucauaauguaauggagagaaccuucaaacuaaaaagaauaagacaaucuaauagagaaaaagacaauauaaacaggcaauucacagaacaaauagaaauaaucaauaaauauaugaaagcaugcucaauuucauuaguagccacagaaaaucuauaaaagaacaauauacuuuuauucauuagauuugcaaaaauuaaaggacugauaauauccaguguuggugagauguguaaugauuauucucauuauguaaaugaauauucucucuuuuggaugggaauguaaacaaguacagucuuuuuuuuuuuuuucuuuuucuuuuugagacggagucucacucugucgcccaggcaggaaugcaguggcccgaucuuggcucacugcaaccuccaccucccagguucacgccauucuccugccucagccuccugaguagcugggacuacaggugcccgccaccacgccccgcuaauuuuuuguauuuuuaguagagacgggguuucacuguguuagccaggauggucuggaucuccugaccucgugauccgcccaccucggccuaccaaagugcugggauuacaggcgugagccaccacguggggccaaguacagucuuuuuuaaggguaaguuagcacagccucacaaaaacaccucuuaacucaguacuuccacuucuagaaacuugcagaaauaacuagaugugucuauaaaaaccuaugugccaaaaguucgcugcagcguugauugcaauuaugaaaaacuggaaguaaauuacaaggcuuccaacaggaaaauaaccaaauaaauugugguaguuccaaaauauggaauaccauuuaggaguuaaaaagaauaagguaauucuauuauguacugacauggaaaaauugaaaacacacauaguuaagugaaaaaaggaagaagcacguuuaugguuaucaucccauuuguauaaaaacuauauuucuaucuacauaaauauacauaaauguauacauguauaaauagaaaaggucuucaaggguaccuauuaaacaguaaacagcgcaguuauuuacguuuguggaagggaguaagauuaaagagguggaguaagaagcuuuuacuuuuuaguuauuucuguaauuuauuuuuuuuuugcaaugggcaugaauuuauguuuuaccuauacauuucaaaaccaauuaaaaaaacccaaccuccugcuauaucuacaguaagaggcaaugcaggcuucgcaagggcacugguuuugaaaagaggacgggaaaucacuuucagacuuuuuuuuuuugacacggaguuucgcucuuguugcccaggcuggaagugcaauggcgcaaucucggcucacugcaaccucuaccucccagguucaaacgauucuccugccucagccuccgggguagcugggauuacaggcaugcgccaccaggccuggcuaauuuuguauuuuuaguagagacagggucucucuguuggucaggcuggucucgaacucccaaccucagaugaucugccugccucggccucccaaagugcugggauuacaggcgugagccacugcgcccagcucagaaauuuuucuuuuuuaaacauacuuucuguaucuccguuacguggaucaucugaagucugcagguacagauguauuugcuucuacagauacagaaacugauaaguauucaucucugugacuucaguaccuagcaauguguuagguauucgguagaugucacauaaguguauguugaaugaaucauaaucugagagaaaauaaaaagguagaauaggaggggcaccauggcccauaccccaaucccagcccuuugggaggccuaggggagcggaucacaugagucuaggaguuagagaccagccuggacaacaugacaaaaccgugucucuacaaaaaauaaaacaauuagcugggcaugguggcacaugccuguaaucccagcuacuugggaggcugagguagguggaucaccagagcccaggaguuugaggcugcgguaagcagugauagcaccaccacacuccagccugggugacagggugaggaaaaaaaaaaagguagaauauacaguuuuugcuaacucuuuagcugagauggcgugaagaagaggguucaaguggauaaugguaucauuaccagacaggaaaaauuggaaguuuugggggcaauuauggaugauaauagcuaacauuuaaugauuacugacugugugcagguaucguguugaaugugcuguauccacuaucucaucgaaucccaagaguaaaccuauauuuccucacacaaagaaagaacaguuuagagacuuucuccaggucauucagcuagcuagagcugugacuaaaaccaauauccgagacuccaugcuccuaacuuugagguuaugcugccucuccaaacauggaaaguuaauacaaucaguuuugacauguugaguuugaggugcugacggaagauucauugaggugugguuguacagugaguagcuaaauauccuaagucugcagcgucuuggagaggacagagcuagagucaagccuaggagagagcagugucugggaggccaauacucaauaaucauucaacaaauauuuaucaagcuuccacauaaaagucaggcucagguauaucaagcauucacuugaaacccauuuggacacacagaacguuuacuaugugaaaguacuguaauccgguauuuugaauugugggucuuaaaaaaacucuaauguucucaauuacguuggaagcaucuugagggcaagggcgagacacuaaauuucuuuguauuccccuuguuauaggucucaagacauguuuguugauuaaaugcuugagaaguuuccuaaaucucaaggaaaccaaguguagacagucuucauuucuguuacuaucuaaaagucuauaaaagcaucaagguuucaaaccaaauaagauuuuucaucagugucaucaagguuaauugcaggcaucagaaaguugcagcuuggagcagcagguuggcugcaagaaggcuugugccacaugauauugcccuuaucaaauuuaucaaagaccagagucuggcccucagccuugcuaguccagaaacucaauccugucagaguccagagaacccaggcaggcacaugcaucuaagucugaaaaaaacugaaguauaaaaccagaaugucgauuuacuuauuuauuuuuugagacggagucuugcugucaacucaggcugcagugcggcaaucucggcucacugcaaccucugccucgcagguucgagcgauucucgugccucggccucccaaguagcugggauuacaagcgcacaccaccacacccagcuaauuuuuguauuuuuaguagagacagaguuuugccauguuggccaggcuggucucaaacuccugaccucaagugacccguccaccuuggccucccaaagugcugggauuacaggcgugacacugcccggccaaugucaguuuauuaauauacuaaagggaaugugacugucaggaaaaucagauguuugcauccaccaucaucuccccguagcuaagcgacgcgcaaagcuguuaccaggaguguacaguaagcccagaaggcagggacuuagaaauaggauuagaacacugaacagcacaggcagcaugaagcaggggcagagcaucagcuuuggaaccagagaggccuggacacacauagaauuauucacgucccagcagaguggcagugggcaagucacucaccuucucuaaacuccgguuuuuaaagggugaauaauacuucacuggcuuauggugaggguuaaaugagauaaugcauaaaaugcuaaaccagucccugucaugugauacauauucaucuccauaccacacauucauccauggcggcuacauauucaucuccauaccagggacacaccuguuagugguucaagucagcuuuuacaacauccuuugcucugaacaaaacuagggcaggcaagacuggaagcaaaagaccauuuagaagggugcuaaauaauccagaacauagaugcuagugacuuaaaauagggcuguagcggggagaacagagauauguauauagauuugaaagauauuuaggggguagguacuaucuuggcuguuuuacguaauuauuuauuguccugacagcaauuuguaaaguaggugccuauuuuuuagaugaaagucagagauauuaagcaacuagcucaggaucacagggcaaugacugaacugcuauaugaaucacagcuggugugacuccaaagccucucuucuuccuacaaacaaaauauacugcuguacauaucguucucaacaagaugucaauugucaggaauauaguaauuucuuaacacuaauaauuaaaguauugaacuuuagaaaaaugauuugcuuuuuuaggaaauaaaauguggagcagaucaagguuaucacuauaauaauuaauuucacuauugcucauuuccauuacaauacaucuucuuaagggagagauagaaagaaguggagguagagcucauggaccagaaauuaugcaucgcugcaggugugucuaugaaacaguguuaucugcguaacuucacccauuaugccuuauugaaaacaguuuaagaaugguuacuccagcugggcaugguggcucacgccuguaaucccagcacuuugggaggccgaggugggcagaucacgaggucaggaguuugagaucagccuggccagcauggugaaaccccgucucuacuaaaaauacaaaaauuagcugggcgugguggcaugugccuguaaucccagcuacuugggaggcugaggcaggagaauugcuugaacccggagguggagguugcagugagccgagaucacgccacugcacuccagccugggugacagagcaagacuccaucucaaaaaaaaaaaaaaaaagguuacuccaaggaacggcccggucccucuuuuugagcaaagacagucuuagcugaaacaucuauaagauuucacuuuaacagugacaagcucuucagacugcagacauaggugcuaagcaaaucauacucucucuagcagaauuuuuauuuucccagucacguucacacacaaauuacaguucacugcaaaacuuaauuuuuuagaugaaagacaauaccauauaacagauuugagcuucuuuucuauaugaacugacaaguuaggcuuuccccacuuuuaccccuuacuuuuuaaccgaagcauaaaacauuacguuuguucuuauaaaauuuuacuuugaacuaguuugagccuaagauuucaucuucaugagauggauguaaaccagcuuuuuuuucucugcaaaguuaauacucauguuuuuauguuccuacuccaaauacugcuuaaagcaauugugauuuucagaaguuuuucauaaguuauuaauucacuagacaaauguuaccacaugccacccaaguaccaggcuccucaaggaauuuacagucuaauaaggaaaacagauuggcacccaaucauacccaauaccaguaauaacauuaauaacaauuacuacuauuuaucauauccugcucugugccagacacugugcuaggcgcaagaacaaaaagaugaugaagcaauuccucuaccuucaaggggcuucccauggcuugaaaggacucauguauaauaugauggaagaggcaggcauauuaaccaauaaaugcaauaaacaggugccuugcuagaaauaaagacaguguguuucguagaauacaagauggagggauugaggcgggauaagaaggagaguugguaaagguuuuauagaggagcggaccuuugaguugaguuucagaagaugugcagguauucucccaauuaagaguaaagggaagaaaaaggguaaccauggcaaaugcaaguguaaaacaauuuuauguguuuaaggagcaacaagcauugguagagauggggguuacaguaaagaagggggagggaguugagaggaucuagcaagagccggaguaagaaauuagagaguagaugaucaaggaucucacagcccauguuguccuucucuuaacuucaagggcaauggagagucauugaaggguuuuagggacgggaauuacaacaacaggguuucucuuagaacucugguagcuaugaagacgauggaaucaaaguguuugagacuggagauacagagaucaguuagaauauauauuuauaggagauauuaaugaguuguaauaguugaacagaagaaauacuaagccuacaugaagaaauuaggaaagagacaacccaacagaaaaaugaacaaaacauugaacaggcacuucaccaaagagaacauuuaaauggccaauaaacauaugaaaaggugcucuagcuuaucaguaaccacgggaauguagacaaaaacuaaauuuauauauccagaaagaugauuaaauauuaaaaggucugacaauaucaaguacuagugggaacaugaaacaacaaaaauucuuauauacugcuaaaaauagaacaaauugguagaaccucuugggaauacaguuugacauuagcuaguaaaguugaagaaacacuuuccccaggaggcagcaauucuacucuugggucucuacccucaggaaacucaggcccuguacaccaggauacacauaaaaauguuuauagcagcauuuuucauaagaaccaaagaauuauaaauaacccaaauguauaucaccaucagaauggauauagaaaucaagguaggccgggcaugguggcccacuccuguaaucccagcacuuugggaggcugaggcaggcaaauugcuugaguccaggaguuugagaccagccugaccaacauggcgaaauccugucucuacaaaaaauacaaaaauuagcuuggcgugguggugcguggcuguagucccagcuacucaggaggcugaggacaaaggaucgcuugagccugggagauggagguugcagugagcugagacugcaccaccacacuccaguugagcaacagagugagacccccauuucaaaaaaaagaaagaaagaaaagaaaggaaauuagggcauuacacagcaauaaaaaugaaagaacucuaacuacaugcaauaauauggaugaaucucacaaacuuagugaagaacagaaagagcaaaacacaaacaguacaaaaaaaaacaugaucucucucauuugaacgucccaaaauacaaaacuauauuguuuggggauguuuacaugugugauaaaauuauuuuaaaaagcaaaaaaguaaucaucauaaaagucaagauagugauuaccuaaguaagagaggauggguuauaaucaaggagaaacauacaaggggcuucucacaugcuggaaauguucuauuucuuucuuucuuucuuuuuuugagacggagucuugcucuguugcccaggcuggagugcaguggcaccaucuuggcucacugcaaccuccaccucccggguucaagcaauucuccugccucagccuccucuguagcugggauuacaggcaugcgccaacauguucggcuaauuuuuguauuuuuaguagagacgggguuucaccauguuggacaggcuggucucgaacuccugaccucaggcgauccgccugccucggccucccaaagugcugggauuacaggugugagccaccgugccuggcuaaugcucuauuucuugagcuggaugugguuucaugaguguucaucauauaauuuuuuaacuguacacaugucuugugcaccuuucuguauguaugcaacauuucaaaauauaaaagaaaaaaauguacuuggggaaaaaaccaaaauacucauuaacagcuacauacugcaagauaugcuuauaaaugaaaagcuaagaggagaauggugagaaaagagccuggaacgggaggcugaagacuugugggcuuuuuuugugauaggaaugagggguguuagguaggcaggugacaugaacaagucugcauguuagcaagaccuuuaucaguaggguauacggaaugaacuggaagacagcagaugcuaaugccagagcauguuaggagccuacugcaacagugugcuaagacagcaggagaguaugaacuaugggaaaagaaguagggacagauggagguauuuauuaagcagaauuguuaggccaugaaaauugauuaguuauaaggggugagguaauggagggauccuguuucuaauuugaauaacauuagcaugauaaaucaaaauaggcaauacaaagggagauacagguuuagugggagaagaugguaaaucugguuuugguccugcugaguauucagugcccacacgacauccaagaauaaaagucuagaaggcagccagauacacaugagugaagcucagcagcagagauauuuguucuggauccuaaugauucaauaucuaggucucaaaauugugaaaugguucaaugugguuugggccacuaccaguuauuugagaagucuuauuuccacuaggcaagaggguggaguaagagggcccuuggguacaagaguggaaaagcaaacagggaggguuccuaacuuuucagccaaagcaauugggugaacaacagugcuaucaucugagauggggagacauaaagaagcaagauuauuucuggcuuuguuuauuuuuaaagagggguaggccaggcaugguggcucaugccuguaaucccaacacuuggggaggccuagaugggcagaucacucaagcccaggaguucaagaccaaccugggcaacaugguaaaauccugucucuacuaaaaauacaaaaaaauuagcugagcaugguagugcacgccgguaacuccagcuacucaggaggcugagcugggaggauugcuugaaccugggaagucaaagcugcagugaggcgagaccacaucauugcacuccagccucggcaacaggagggagacccugucucaaaaaaaaaaaaaaaaagagugugaguggugcggcagcggggcaaagaaucaagagcucuccuuuggacucuuuuuaagauaauaugcaggcugggcacgguggcucacaccuguaaucuuaacacuuuaggaggcugaggagaguggauugcuugagcccaagaguuggagaccagccugggaaacauggcgaaaucccaucucuaccaaaaauacaaaaauuaacuaggcgugguggcgcacaccugaagucccagcuacucaugaagcugaggugggaggaucaccuaagccuagggaguuugaggaagggaggccgaggcugcagugagccaugagcaugccaugaacuccagcuuagguggcagagcaagauccugugucaaaaaagaaaaaaaaagaaaugucuuuucaacauucaacuggggacaucagguaggcaacugugugcaccaguguggagcuuagaggacaaggucaagguuaagaguuauaauuuuggguuucauuaguauaaagacaguauuuaaggguuuccugaccuaauaauucuaggcugggugcuacuccugugaacuauaccauauaacuuauuccucuuaaaaugugaaccucaauguaacguauuuggcuguuuccauaucuguguuccccauaagaacuguaagaugcuugaagguagaagucaggucuccuuuacauuggauucuuaugaccuaauggcuccuagcacauaguagguacucaauaaauguguggaaugaaugaugaaaugcugcugacuccucuuaucaugucuugaguauucucugcacuacauuuaacugagaucacuaaccuucuucauacacuaaguuuccagcugcuccucaauucuuuccuccccaguucuccacaaauguuucuuacuuucaaggcagaggccacuaguaucucccuccucauccauuuaaaauguucucuucuuucagaauauugcucaucuccaaggcucauccuccucccuaucauguugacugcgucuuuuacuucuuccuuagauuuacacccuuuauuauuccuguucuguaugaucaugcauuuuaucuucccacauagccauucacucaugccagcuuagaaaaugugaagguaccauauuuacccuagaaaauacuagaucuugaauuuagggagacugacuaauccagaguucacauucagaugguaauauucuccuuaacauccugccaggcaugacuuuccuggcucagaaaaaugccuggagcugugacagcaaauuaaaagccucagucccuauggcugcuuagggauggggaggcacggccugacacacuauucucucaacugcuggacaagaugggauugcacuagggcaaggauuuccccccuuuaacuggggaucagcauucuuucuuuccaaugauaauaucuuggaaguggccaucacaacagguucuaggugaggggaugagccaagucauauauucugauguccaggggucccccuugacaggcuucacaugggacuccgcaggccagcggcucuccuuggcaaugcaguccugaucugaggguuagcaccugggaagagcucauccuugaaucuggcuaaugucaaggccucuggagcaccuggaggaguuuuucuuugagacucagggaacaggaggcacagcuccaaagaaagcucugcucuaagcucuuuuacuuccaugcugggucccaagcucacccaugauuaauacugccucaacagaaaaagcaucaaguugagaaggugucuguucuuagucagaauucuuuccauccugaucuaagagaucacuggguagagcuuucugaagucugcuggagugacaaaaagggaagagcacagauuuuuggcaucagacaggucugucuuugaaucccagcucugccacuaacuagcuguauauuggucaaaugucuuaaauucucugagucucagcugcacuauauaaaauggagacaaugucuaccugcagggcuguuaaacaguaaauuuuaaauuuauuuccucuuuacuuucucuguaauagcaacuggcuaggaacauuagccccaaugccagggucagcuuugacuaagucccuccauucuuugccauguccucuucaucuuuugccacucuccacccuugcacacugcauaccuggcuagagugaacccuuuucaguucccugaaugcaucaagcucuuucuggacagagcuguccaacagaacccucugcaaugaugaaaagguucaguaccugcucuguccaauauaguagccacuagucacauguggguagucagccuuugagcuguagcugaugggacugaugaaauaaaaauuuaauuuuauuuaauuuuaauuaauuuagauguaaauauacccacauggccaguggcuaccaugacuuauaguucuagacuguaagucuuugcauuugcuacuuaccugcgugaaauguauuuccccacucuucaccuagcuaacuucuacucagucacaaaaccuuaacuugagcaucuguuccuccaggaugcauauccugugucccuggaucaguuagguuucccuuuuguucccgucucuagcaucuacacuucucuuaucucacucaucacauuuuauuucaacgacuggucugucuguauuuuccacuagcuguaaacccuauggcccuccucugucaggucuugguaccucucaucuucccuuugaguggacauccacaggaacuuaggaucuagauuuuuuuuccaaaacuggggacuaucuuugagauaacuacugcacauuugaauagcuuuagggauucauuagaaguggccuuacagcuuucuaaggauaagccaaaagggaaaaaaaaaugauaaaaugccuuguuaaaaaguaaaaacuuaaggcuauucuggacacacugccuaugggguagcccugcuccacaaggcauaaaacuaaauaaaauaaaauaaaaauaaauaaaaacaaauaacaacaacaacaaaaagcuccaccacccuaaaguaccaagacaaaugauaaacugaaaaaaaaugcaacaaauauuauagauuaaaaaagauuaauauccuuccuauuaaaaagagcucuuaaaaucaauuagaaaaagauggaaacccuguaaaggacauggauaagcaauucaaaaaagaagauaaacuaaucccaauaaguguuuuaaaaaauguuuagcuucacuaguaacuaaagaaauacagauuaaauaaauaagaaaccauuuugucuacuaaauugccaaagauuaaaaauauuuaucauaauguguugauaacagcauaaagaaaaagguaauccggcaagcggcauaaagauuuaaauaugccuaccuuuuuaucuaacauuucuacuuucgagaauauauccuaagaaaaugaucagacgcuugacaaaaguaaauucacaaagauguucucuguaauguuguuucuaauauugaaaagcuggaaacauccuaauuagacaaccagagauugguuaaauaaaauguaaugcaucccugcaauggaauacuaagcuuuuaagaguagugauggugauggagauuuauguugacauacaguaguaucuguaauaaaugaaaaagugaaaaagaaaguaacaaaucagcauuugguaugacccuacuuauaucaaaacacacugaucuacuuauuaucuacucauuaaaaggaagcuggaaugauacauaccaaaauacuaaugauuuuugucuauguguuuuauucucuuucuccucuaaaaaucauggcagauagccagcgggagguuguccauaggauucucugguauaggguuuuugucuccuuaaaugggucacaggccaccuaagaaacauccaguacuagguucccuggcugauguagcuguaagcucaaugggagccuagaccuuaccuguauuauucauuacuguauccggagggccuaaaauugccuggcaccuaguagguauucaauaaguacucgaauuaaugaaucguaccagaguaccaauuuuacuuaaugauaggcauauuaaaacauuauuuugacaaaguaaaacugaaguacagaccggacacaguggcuuacuccuauaaucccagcacuuugggaggucaaggaaggaagaucgcuugagcccaggaguuugagacuagccugggcaacauugugagacuccaucucuacaaaaaaauuuuuuuaauuagucagguguaagggugugugccuguagucccagcuacuugggaggcugaagugugaggaucacuugagcccaggagucugaggcugcagugagccacaaucacaacacugcacuccagccugggugacugagcaaaaugcugucucaaaaacaaaaaaacaaacuaaaguacaaaauuuacaaaaauuuaagcuaaaaacaagacuucuaauaguugauccuuuguauacacgauugcaaugcuggagggcagaaguuaguuuucuucuauauguguauuuucccagaagaguuugagaaacaguaaguuagugucucuguuuaaggccuuucccaaccccucaugaggccagguauuacaaucuuuaauuuacagaugagaaaaugaagguucagugguugcaagaucacacaguuacacaguggauugaaucaggauucaaauccaggccugucugucuccagaacucaucugugguuuugagagguugaaagcaagacaaugaaaaggacauugcagaucaugacagcuacugucugcacuuccuaacaagucaccaucccuuaccccugagcucccaggucuaagaggugcuuuuucuuaacccuuagagaauccagaggacgauuugucaccaggguuauuagcauuucucccuggauaucgacagcuugucuuuccucccuccaaccagugacugauuucuucaaaugcucgccaaauacagcccaagucaccaugguaaauguauugacagacucauauuaacagcuacugagcauuuacaggguuguaaguuaugcgggguggggugggggaagauaagaaaaaucacagggaaauaaaacaaguucaaucagcagugacaauuauuuauuuaaaagcugcugguuggaacaguuuuuagaauauauuuuaauugcuaauuaugguuucuaacaggagaguggccucaaucagaauugcuccuccuuaaagcuaaucauuaauauuuuagcggcuuggcucagaaacugugcucaugcaguuggcccacccacagcugugucuaugcaaucgacuuuagcuuuagcugcucacuuggaaacagaaagucuaccgcauugguugguuugcuaugccacucccaaagcgugcuauuccauuugccauaaggcaguaguagucuucuaaauacuuacuucucugaagauugaggcucguucaauaagcaaaauugugcucuaagccacccaaacaacugucaguuuuucaaaggaaugaccuaucuuuucuaaguuaauuuacaccuuuuacugggggacauaaguguugccuuaggcaagauagagaauccugaagaguuuguuuucaguuucuaauucccugggcacuucugugugaacuucauaacaaauaaggucagcuuccaggcccagggaggugccagggguaaacagacgagagggcgcucuggggucccaagagugugaguauguuuuggcauugccccaucucccaaguuuccaacuucacaugcuucuuaaggagaaucuaauccucaggagagaauuuaaucuguucauuugcacgcaucucaucagcacccugcuuuguuguggacuguuugauguccuaaggaaaagacuucgaagucuuuuaaagccuuuuugaugugaaccagaaaaucauguuuugucaagagugcacucaacuugaaccucaaaagguucaggacucagaaaccacaugguucaagugggauuuaaacugggcaaaaucacuuccuugucuuucucugcaagucccuccccuggccuuugugcuagcaguugcuguacacuguugggccuuuuccucuuucuuuuuauucucucuuuugcucacacaugugugugugugagcacacacacgaucucgacaagaaaaccuagggaaaaagaaaaauauauuacccccccuaaaacuggcugucuuuccacuaagggugaaagccaucuccagcuccacucuguccucccagauucagaauggucauugcugggccccccagaggcccaggcugcuuuaggugagggucaaaugauuuacagagccaaacaacuaugauuacauccuuaaucgaggcauuuaacuagauacaagacaagagcucccugcgcuccagggagcuuuugcagagaaaaguggaaacuugcuucagggacuuugugugucaaggaggcauauacauuaggacgauucuguuaaacuuggaaauggaaggagagggauuugacuccuccuaaaaucagagggaagaacugagcugagagaaaagauucuaacccuaaccuauccaaagguuucuuccauuuuuuuuuuccucuuuuuucuuuuuuuugauauggagucucagucugucacccaagacggagugcaacggcacgaucuuggcucacuacaaccucugguucaagugauucuccugccucagccucccgaguagcugggauuaaaggcauaugccaccaugcccggauaauuuuuauauuuuuaguagagacgagguuucaccauauuggucaggcuggucucaaacuccugaccucaaguaauccgcccaccucggccucccaaagugcugggauuacaggcgugagccaccaugccuggccuuuucuuccucuuuagacuugaaaauccaauuauuugaaggccagcacaaguuuagauucaggagacagaguuucaacugugaaaaggucccaaguguuccucuuuaucccaaggaacgcuggugccuuguuccccauggcuguaaucacacugaaguuucacugaccacagucucaagguauccucauguccugcuaacuauaauagucacuauuuauugaguggcuuaccauaaaucaggcaccauguuauaaauacauuaucucauuuaauuuguucauuaaaacaaaacagugagucaucuuauucccauugugcagacauggaagccccaagcucugggaguuuaaauuacuugccccaaagcaacauagcuaagaaguaucagaaaugcaauuaaagcccaauuuguugcucuccaaagucaauguucuuggacuagcaccauguugcucagcaugucgcacuccguugcagauuuuuugguguuuuuuuaggcacuucacguuuuauaaauuuauuuauuuggcauuuauugaguaccuacuaugggaaaaguacuguggauauuucaaaaacuuuaagacauuauuccuuccucgucuuuuuuuuuuuuuuaagagacaggaucuugcuguguugcccaagcuagugugcaauggugcaaucauagcucauugcagccuugaacuacuaggcucaagcgauccuccccacucagccuccugaguagcugggacuauaggugugugcuaccacauccggcuaauuuuuaauuuuuuuuuuuuuuuagaaauggaguguugcuauguugcccaggugguuucaaacuacugugcaauggccuuuucacaagucuucuguuacuaacacuuucccuacaucaaucuguuagucacgcaacagccaaaguaaucuuuuuuuuuuuuuuuaagagagucucgcucugucgcccaggcuggagugcaguugugugaucucugcucacugcaagcucugccucccagguucaugccauucucuugccucagccucccgaguagcuaggacuacaggcgcccaccaccaugccuggcuaauuuuuuguuguuguuguauuuuuaguagagacgugguuucaccguguuagccaggauggucucgaucuccugaccucgugauccgcccgccucggccucccaaagugcugggauuacaggggugagccaccgcgcccagcccaaaguaaucuuuugaagugauaaaucacaacauggugauuuauguuuaaaacacucuguggcuuccugaugaacccaaaauaaaauccaacucuccguggccuaaaagauuuacagaggucuggcuccucuccaucucaucuccuaccauauucucccaaauucauucugucccagcccucaggccuucucucuccuccucaaacauuccaggacccccuauucccaaacccuuacauaguugugccuggcucaucauuucauauuucaauucaaacaucauuccaagggcauuccaauucaaauauguuccaaggaacauauuugacacagcaggucauuuuuuaaaugacaaauaacuaaucauguaauaaucagucauaauacuuuucuugauucuuuaauuuuaauauaagcaguuaaugauuuuaaaaauauguuuuauuuuauuuuauuuuauuuuuuaagacagagucucgcucugucacccaggcuggagaauaguggcacaaccucggcucacugcaaucucugccucccaggcucaagcaauacuucugccucagccuccagaguagcugggacuacagacaugcaccacugcaccagcuaauguuuguauuuuuaguagagaugggguuucaccaugcuggccagguugaucuugaacuccuggccucaggaggccucagccucccaaaguggugggauuacaggcaugagccaccacaccuggccauuauguuuuauuuuuaaagauguucaaauuuaguaaacuauuuacugggcaaacuaaaauuugcacuuaccaaacaaaaauauuacacccugcaguucacaguuuauuucacuguuuuaaaacuuaaacacauauaagaacuccaaguggucacaaagaacugcagaauuggaaaaaacuccaauuuucaugucuucaucuuuacaguucaugugcugucauuguuuauuuugaauauacugcaugaaugcaggaaggaauaugcugugucaccggaguuggagacacaaacuguuuccuguggaagcucaacugauucugaacuguuacguacuuuuacccaaaucaagcugaauuugccaaugucaggggcccacaguacaacuggaaguucuccaaauucucccuuauagaugacaauguucauuaaaggacaaauaauuuaaaaaugcuaauuuggccaggcaugguggcucacaccuguaaucccagcacuuugggaggcugaagcagguggauuacuugaggucaagaguucgagaccagccuggccaacauggugaaacuccaucucuacaaaaaauacaaaaauuagccagguguagugacgcacgccuguagucccagcuacuugugaggcugaggcaggagaaucacuugaacccagaaggcggagguuguagugagccgagaucgcaucacugcacuccuggguacagugccugggcaacagagagagacucaaaauugaaacugagcaacagagcaagacucaaaaaaaaaaaaagaaaagccaauuugaaacuuacauacauaccaaaacucaagaguaaccacagcauuuuuuucaaacuuauaccaacaaaauauuucuguggggagaaauauuuuccaagugacauuguuuaaaauugccagcacaugaugauauuaaaaagcagaccagagcguuuugugguggugcacaccugucguuccagcuacuggggaggcuaaugcacgaagaucacuugagcccagggguuugagguuguaguguacuauaaucacaccugugaauagccacugcacuccagccugggcaacauagcaagacccugcuucuaaacagacaaacaggccgggcaugguggcucacguuuguaaucccagcacuuugggaggccaaggcaggaggaucacuugagaucaggaauucgaaacaggcugaccaacauggugaaacccugucucuacuaaaaauacaaaaauuaacugggcaugguggcgggcaccuguaaucccugcuacucaggaggcugagacacaagaaucacuugaaccugggggguggagguugcagugagccgagaucgcgccauugcacuccagccugggcaacagagcaagaauccaucucaaaaaaauaaauaaaacaaacaaaagcagaccaacuuuuaguugacuguuguuuuaaaaugccucuacagaguagcaggauccuguuccccuccccaaugcauacuuuaucacaauaaaaaaaaaauucaaagugcuuuaacauggggaaacacaggguauuaugacagcaaaaacaugguugaagaaguggaagaacaauaggaguauaaugucgcagaagccacgguaaggggaauuccaagaaggaugaaguaguugguugcagccaauauuacagaggaucccucuuuucaagcugggugccagggccaacugggagcaggacccagagaucucccuuucuacuacaugagaagguaaaacccaggugccuuccucuggcugagaugugaauuaauucaaagggaaaaugccuuauauuuggccuuagccaugccuuacuaucagcagcaggaucaaugagcacauaucauauugagccaauggcucugugcucuccagacucugauccugcaacaaacagagccgauggccaccaccaggccugcuggugcaugaggagggaagagacuccacucagaagauggccagggauguagucuucuugcccacuccuauguggcucuagcgccaacuuaaguggagaaaaaguuucauagauauagccacaaacagagcugguuaaauggaauuccauuuagcacucacaucugcuguuuaccccaucuugcucacuugaagaaagcagcaagcauuugaccacuucuuuuuuuuuuuuuuuuuuuugagaugaagucgaugaagucuugcucugucgcccaggcuggagugcaguggcaugaucucggcucacugcaaucucucugccucccaaguuuaagcaauucucugccucagccucccgaguagcuuggauuacaggcgcaggccacuacaccuggcuaccuuuuuguauuuuuagaagagacaggguuucaccaucuugguuaggcugggaacuccugaccuugugauccacccaccucggccucccaaacugcugggauuacaggcaugagccaccucgcccggccgucuuauuucauuuuuaaacuaccuucacuauauagcuccuagaccagucugugcuuuuuggacgguaaaacugaaauaaccaucaguuaaccuuuuuuacaaacuaacucagaagaaaaaacaaauucagaaaagaaaacuaauuuugucaacgcacacacacaaaucagacacuuucccagcaauugugacuguaaucccauccacuugaccauuuggaagaaauagaaccaaguaguaauuacagaaccagaggaaucauucaguuuuaucaauucaucucuccaagauucaaucauaaaugcuagguuauaagccugucccauaauacagucuucugaaucaucuuuuaaaaauaaacuuuugguggcugggcgugguggcucacgccuguaaucccagcacuuugggaggccaaggugggcggaucacgacaucaggaguucaagaccagccuggccaagauggugaaacccugucucuacuaaaaauacaaaaaaauuagccaggugugguggcaggcgccuauaaucccagcuacucaggaggcugaggcagagaacugcuugaacccaggaggcggagguugcagugagccgagaucaugccacugcaccccagccugggagacagagcaagacucugccucagaaaauaaaaaauaaaaauaaauaaaaauaaacuuuuauuuuggaauaguuuuuagauuuauggaaaaauugcaaagauaguagaagaggguuuccauauacucuucauccaguugucacuauuauuaauauauuaguaauaugguagauuuaucaaaacuaaugaaccaauauugauacauuauuaacuauauuuagauuuccuuaguuuuuuccuaauauccuuuuccuguuccagcaucuccaaauuaacuuuuuaaaaucauaaacuaaauuuuuuaauuauagaaauaauacaucacauguuaacuauucaaauaccgcagaagagcauacaagaaaaagucuuacucgcuucuuccuaccuagucauacuucccaggggaaacuagcauuaacaguuucauauguaucucucugacauuuuauaugcauauauaaagauagacaugaauguaucuuuuuuucuaugagguuuuuuuuuuuuucucucuguaucuuguuuuacauauaagcacuuacggcucuaacucauuuuuuuaaccacuauguaguauucuauaacauagauauaucauuauuuauuuuaccaauuucuuaucaauguacauuuagauuguuuguuuuucacauuacaaacaacauuauaaagaacauacaucuuuaaguacuuaacccaauauaugcaggauaaauucuuaaguugaaucccaucaaaggauauuuguauuuaaauuuuucauagacagacauuguugaaaggcccuccaaagagacucugcugcugccuuauaggccuaccaaccacacguccccacccuguuuccccacuccuucaucaacaacuguaggccaucaaacaaauuacuaacaauuccuugaaaugcuucacauuugccaucuucccaccuccaucuucaaguuuucccuccuucuuuucagcucucuggcuacuuuugguuuucuucccaccuucccugugaagguuguccuguacuuuucuuuuucuacacuuacacucuugacuccccuucucacuucucuaauaucauucuucgugcucacaaaugucccuuacgauuuccucugcagcucagcaugauuaaauaaagaagagacacuuccucugcucucccagccugcuggcccuccugaaccaagagagaauguuaauagggacaccugaaaauccuucaucugggucagaauauuagaaggaauauauuuaacuugguguaaugcuaggagaaaacaucuggaagaauuugcauuguuucuuuuguuaaaaucuuaucuguuauuuuuuuucuacauuccauaccuggauaggauuccucucuuuaaaacaauugcucaaaauuguuauucauuacuccccccagcuuuuuuuuuaagcuaguguuggaguggaggcaaaaguagagguggaaggaaagaaaaaaaaaauccacaaguggcagacugaagaguaggaaugaaagugcagggagggaagaggugaggaggcaaaagacaguuuuggggaaaaugucaaccucuuaaguccucuaagaagaguucuuuacuuaauuucaucaccacuuccuucauucaaaagcucuaaaaacagaauggggcaggaguggguuggaggguggggcacaguggaagggggagugaaaguauccaauuccuccaacugcaacuuuccccgaccccaacuucuuauccagcaaagcucuauccaccaccaagaaucagcuuaauagaauaaaccacuuagggcuaagacgcagaggaagucaaagaccccacaaucuccuugccuauuaagccucuuagaaguuagaaugcugcuaaagaaaagugauauuauggccgagcuacuuagaaagaacacaaggaugcgaagucggaaagagggaggccaguuuggggguuugugagcauccaucguuaacuaaagaugauggggcggggugggauaguggagugggagcgaaagcagccagcugugagaacggcgcuuggaagucaucaaguugagauuuaggagaagaguauuuguagaauguacaaaugugaugagcucuaaauagagcaaaagcaauuuuuuccccuuaaaggggaaaacacagucuuaagcauuauguaaguuauuagaaaauuggaaaaauaaagcagccugcaaugguuccuucccaguucaaauuucccagugauucuaggcauucugucaccuccucauccucuccucaaaauagcuggugaacaguaaaugguccacagacuugcuaucugaguuggcugaccaggcagaggcauagaacaggauucgucaagcccuuuacuaaacccagaaaaaauuccuucuggcuuacuguccuuccucggguaggaguuuaguguagaauucuagucauuuccacucugugccuuuucggguauuuuaaaaagguggucauugggugggugcuaaacucaucccugcuccagcccccauauaacugaagccaagaaggaaaaacaacauuauagguaccaacuccugaauaucaauuggaagauuuuucagucguaggaagacuugucauaaacugcacagacuuauaagaguucagggcuugcuggagucacuguccccauaaugcaauuaggaguagagguaagaguuggaggagccugguuuaagagaccucaaaucugugcccaaccccuuaucauauuaauuauagcuaacauuuauugaaggcauacuuugugcgaggcacuguuccuaggacuuuauuuguauuuucuauuaacucauuuaauccuuauaacaccacuaagagauugauacuaguguucaucccacuuuauccugaggaaauggaggcacagaaagaguaggugcaucugucucgucucacagauuuagcucuucuuaaacuacuaugucuguaaagcacauugggcguuagcagauacuaaaucaucuucucccaucccaccaaaggguauguuugacaaacuuuuuuucuuagaucauaacuaguaaguuccaggcaacgcacuggguacuaggaacagagaucuuagaauaagacacaguucccaucucaaggaacucacagugcagggagggugaaaagggcuugugagugggccaaaauaaauugugccuaagggcugccacacugcaaaaggcuccuaucaauuuuucgaguauggagacagccugacauacauauaugaagugcucagaacagugucuggcacacagugaacaaauacaaguauuauucuuguuaccucgugaaucugacccauaggucucccucuccuggaguguccuuccuucucauugacucuggagucagacugccuggaucugaaccucuucucucacaccugcuugugugacaaugggcauauugcuuaaacacugugcaucaguuucuucaucuguacaauggagauaacaccuaucucguagggauuuuaugaggauuaaaucaauuauuaccuguaaagcacucagaauagugccugacauauagaaagugcuugaagugucagcuauuauuauuaggagugauacuauguucuucucuuugcuugcagucauuucacuugcaauaaaaagacugaauuuaaaugcaucuggcuugguuaguuuaagguggauaggaagucucugggacuaaaugggaggagaacaggaccccugggaacuuggaggaauaacccuggaacuuguuaauuaagaucuuguuaaugaaucugcuuguuacuggucuauuaaauaaucacacaaugaaguuuaccgcacaaguaaagucuuuuucuuucuuucuuucuuuuuuuuuuuuuuugagacagagucuugcugugucacccaggcuggagugcaguggcacaaucuuggcucacugcaaccucugucucucgaguucaagcaauucuccugccuuagccucccagguagcugggauuacaggugugugccaccaugccugacuaauuuuuguauuuuuaguagagaugggguuuugccauguuguccaggcuggucucgaacuccugaccuuaggugauccuccugcgucagccucccaaagugcugggauuacaggcgugagccaccacaccuggccuaguaaagccuuuuucaaauucuugcucuuuccaauccuccuggcccagcuuuaacuucuaaagaucuugccuaaggggcaggcccuuccaaaucugacagggaccucuucaucuugucauacuggccaauaaagcauggcuauucuugcagccuaggaaagaucucuagggcagaaagcccucuucgacuugauucugccuaucauuccucaggccaaagcacugugccucugagccaaaacaucucccuccacaaaauaggaauagagucacuggcccuggaaacagaaaaauaaagaugcuccgagcuuugcugagaagaaaggcaaaggguaaacuucuuucaguggggauuuagccaauaaaauuucagcugagaugucuguauagaaaacagccugccaacuuacauucacaaaaagucuacaagaguuggguaacuuuugccccaaaacaccuagaaaaauagugcugcggucggucucagggaacacagacugucuucuguagcucagcuucaaggagggaauggcaugucagagggcucccucuagguugaacacucaggcauuucauaaacuauuuuagcccccaaagaccauuuugcucuugagacagacguagauagacaucuugcauguaccuauguguaugugaggguauggcauuuauacgguuacuuuuagauuacaaaacacaucuggauuaucuauuuacucagcaacccuguaggguagggcagggauuaucuaccaucucccauuuuauauaugaggagcuggggcucagagaaacagagacuuacccagcaucacacggcuaguaaaugacaggcccagagcuucugacugugcuguugcccuauugcugaaccguuccucuauuucuagucaccaccucccacuuguaaacaugccaggaggugcccaguguugugguggauccuguguggcccuucagacuauguccaagugaguagagccagcuggcaacucugcaaacucagcagaagaaacagugauccuggguucauuuacuuuaacaacaaguauuuaccaagcuaggcacuacgugaggggacacgcuagauggagucacauagggagacagacaugggcccaugggagaggcacaauuaagcaaauaauuacaauuuaaugugaugaguguuuuuaaagggggaauuauguugggggaaaaauaccauccccaacuccauaagcaaaguugacgagagcauccccuacugugcagguacccaaaacccccugaaccucucagagcaagccccuagucacggcucacugaaccuucuacccgguggcagcugcccccuggaaggguuaaagcuuaaagcagaaagccaaucugcagguguuggugacuaauucugacacugacagauuccucuaacccuccaacuuuuauuucuuuacaaaugagcauuugaaugaaagcucaaggguugcggaagaggacagaggaggcuggcaaagcauacacaccaaacccucuccagccccuucucggcagagcaacagcagugagaagauaagcgggcuggagcccaaggggcaccgcagcgcacaccggccucccucacaucuggccaagcaccuccagacccuccgcugggccaccucaucauaauaauauugcaccaagaaggggaggucugggcacauacagucacuugaucagcaauaagacaggcagagggaggcaauccgaggaggagcaguggcagagggggagccgggacagguggacagauccuccccaagacaggagacuggaugaggaagguacuguuugugagcagaugcugggucuucacccuuccccugccugcccagacuccucaguggguuuccauccucuccuuuccuccccacuaguccucacuccccuuucugcaaggccaaacaccucggugaaaccuucccccgagacuuucacccuagaugagugauuccuaaaccuuaaggaaaacaagaaucaccuaggauggcuacuugcugaauacacaguuuuuaggcuguauuccuugugauucugaagaugaagucuagugugggcccugggaaucugcauuauaaauaacauucuucaccccacccccaucccuguccccauccuccacuaucaccagcacaagugaucugaaacaggcaguccuuagaucacauucugggaaagccagccucagggaugacucucucucucucuugaaauccuagugcccuuacugucuguuauuuuacauuaucauuucuuuuucauauauacaguuuagcuacucaccuuaaccauaaggcugucaagaagaggaaguaucaucuccuacuucuuugauucccuugcaaacagcaccgagcacaacgcucuacacacaggagcucaggaaauguucguggauguagagcgaugaugaagauaagaggccagggaaggaaaaccacagcggggaugguggaguacagaggccccgccuggaaggaacuguuuuuagcaugccgacgugugccaggcuagaacaacgguuugcuucgcuuucuuuuuuuccuucuucaauacucuuggcacuacaugccuaaccucccucgcgaaagucaagccugagcaaugcaccucccagaggaaacuuugccaagaaacucugccaagaaucccgggugcuauguggcuuaguuuaacggccaagcgaguacucuaggcccugagaccugucacguuuccggguagggcaaaggauagagcuaagccugaacuuuaguaaaaagaugaggacccuuaaucuaacucacuaaacaucagcagggcaauggcccuccuucauucagcaaauauuuccagaguaucuacucugugccaagcaugguucugggugcucauggguccucuggugguuaagauagcauauguuaucagaaagcauuuucuagugacauaucuuuagaaaguuacuuuaaaagcaggacccuagaugaugaugagccucagagccacauaagcaccaaauggauauucucaagaaugccugguuauaggaugaagugcuauagacauccaaggucaggucucaggcccugccagggaacaauucuauucucacuucacugugagcaauccuuggcaauucuggaguucuuucuuccacucucagauacuacaguuuguccaaaaaagccaacugcuaccccuagcuccuuugaauaaauaacuccuucuugauuuucagauaucagcguaaaggucacuugcuccagaaagcuaucccugacucuuagacaagauuagaugcuccaacuucuaagucucauggcauguuauauuuccccuaugacagcacuuuucgcagcauccuacaauugcuaacuaaacuuugaaguccaguaaggcaggggcuauaaucuaucuugcacaucagucuauucccaguaccucgcauggugccuggaacaauguagguaugcaguaaauacagcugaaugauuaaaccaaugagugcaucacauuugaccaaugauauggcaacugagucaugucucacauacucugcgacaguuuuauccacugccaccaacaaacagcuaagaugaagcaguacuauuccuucugugggaccaguaucuuauggagguaaaacuggggcucacagcagcaccccaguacagacuccaggaggcacuucccacgaucaaagauggauucaauacuacagagucaauauaauguccucaagagccugagagcuauucuggccaugagcaacagacuugaguuucuuacaagucacucaacuucucauaggcucagcuuucucaugaagaggacaguggguacuucagcagcaggcacucacuuuaaauaaagaagaaaugacaauaaaaaucuccccauaccaugaugguaaguuagaaggagaaggcagcauuugcaaugaagcaucucugugguuaggaaaggguuaaacccaugucuggguucuuuuccccguaaaucagccuugacugcugcucagucugaaugaagccccaccagguuggccugucaggaaggaagcccaugcguccagacuuuuguuguucuaaggauuuuuuuuuuuaauuuuacugcucaggaaggaagcugaagccuaggcccuaacugcaguccugcugauuccucagccgagcaugcgccacugcccuuaccacuccagcgaccucucagacuccgcuccuuuucuagaauuccuucugaaccaugauuuuggcauuuggaccuaaaucccagacuuucuccuucaagaaccaaaaauuaagaacauucagcauuucccuuccuaccuaguacacaccuuugugacuauaugugggaagggcugaggacagagagggaggagaauugggugcugcaugaccuucagugacacuuuacuuccaaaggugagcugaacccuuccuuuaaauggagccaugaaggaguugauagagacugagguaucagaugauuggcugccaacagcuauuucugcuacaaacaugugugggcaugaggcucuucaaauaugagcuacucuauuuaaauaacagacucaaauccgagguccucaggcacagggucagucuuccccacucccauccuccuacuccccaccucucccacugacaugcagagucauucucugguauucccaagucccauggggcuuuuucucuacaaagagaaaaacacugaguuuauuugugcguucaggguaauggacagcccucuuuuacuccuaggagaaugcacacagacacuaugccccgcccaacccugcccuccccuucccccugcuaaucccuccccaggcagcccccccaucucaguccugcugcuguauuucucuucugaccuacaaggccccuucaagccccguccuaagcuucccccaagcagagacaauccaucaugcugugggacugugacacacacagaugggggaagguucacagauuugucucacauaggcaagaggguaaaacugucuguauaacuuaaaaucuaaggacacacgagaaacccagggauugugaauucuaauacuagucaaauacuauuacagcaaaucucauuacguguaguccaaaucucuaucacacacaaauucuaauaacccauugauuucaaacaauauccaguaauauaaaauuucagaauaagaaaauaccaugagauuuggcuuuuuuaacccgggccacugccuagauauccaacccgagucaaauccucucccgacucccagacucaguuucucuaacucgacuauuaccuugcuucuaaauaaaacaagggagaaagaggucaggaggacaccagggcuaauccugguggauggauaauaaugaagggaggagaagcagcuggccaucacagaaaagggcuuucaagccuuucucccucccucuuuccacauugccauaaggcaugagugugugaaaggacccuacauacauugcuaguuguuaaugacccuguguuuggcuacaucaaugcuucuaacaaggaagguuuuaccaccagauuguccuugaaauaacaacaguaacuaaguauugaauacuuaguaugugugagaaacuguucuaagcauuaucuauguguuuaaucucauucaguccuucccaacaaccuuuaagucuguauaacucccauuuugcaggcaagaauacugaggcccagagagauuagguaaccugcccaguaucagaaagcaaguaagcuaacacgucaggacuuaacuccagaggccaaacucauagugacuauguuacauugccuccccaccuuugaucugaaacaccuucgaguugaggcucaaagggggcaaauacagcuuuuauuccucuaacagguauuuauuaugcuaggccacucugacuuccuuuaaaucaaacccccagaagcaaggucaaaugagagcaauauaggauuagcuggcaccuaaaugggaaucauauaccugaaaauaaagcgaaggucucuccagggcuggcccuugcccccucccuacagcuuucugucucugcugcacuaagauugauguaaagccauaagucuagccugaauuucaguggaaaaagacaacucuugccugguaagucacacucaaacuuacugggcuggauuucucauaagacuguaccaaaagguuccuucuucacucacauagcuccagauuuuccuaaagcuucagaucuguuaacagaauguacuggacacagcaccaugucuccccagcaaaaacacaacuuucauuucuucuaggucaucuuaaaccagaacgcauuccacagagaaaacugacagccacauaucugaauugccagaugguuacaugugucuacaaaaccuccacaucacuugacuguuugcaacuuuggccaggaucuagguggaaacuuuuuucuaaaauacacaccaaaagcagauccguauguguggacuccacgauaggggauguaaugcugugggaaaacauuuggaaaggggauaggcuccaaucuuagguuucuaaggguuaggagaaaaaaguagauuuaaauuuuuguuaaguuauaaacgauuuuuuauuaauaguaccccaaguaauaaaauaagucuauauuugagaaaggugauuucacaaauucuuggaaaacucccucccuaccuucaucaucaugaaaccucaaggcauaaauaaguucuuccuuucuuuccucaaaccucuacgccuuugggauagcauacauagucuuacagaugcuguucugugcaaugcugaagagugguaagaugaugaaaacuuaaaguaaaaacuagauuauaaucgccaccacuaagguauucaauaugcaaugaacacuaaacccuuuuagaugauugguaccagacaaaaaauaauaauuuuuuuaaacacuaaaacuaaaguagugugauuaagauaacagaaaaguccaauccauuggguaaggcuggaagaugauaaauuccuucuguuuacuuagcaucuaccagguguucugauucauacuacagccuaucauuucuccaggcucaacauguagucccaauccaggaucuuuucuuggaaaagguguaagaagguucuuucgcagaaaauucuucuugcugcaaagaaagagauacuuacaaauuccuacccuguagcacacaugugaaguuacaaaggauaacaacacauucuguucaaccauacaugccacaauuuaaaugauacuuaaaaaaaauuuuuaaaggcauuuuagcuaauauauagcaauaaauuauccuuaagucugcaguucaucucucuuuaagacgggauaaaauggcacugggaaaugcuguuaaacucuuagcagcaaauaugcaaguccaaacaauauugcuauuuugguguuuaaaaauccuguggauuuuacaaugcaauguaccaucacuccaaaucucaaguauuuauaaagagcacgucccaaggugugcuucgauauuuauuaaccacauggaugugguuaauaagaguuaaaaauaagaaaaacuauuauaaaaauauaacuccauuaaauaugcugucacuccaaaucucaauuauuuacaaagaauacauuucaaugugugccaauauuuauuaaccagauggauguaguuaauaaggguuaaaaauaagaaaaccaauauaaaaauauaauucuauuuuucaguuuccucuucccugccuaaugaggaaaggggguggggagggacagcaacuuuuguuauuuggauacaauguguguguguuuuuuuuuuuguuuucaaacaaaaaagggccaccaaauaaucaaccuggggccgcugaccggaaggcagccccggaaaacuucccgugggaagaguuccagaaauugcccagacuuuaacgagccccgcugugcuggcugcgagccucagaggccaccgcgacucgccuugcccgaaugccagcaaucccgccgaaggacggagcccuggacuucggaaacauuccccggaacauuuuuacagauuugaaaagcaggaagggaaaaacauuucaagccgaaaggagaagccucagaguccugggggcaccaaggggccagcgagguccccaggcgcuguacacacguccaaccucccuccuccacgcgcccugcucccccaaccuccucccaucccuccuucuccaggcagaacccuccccgcgcaguggccauccccacgcccgcgcugugucccccucacgccccgugcacccacuagcgccucccgcgcgcucccaugcaccccgacgucgcgugggcgccccccccuuauccgucaccccgguucccacucucuucugcucagacggcguagaggaaaccgaucggggacuggguucuuagugcgacuugggggugcagggacguggagggcgaggcggggcagggcggggggcgcgacgggcccucgugugugcggccgcgggcugggcgcucccggcccucgaggcggcgcgcggaguccuccugcggccuccaagugcugcagagcgacggcgagaucaccaacauuucugaaaccacuugcaagccgccucgguggcggaggcugggggucccuugcaaguaagcgaacggggcccaccccguggccuggccuccccggggccaguucucgcgccucuccgcgcccccucccccagaagaucaauuaccagccacccuucugccggcagcggcgaggggcuggcgggcggccgcgagaaaacggcagcccggaucacuucugcaugacaauugaugggagggagggcgcggggcgaggagggaggacggcugcgguguccguuuucucaccauggugauuaggcauuccggccguaagaggaggcagccgccgcacagagcggcgcggcguggagcgagggcaggggaagagcgggagcacaacuacagcgagcccagccgccaggcgagcggcgcgccgagccaagccaagccaggccagauggcucugcagccaucagggacugcucccguccagccuggccccacuuuagcugugcaaacauuucuuuaucccaacaagacaauuaaacccagcagcaugaaaaagagucuccaugacuguguugggagugaacaaccagaaacaaccacacacaucacaggaguucuugcccccggggaguaggggagaacccgggagcagcugagggagagucaggcuaggucugggcagucaggacagagggaagcaucugacccaggucuucuggcgauuugcugacccuuucccaguggucaucugucccagcugcaacccagaggugcagccuggccaccuggcaugccccaaacauucucccuagcaagaacaacucuccuaaaagcccaguguagagucccugcccaccccagucccagagcccuuggaaaguauccccccucaccccagcccuccccauuccaggcugccuuuggccuaggugggcucagcugauuugauuguuagaacacagggucuucaaugauacaugccuuuauauaaagacacagaguacaaaauaccaucuccuacucagggcuuuugggacccaagaauggcuguucaaguacaucaaagaugagagcaaagcagaacauccaggagcugcugugagccaucagguuuccugccuaccugugacucugcccgaccacagugaaggucaaggaaagagggcaaagccaagccacguguggucagugcccaggguccaucccugggguaagccagaagacagggccagucgccgcuccacgcgggcaguucugggcccucucagcccuguggugagcauguauacuucgccaacuccaaucugggcugaguggauaggcuggcaggcuggccaaagacugugucacacaggcaggaaucugggcacaggggcagccugaagaggaccaucaggauaugcacaugacaggagccagagugcuaaggggguaauaaauguacagauucuaacacaagacagcagacaauacuuaucuucccuuuuguugugaaguuuccuuaaugaggaaauguuuauuuuaaaggcccugggaaacauggcuguagacauuucauauguaaagcacacgugaacuacuuguaauugguccguaaauuuuagcauuauuucccuggacaaugagucuuggggacugauucaaggagugacaauaagcaggaguuaccucagucuccuuccuggggaauuaugcauccuccaugaauggcuucucacaaaacacuucucccauuuuccagggcaaguaagucaguccugcagaguaaaggcugcuuguuuuuccauagagcacaacaccucccucaggaaucaccugugaagccagguggauggacaggcaagcaaaccagaaucaucuaucaggaaagaugaugcuugacccaaaucgcuauauuucugucuauaaaaaugcauguuuaaccacaaaagaaauccugccuaccaguacccagauuuaaggaaagaacaugugugcauuacaccaugucugcaggccucucuuuccagugggcucacaaguggacauaucugcagauugauguagugugugagcaggggguggcugcagcaguaaaaacugucaguguuuccauuauacaacugauuucuuaaugaccuaaaacucagucauaaaaacuucugcucuaaguaaaggacacacaccaccauucucaucucccacccccacccaccaacaaaacucuaaagcuaaaugcuuacuucggaguuugacugcugcacuuaauuaaaacauuuaaaaaauauuuuaugaaaagauauuuauaugaagagaacugaaaaaugagucaaccauaucagcaauuaacucuaaauuuuaagaauaaauauauauacauauauacacguguguguguguguguguguauaucaaccauauaugguuaauuugggcaaucuggcgaaagcacuguauccuaucacucugcucgucugaacacuuucuauccucugucuuuucauauccccauaccccgucacugcccccaucugccccugaagcuuucucucccuuuggaagcagucuuguauacugucacucgauuaucugagaaauauuacuuauuucaaaacgguucuguagggaggaccugaaaggcaucuagugggaauaaucaggccuucuaacgacccuuaaauauguauuuacauaaaacagaccauaaauauuccgacacacgucggcauaugacaggagccaagaaagcugcugcagacuuugucuuagugccucuucaacccuuccuuacagaaaaauacuucuccugccuuccaaaaauucgcaaucaaaagcacaaacgcuaucuaguaugacccagugagggaugugcuaaccaccuaagguaaggaagggaguaaaaagcacaacuccagggugaccacaggguagcacagccuccuuuucacuuugcaccuuuguuuuuuauuaaagauuagucacaaaugcaacucuggauaauaacgaggguguacgaacacccuccccucacagacacuccuauagguuuuaugcuuguguacaagaaaaaaaaaggagaacacaggguacucuauaagggaagacuauuuuaaaugaauaaaagaggaaagggacuccaauuuguauaacaccgcauuggaaauaaagaaguuuccccacccuucugaucagaaucucauuaauuucaaggucagaauuccauuucacuuugggagacagacucauuuaauuuuucuccacccaggcguacuccugugugagggauccaucuccaugggggaugccaccaccacacaaugcaaaccaggcaaacagaagaguuauggcuuugacacucagaggggaauggauauccacgucuaugaguucugacuugacuaacaagcuuccuccugcucuggagucggauacagguuugggcuaaaaagauagaaaaauggagacaagcuggaucuguuagguaagaagaaagagaucucaaucuccagauguuacuuuguggcauauuagcuaagagaagauuucauuuucaacuuguauuuggagaaaaaaaggggcggaaucugucacacccuaacacaaggcaguuuuggcuggaggucacauuauaacuagccuugaucacuugcacaucacuggacaaaugaaaacuaaaauaaaaucaaaugaaccaacacaaugccgauaccuguucagcagguauauccaagaagcaggaucacaagacacacaagucaacagaaacugaaaaggugaaagagaaccaaagccaaagugagagggcaacacuagcaguagugcugucagccagcagccuucucccuuaaguggggaggucuccggcuuacagaggcugacauaaaagacacacuugcaacauauuucaaaaccaaagagcgauggauuuacaaggcagguugauuuuaugaugacuuuuauugaaaagguacgcuggguuuaggcagaugccuuuuagcgcagggaaguuaacacagugccuaauucaaggagacagccugacgaagcaguggcgacaggggagagagcugcaaugucucuauuacucuccucggcaucauaaagaggagggaaaaaaaugguauucguguuggugguuauagagaggaugggagcacgaaaaaauagagaaaaguggaaggcaaaccucagauguaguuuucuuaagaaaauaaaaugaagcaaaucugagaacaaaggguugcguggaaaaaacacccucaguucauaaauucucaccaggcuugaagaaaacugcucugucuacccacagcccaaaagcuucaaaacacaauuauuuucugauuauauuagagcaaaagauugcaggguucagcacuccuagucuacaaguuccaaauaaagguuuaguuccagcuauaaguguagccagagcccaacaaggcacuuggagaacaugaaaaaaagcuguuucauaagcagaaauuaauaauaguugugaacaucaaauuuggagcagucacacaggucaaccgugucuaguccuaaaagugagccccaggauaagcauccagcaaaccugugaaaucccaagagaagucggcuuucuagccuugcgaucgcaaggaaaacacagcugugugaaaugcuuuauggugauugacgacaccuuuguccuucucugaaaaauagccugauguggacaagggcugagaguugugaaaauagaaucacguggagucugcuggaugugauacaauggaaaagcuaaaaaauaacacugagaucagacaaacauaacgaggacagcaaagagaggagggguggacauguuucuuuaggccccccaaauucccuaggagccgacacuucuuaaugaaaugacauucacuucaguacgucgguggcaccccucuucacucaaguccucagagaauaagcccacuaggguccggagagaaaggcugugcuggggccaacuugccucuggcuacuuucagaaaaauauuucaagaacuaucagugcucacugauaagagacaagcaaagguuagcacuccacagcuagugaaagggaaguaguuggcccuuccuauuacuaggagcaugcaaaacgccaccgaccuguugaacaucacggugaggcagggcuuacuggggguaagggagggcuggaaccaaaguacuuacaucugucauuccgauccucugggcuagaugaggcuucccgaucagaaaugaggccagagacagcaaaaaucuucuucccagugucaucaaccuuuagugaaccgggggagcuagauggcagcugugucccaaagucauauuccuugccaucugcaucugagaagcgcaaguggggagacucugugucauggcaguucuuaagucgcuuggccggcguaaaggcugacugauagcucucccgguccucgguggaggcaaagggccggaaagcccccacaccacuaugauucagcauacugauuggggugcaaucuagauuugggggagcaaauugaggguggagguguaguagagaaggggggaaaucacgauuggcaaaagugccuggcaccccaccuugccgaugguacauagaggcaaagguauaggaaccguuggugaaaggaauaugcacguccuugucaacugagacagguacaccaaagggucguggcugcugacaagggauggaagcaucacggcuggccucagccguggaugccaggaccaucagugcuggggaugccagaggguugggaagguaggaugaguucuccaucuugaaggcugcccgguguaaguccaucggagucucuuucuguggccggcguuacgcaagaagcagucuucccugggagggaggccaaccagcacuuugggucagggcagggaauauuacuggggaaucauucccuccuaagaccuguagaaacagcaaagagaaaaaaagaagggggaggaaagucagggggaggaaaaaaagggaaaccccaagugaucgaaacaccauccuucuggcucacagaugcucgggcaagagacaccacaggcuuuaggagccagugggcagcagcaucagaccauuuucauucaggaaaaucaauagacaacuuacugugauguacgcguagcugacuuuggucccuacacguucugggugaaaugcgccugagcccagcaaagaaaaaaauaucauaaaaccuccaaauacgauauucucugaacaaaugagcuuuggaaggccaagccauccaguagauuaagugggggucuauguuuuaaagugcuuccaccugcauccaccacucauggcaggccugauguucagagaccacauucuaccuauacgauuccccacauaugcauccucucuucaucuccccuaacaacacccugauacugaaauaucccuaauucaaguucaucuagaccaggaacacuuguacauauuaguuaguacaaaguauacacauggauaaaagauacacauuggcauauacacacacacacacaucuucauguaucaucuaagacuguuuccagaaaaaagugcuauaugaacaaacagcauuaacauuuauuuugaggcacaccucucucuaaucacaugggcuuucuauuucucuuuucugagaaggaacaaaaccuucaucaauaaaaugccuggcgucucugacaacacuuaaaaccauaaugggugccuuuggcauacgcucucuagaagcaucugucuucuaagggcagcaaagaacagaucggugauuuuaguuacuaaugcacucacucuuaaguagauuuguaaacugccuuggauuugccauuaacauuuagaacaaaauguuaacaaaauuucugacuuauuuugcucugcuuauuggcccagucagagcugauguccaauaaaggcccccggaacaaauuggaguucggagagacuucuuucaguuucccuuguaaauuuagguuguacauuuucauagucagugguuccauuccaaaguguauuuugagugggggcugggagaagggcuauauaucaaaagccgggacaauauaagaugaauaccaagacuuauuagugucaaaaauauacacgaaauagaaacuuagugaaacucaaagcauaaccaaaaaucaccgucugcuacaaauuauaccuuuaaauugagagucauaucagaaauaaaaucuaccucgucccuuuuaaaaagcccaccuggaguaucuuugguauucccucaaacagagaaacaucaguuaaacgguagaugaauccuccuggcuuaaugcagugcaaagagaguauuuccuucucccauccuguagcagacaugucaaugacuguuauuaauugggaagaugaguggacaccaucagacugcuuccucauuuggcaucuuuccuuauagacaucauugcuaaauuaccagauuauguaucucacauuaacggauuuuucucucuuccaaauuuuaaauaacuuuccugucaaguuauagcagugcagggaaugaucugccaaggacagccaguuaggcugacaagucugggaauccuguucuuggcuguuuucuagucagauuaauggucauacaacauggacgcucugaaagugggucuagggcuguuccaaggguucuaagcagcucuucacaacagaaauagcuacuuaucuaucaacaagcaauauuauaugaggaaaacuggagaaaagaaaugugaagggaggaauguuucccccucaaaauacgaccccccccaggauucacuugcuauuuuuacuuccuagaucaccucauuaucuuaaaugaguuucauaaauuaggaaucuggugacagcaccggacacuccaacagaaccuggugaaucacucaacccugguuauucauuugaaaacuucauuacacugaaaauaaaucaacaauauuuuuccaggccacaucucuuuuacuucauugcgugggcguuggucuccaugggggaggggggagugcuuuuuuucuuuuuuuucuuuucccuuuucuuucuuacccucuccucacauuaacaacuuguauagaugaggcuucagcugaccacagucauuaugaaaaucuauaguuaauacacucccaaugucaaaaugucauggguuuaaacacagaacccaaaauaagaaaacuaacugacccucuuaauuaaaaaaauauggauuguaagauaaucagcuugauggagcauuugggugacugugaagaacccggcaaagggaaaguaaguaacuguuacuuuucugccucuaugcugauuuuuuuuaauuuagcacuucgugcaaauccagauuaaaauaacuccagcuauugauccgagcaguggaauugacauuaauuuuaguucacuucucacuuugcaaagggaucaauaggaaguaauaacagcugacauccccgcugaaaggaggagaaagaagggcugaagacagaaaucgaaaagcaaccaaauaaaucaucagcuacuuuuccacggcaucagacaaacuccaaacagauugcaaaaagucuuuguugaauuaacuaaacaaggaggagggaucaauccacgaagcuaaauaaauugucuggcaggcagugagguuggacggagggaccaacaaauauugaguuaaaaaauuucaaauccuugacgugauggguuugguucaguuccguaucugugggaguuuguuuguuucuuaaaucacacuccugacccugguuuaaagugauugcaaaacgccagcuaucugaauaauuagugagauuacuaauugcgugguuaaacacgccagaaccaagacaaaugaaacgaagacguccgcguuuggaacgugaaaaugucugaggcugggcugaugcgcagcgcuccgcgcucugcggagcgaacuagccacuuucgcacagaaaaaccgaaagcccaagagaaagucucagagaguagguaaucucccaucccaguccaaggucugggcuuccugaccugcgcccgggaucggcauagaaggaagcggugcugcugcccccucugccuccgccguagcugagagccaaaccccuuugcaaaugacugccacaaagaaagcugcaaagggcucuuucccggagccgagcucagggcgcccaccaaacuacggcucugcuggcaauuaaaaugcacacacaacacuccucugcuuauuacaacaggugacaguuuuguggucucugaaccguuuccaaaagccaggaauuaaaauaauagaacaaauuaaacgauauuuuuccuuugcauaaauaaacuuuuaaaaaaauuaacaaggaacuuaaaaagcaaagaacaaugggaaaugaggcagaguagugggggguuguuaagaacgcaggaaaaaaauuuuuuuuuuaaguucacagacuucuucgcuugaagagaauucccgcacaccaaaugcccaggggguauuuggaaacaccgcucuaacagaaauuuuaccaccauaugcgagagcucagggaacauaaggcuaacacaguucccgggcuagggccgacgccuguguuucaggcauggccggguauggucccagauuuggacccggguucaggcccagcuuggccaaagggugcgaauccgagacagcccgggccaguccgagagugcggggucgcgggauacuggcucagcgagcgggugcauuauucagcucggaagagucucgacugggaaaaaaaaucaacucuuuuagggaaaacgggggaagaagaggugaaggcgaaaccuacauaaacuugggcccaacgcggagccgagcccacuacucuuuggcccgaccucucccuccggcucucgguugccuuuguauauagaauacucugggucccaacaaccuccgcacgaaacaaucugcgcccaacuuugggcaaccaaagcgccaguccaggaagaaccgacacgugcaagggccccugguccgcagccgcgcggggcccgcggggcaggggcucagagcugccagccuucgaccaaaguccaaggaccuccagcccccgagcagccccgccccgggggucacccgggucccgccgccgcgcgcaccaccgcuucagcgggcagccgcggacuccuccacucccgcuucuccugcaaauacggaccggcgcggggcugccgggcccuuccagcuccuggacugcggaugcgcagugcgggagggaggguucugcggcccgcaccgcggccguccggccgccgcacaccgcgcggcucgcagaacagguguguguccccgcucgcuccgcgcccggccccggcccugucggccaccagcggcgcgacgcggcgccgccccguccucggccuuccccagccuugccucgaagcgcagcaagcgaacucacgccacuuuugccgggucucugcgggccaggagggaucggcacggaagacgccagcaccgcucuuccucgacgcucuuucugccuuuccccccucugcucauuccccuuugcaggaagagcccgcgagacggaaagaggaggccaggcaaggcaaagccccccugcccacucugcuccccccaguccccucgcugcuuccucacugccgcccuuuuuuuucuuuauuuuuccuuucucuccccuuugccccucaagccgaguccggagcggaggcgagaggcaagauguggcugcugggcgucgugggcagcgagugcggugcucucccccucggcggcucccgggccagugggccggcgcagaccccagacgacccgggccggccagguagggcugugcccccacaccuauggcccgggccccaugcacccacccagugcgacgcgcgccuggcucagggccggaacacgggcucuccgcuggagcugcauccacgacccgagaaugcagggugugcuuaacgggaagcgagagcuuucccccugccuccuggcugcccuaguccccgcuacuucgggacuccugcgcgcccucgccagcuggggucgaccugggccgcgagcucucggagaggcuccuggacugggggaugaaccgggcauccccucggauggccucaccaccgugggcggccucgcccggggggccacacggaagcucuccgcccaaguuuguugugcccuggaagaaaaggcuuucucuuacaaagcacaaaggcgaaacgcccaggccgagcccugaaaagccccggguuggggggcggggguggggugggggaggccggaggcuccggagugcgguggcggggcuggguuccgggcagagaaggucgcucggcccgggcugacaagcgcggcggcaguggccgcaggaccgcagcgaccggcgugcucacugaaaaguuuuguucuuaagucagaagagaaauuguuacucaguuuaaggcaggucuaagauaaaaauaaaacuacaaguagaguagucaaguagcccucgucuccacgaucguccucccgccuugcucaguagaaccgcugggagagggggucccgaccccgaaaaucccgggagaucccacgugucgggcuacucuacggccaggccgguccagcccagaggaguggggaguuuaccgguggcguuuagaacgguccgccucuaugcuagcaccugccuccuuccugcccgcagaggauccauccauccuaccccaccucccucccuccacacccuucacacccgcccccgcuaggaaaaagucagccgagcacccgggguccagggcuaaacagccacuccccggguaucccgcggagccggcugugugugggguggaggcugucgggguaguuucucauucggcucgccccuucuccauccgcccgccgccucgggcuccccacugaguaccacccagcccuggccucgccggaaaucaacgcgggguacauaggggagcccggaaaucaccggggggugcaccagagagcccggcgagaaggcauucucgauaucgacccgaacaaagugggaauggggcuuauuaagagacggagaaaagaaguccugcucccuucccuugcagugcccucacccucccaacuuguccaauucccgcgucuggucccucccccuugcaccucccccccuccccaaauaaaacacauuaaggaaaacucaagacggaaaguuugagcgaggcagcgcacggagcgcgcagggcgccgaugccgagaggcuccgucgcgaugauccaagacgcgccaguccgagucccagucccugcccccguccagagggaaccgcccgaaucccuaggaaacggacccggaaaguuagccagguuccugaacaagccggccgcccucgcacccaccccucuuggguacgcacacacguccacaccccuuucugaucuccauacuugccguggaaauuccuugggagaacggucgcacuuuucaggacacggagggaagcaggcggagaguguggugcaugaaaagucccggguucgcagagccggcggaggcagcggcggcggcggcggcggcagcggcagcagcagcagcagcaguaggcggcuggccccggguuuguguucgcgagcugccugggauugcauguacagaucaagagacucaguuggcgugagagaaggagcagu

SEQ ID NO: 191404 - RNA, 7227 nt, Homo sapiens
gcaccgccggaaguuucugccgcggcuuugcggggacgggggagugguagugggggcugcagcugccggacccaggugcggaagugcgagggcccagguggcugaaggggccguuaggaacauccaagcgguggggcacaggcagauccccgaccugaccuggaccacccuucuccucuuggcccgccccuucaacucgccuccgcuuaggucuggauuggccccgcccccugaccugagccugguccuucuucaggcacugacccuugaccuccgguggcucccccaucucucaggcgcgauggcuacgggcgcggauguacgggacauucuagaacucggggguccagaaggggaugcagccucugggaccaucagcaagaaggacauuaucaacccggacaagguagcaggggcaccugaaagcguugacuaggggaggguaggggagugaagauggggaggagugacaacgggcaagggaugggugcuacacuuacagugaguugggcgauaaaaggggugacauaacaggacagggaauaugugucauccuugaugggagggaggagaugggacaucgugggagauggugggaccaagaggguaugacaccucuaagagcugagaggaccaggcaagugugauuuuugcaagauauuguuggggagagaucaagacauuguaacagucugagaguuggugggauggggaggggacugcucugauuugggcguaggaugguguuccugggaguggguuucugugccuuuacagugugucaguuugccugucauugacccuguaggugcugcuuuguucagggauugagcuggacuaaagaauuuucaggaaagggucuagguugugguuccuuucugugguuuccuuccucagaaaaaauccaagaaguccucugagacacugacuuucaagaggcccgagggcaugcaccgggaagucuaugccuugcucuacucugacaagaagcaaguauuggagucccaagucccccagguuuuggccccugauucaccugccaugccccuaacuccuaguuuucucuaacaauuuucuccuccccagcaagggcuccugcuugcuuagcaggaugcaggaggaccugaagucuuuugcuccaggacaugacuuucuugcuauaggguaggguagaucagcucccugggacaaaaagcucuuuaacacaccuucugauucuaaccucgcaucucccuaaaccucccugccagggaugcacccccacugcuacccagugacacuggccagggauaccguacagugaaggccaaguugggcuccaagaaggugcggccuuggaaguggaugccauucaccaacccggcccgcaaggacggagcaauguucuuccacuggcgacgugcagcggaggagggcaaggacuaccccuuugccagguucaauaagguaagcuaccuucauucggacacaggccaagauugcccucccacuuugagccauuugugcgagcucuccagucuccuaggguugguucugggggcacgcuuaugcccaacugugauuacccacucaauccucguggcaaaugcaugcagaguaggacucugugggucuuuucugcccaagggauccuguucuuucccggaccugcucugguuuuucauggcuuuucuuggucuuucaaauguugcuguuccucagagcuguauccuaggugcucuagucuucuuguucucuacuuucuuaguaugaacccuguggcuucaguuacccucucuacaagucaccaauccagagcagugcuuccuucgcauccagucauuuacuaauaucucuuucucaaugccccacagguaccuuacaucagguagguacccugaacagagcucaucaucuucccucugucagucccaaaucuguuccccaucucagugaauggcacuaucuuccacccaguugcccaaaccagaaacuugggggaucguccuugacuuagucuucucccuuaguccucacaguauuuaaaucaacaacagaacaaagaagguaggggaaaacaaacaacaaacauguaaggaaauaaauuggagucuuucaaauaagagccgucaguaacacgaaaccaggauuugaauggauaugaaaugagauaaagagugaacuuguagguguaggggaguccuaccuuagguuggucagggagggucugagaacguggcauuugagcuggaugccagugauacaucuauuuauugaguccuguugauucuuuuuccauaauaaaucacaucucugacuauauucuucaucacuaugccagcccccuaguccaagcugaguuaccuguguagcucagcacagcacggccuucccagacucacccauucagugagaggcagagcuagauugggcuagguuuccuaguccauuacuuaagucauuguacaguguggccucacagcugcugcggccuggaauagccuagacuuagauccuaaaagccucauuuaccucuucucuaaccaaucuuugucccugggcuggagugucacuuguuauacccuauguaucaaacuucccacacgguaccaaaauuguuuuuucagcugcaguaugagcuuugagaggcuaggaucccugccugucauaugcagcacugugucuccagcauagguauugcagccccaugguaaauauuuguugaaugaaugaaaaaaugucuuccucacuugacuaugagcuacuugagaggacuggcugcacaguuccugaggauuuuuuuuuuuuccuucuuugagacagggucucuuucugucugccaggcuggagugcaguggugugaucucagcucauugcauccuccaccucuagggcucaagcgauccucccaccucacccuccugaguagcugggaccaccggcaugcaccaacaugccuggcuaauuuuuguguuuuuuuaagagacuggguuucaccauguuucccaggcuggucucaaacucuuaggcucaagugaucugcccaccucagccucccaaaguauugggauuacaggcgugagccaccgcacauggcccugaguuguugguuuguuuguuuuuuaguuaaauugaauuaaaaugcauaggagaaauauguaaccaaaccugggaaaccagagagacuucccagaggagaugaugccugagagcucgaaagguugagaaaguuaccuagguagaaggaauguggaaguggaaggcauuucaggcaagagcagaggucaagggggaagucugcuauguucuagaaacugcuagucauuuggcugcaguuuaggguucaugagggacaguggcugcaggaggaggccaggucauuuauuuguauguucauuaauugauuugguagacacugauacauacagugugcugaguccuaaaggugcgagaugaacuggacaacccuugcucuucaggaguuugugaauuaucuagaagaugcuuuaucuuagauggagagcuucugaggaguuuaauaagggauaguuggggguaaugauaagauauauauucuagaacacuaggacagugugucucaaaucaucuguggugaaggacauuuuucuauuuuauuucuaaaccaucagagacugauaaagauaauaaaauuauaaagacaaaauacaaguccauguuucuucauauuagauucaacagcauacaauugcuguaaaauuguuacguaaguuuuucaguguguacucucaguuuccauucucaucauagaccagggguaaguguaaacagcacugguuugcagacuauccuuuaaguagcacuguucaaagagaucacgucuuagcugcagauggagaauugauuggaagcggauugaaugugggcagagaucaguagcgaggcuauuucucugauccaggcaugugacaguggguaggccgacggagaaguggcaauggagacagaaauuuuggagguaaaagccacagauuuggugaaggggaggagucaaggggaaagauaggaauuaagaugccucccagguuucuggcuugagcagcuggguugggugauggugauauugacugaaaucuggacuggagaagauaauguuugagagagggccaugaguucaguacugagcuaaguuugagguuccuuggggccuccaguaggagauguccaaaaggcgaccaguuuuggagcugguuguggucuuuaacugagaagagagacuucccugauguagucuagcacugacuccuuccuugggucucugacagacucagcucgugguagugcuauuugucucugggggaggucuguggaagaagggaggaaggggcauuggcagggcugcguauguugguaguaggauucaggcccagcuucuguagagaugccugaccuuggcaaacucugggggaguggcaagucccacugugcccacuggguggcaguagugcuucagaugaguuguauggacuagggguugcugggccuuucuccagguaauuagccaucuguccuacuccagaguugaccuuuggacuccacagaagcacuuacaugugggccccucaccuuaacuaugggggcaggagugugugucccaugacugaggcucuggagcuggagacagugaaguugauccuggaauaaaucagaggcaggcuacagucccaaacccugcuaggaccucuagucaagcagacaaguucuuuccucacuccaugcugcaggggcacaggcccagggucuggcaacaaacaggagcagcuguggucacuggggccuggagccugcuggacaugacaucaugcgggcaugccccuacugugucccucugugcuaguagacugugcaggugccuguguacucggagcaggaguaccagcuuuaucuccacgaugaugcuuggacuaaggcagaaacugaccaccucuuugaccucagccgccgcuuugaccugcguuuuguuguuauccaugaccgguaugaccaccagcaguucaaggugagccauuguguauuugcaugggugcccagcuucugggucuagcaggcccuacuuuuaugccaucucuuccacaugccccugaauguucauuccucuacccugucuugcuccucagaagcguucuguggaagaccugaaggagcgguacuaccacaucugugcuaagcuugccaacgugcgggcugugccaggcacagaccuuaagauaccaguauuugaugcugggcacgaacgacggcggaaggaacagcuugagcgucucuacaaccggaccccagagcagguaagcccaaggccacauaccuguccuccaugccccaaaccccuugcucauugucuccauccuccauccccucaacucccacucccaggucccccugccucccacugauaccuuauuaacugccccaagcccauuccuacuucucaugggccauccccccugcuuuucauagcccuucaccucccucaugauccauuacuucucagauucccucacagacagcccagcacccugucaccuccgugucuacccucacuccuagaagugcccucacacacuucgcaucccucacuuucccagguggcagaggaggaguaccugcuacaggagcugcgcaagauugaggcccggaagaaggagcgggagaaacgcagccaggaccugcagaagcugaucacagcggcagacaccacugcagagcagcggcgcacggaacgcaaggcccccaaaaagaagcuaccccagaaaaaggaggcugagaagccggugcggagguuccgccagccuagcucaggguggaagggucaccuggcacaaggccucaccccgaguggaggguucugagaguacccagugcugauggggugcuaggacuaacccugggcccucucccugugacaccuuggucuccauaaugccuucucccccaggcuguuccugagacugcaggcaucaaguuuccagacuucaagucugcaggugucacgcugcggagccaacggguacgugagucaccuccuuuagcaaguuuggguccugggcucugcucugggcuccaugugucccaaacgcugcaggcagguggggauggagcaguaggagagauugcugcagacagagguggccuuggcaggaucucagugauguggccaggcuaaggucauagcagcuuucacuauauucagcuuccuggcuauuuccuuuucuggcccauaguuaaccuccauguguuaccgucucucuuccaccaucuuucccucugccuuuuguccccuucauccuaagccucuuguggcugggacaggcuuagcuugccagcuuucauugcagaugaagcugccaagcucugugggacagaagaagaucaaggcccuggaacagaugcugcuggagcuuggugugggugaguguggggacugggccccauaggguguacccacccgaggcuguggauauagguugggcagggggaggggaguucacauugcuggcccucuaccacaccugggcucugcccgugcugccugccgccugccugcagagcugagcccgacaccuacggaggagcuggugcacauguucaaugagcugcgaagcgaccuggugcugcucuacgagcucaagcaggccugugccaacugcgaguaugagcugcagaugcugcggcaccgucaugaggcacuggcccgggcuggugugcuagggggcccugccacaccagcaucaggcccaggcccggccucugcugagccggcagugacugaacccggacuugguccugaccccaaggacaccaucauugauguggugggcgcaccccucacgcccaauucgguaagagucuggacaggcugggaggcacgccugggcccugcgagugagcacaugcacauggguguaggggcuccucucccucuagugccugcagcaggaacgaucaucacuucugugcgagucugagacugaggguaggaguggguugaccagugggcguccuugucccugagcgugugaagcacaugcacuaagccugacucaggccuuggggggucacugaccucaaugccuucuguguauccucagagaaagcgacgggagucggccuccagcucaucuuccgugaagaaagccaagaagccgugagaggccccacggggugugggcgacgcuguuauguaaauagagcugcugaguuggaccaggc

SEQ ID NO: 191405 - RNA, 33802 nt, Homo sapiens
uccaccauuuugcuagagaaggccgcggaggcucagagaggugcgcacacuugcccugagucacacagcgaaugcccuccgcggucccaacgcagagagaacgagccgaucggcagccugagcgaggcagugguuagggggggccccggccccggccacuccccucacccccuccccgcagagcgccgcccaggacaggcugggccccaggccccgccccgagguccugcccacacaccccugacacaccggcgucgccagccaauggccgggguccuauaaacgcuacgguccgcgcgcucucuggcaagaggcaagagguagcaacagcgagcgugccggucgcuagucgcggguccccgagugagcacgccagggagcaggagaccaaacgacgggggucggagucagagucgcagugggaguccccggaccggagcacgagccugagcgggagagcgccgcucgcacgcccgucgccacccgcguacccggcgcagccagagccaccagcgcagcgcugccauggagcccagcagcaaggugagucgcgcgcccgcgggcccucccgccaggaacaaaggcgcagacuccugcccgccuuacgccggccagggccucccccgccgccccgcugcgcugugcgcccggggcgggccgcgcgccucuccgagccuggcucggugcgggucccgagcgcagcgccccgccgggccgcuggccgcaguggggaugggcuucggaucuagcgggccggagggcgccgcgugcguaguuggcgccggcacugagcacauggccuccuuccgggggcgccgcgccguccacgcggcccugcuggggcuggggacacagggcccgggagcggcacgucgcacacgaccucggcagcagcagcccagccucggccccucccggugcgggggagggggcccgagcgcggcgcccauuggcugagcgggccgagcccccggcccggccccggccccggcgcgcggaggagucaggagccgcccccgcucuccgucugcuccccuagcccggacgccccuguaggugggcggccuggugcgaggugucccaccggccuccccuacuccucccgccagucccccgcggugacgaggccgaggccgaggggagggcacuuuucuccaggcccgggcucgaacgcggggguugagaugaaccuccggucucggaggcucuccuuugcgaggagugcaggccccaaagcuuuggcccagucucgcggagauguguuccgcggaggcagguuuacccucggggccaggcggggagcgcaaccggaggggcgggggaucugggggccaggaaagagccccaggcugaagucuagcgggaagcgcgcacgccacgggguuggggaaugagggauggggacucuggggaccaacaacucccuagauaggauuucuuuuuuucuguguaagugggcuuguccugcagggcaucuuuguagcguccgcagagcgauuucuuuucaacaaauuguuuguggagccccuccuguguguagggcauuguuucuuuccaccuccuuuccucccccuagucuacaauauuuucaaguccccuuuuucuuuugaaacggucccucuuuaucuauuauacuuugauuuuuccaucucgucagcugggagggcaccuggauggcccuuguuuucuuagcugggacgcggggguagcacugaauuuugaacugcccuuccuacuggcuguggaggugucccgcugagacugagcgggguggcgcugggccgcacccucggcaggaaaaggccuuccgccccacaccuguugaauccauaaauccagacgacuugguucacccuuccugggcccucgcuugaggugagaccccggggaaguucccggggaaggcucccaggaucuuaggugagccguaagggugggauauaacuaaacaaaaguucagugagaagcucuucuagcuaguggcaaggaaguccaaauaucucagggcucuugcaggccacuuaacuucugggccucaguuuuuccaucugaaagagaucacuuuugucacuuccucuagggaaggaacuaucuauucagcauacuaugccagacauggguauuuauuuguugaguggauaagggaauacuacguggagacagaaaaguggaggagaaaaucagcagguucuuagccaaacuacuuuaagcgucacggaccuuauagcccugcugguuacucacuagccuggagcucagagaagggaaauaaguuugccaaagucacacagcuaguaagugguugaacuggauuugaacccaggcccaucagauuuaauuucauuucugucuccacugucucucuucaccacaacauuucuugaauuuugggcagaagggagagaguuugccuaucuucaaagguggccccuugugccagcugguucuaaauaguguagcaggugggugcucuucauggaguguucuccaaguuuuccacugucuaccucgucaguaauuaauguuggaacaccucuuucacagugguguaucuguauuuuuauuuuuuuauuuuuauuuauuuauuuuuugagacggaguuucgcuuuuguugcccaggcuggagugcaauggcgcgaucucaacucccugcaaccucugccucccggguucaagcguuucuucugccucagccucccgaguagcuggaauuacaggcaugugccaccacacccagcuaauguuuuuuuuuuuuuuuuuuuuuuuuuuguaguuuuaguagagacgggguuucuccauguuggucaggcuggucucgaacucccgaccucagaugaucugcccgccucggccucccaaagugcugggauuacaggccugggauuacaggcgugagccaccacgcccggcuguauuuuuaaauucaugcacaugcaguuugauacuaacagaugauaugccuucauaaaauagaaauuucaaaagacagauagauacaagacagcaguuauagucauuuuccccuccaaaucuuguguagaucauuccauauacauucuggaauaaagcccuucccuuuggagacugcugauuugaccugcaagcacagccuuuuugugcaugauguuagaggccuggggaggucauaucgcuugccuuucacacaagaucugaaaaccaggugugucuggcuccaaagccuugguucugcuauguuccucuuugucuccuaggaaaugggaacugacuuaacuaacuuccccguguuccauugugcuccucuguaacucacaguaaugagcuuagcugaauaggaaguaggggacagauggaaucaccuugccuacaagccagggguucgcccacgaucucuccugggcagcacgcaagggugagcccugccccagaugucucaccccacccuucgugaagaacuuguaacuagccuugccuaugcccaucacucaucacuuuucuggccagucucuaccuuccagaaaaggaaaaaucagaaaucugcaggcuuucucagccccuuuguggugcagacagcauaguuuuuuguuuuuugucuuuuuuugagacgaggucucacucugucacccaggcaaguaucuuggcuuacugcaaccucuaccucccaggcucaagcgauucugucaccucagccucuugaguagcuggaaccacagacaugcgucaccgugcccagcuaaauuuuuguauuuuugguagagacaggguuucgccauguugcccaggcuggucucgaacucuugagcucaggugauccgcccacuucagccucccaaaguguugggauuacaggcgugagcuaccgcacccggccaaacauagauguuugcauaugugguuuugaaucccagcuuagcuuaguugcccaguuuucaucauuacagugucuaggaauucagaaaagaauguacgucucuguccccauagaugcuccauaaauauuucuugcuuccuuggacucccaugaugccuuaccugggcugugggugacuuguaccugggccuuggccuuuauccaaaagcuggcauucuggcaguaugagcuuuuggggagucaggaugcuggcccauggguauuaagucagguaaaucauuaaagcucccacuaacccauucuuccuaguaggggcuuguugggaagugaguaggcauggcacaugggugagagugccaggccagggagggucagcucaugugagugcccugcgcugcuuugggcuucuuugcuuugcuuuuuugccuuaggcuuccugccuaccuuucugaauuugggucacccuugggauaguuugaaagggacauucauguccauuaacuccaaggguccucacaacugcccugugauacaaguuacagugaccucaugguccaauaaaaaaugacuuugccaagaucacacacugagccucccaccccaagacaugcugccagccuuuccaggaugacauuagaggguggaaggaacccagagcaggaggggccuuccagccauggcccagcccuccauuugacaaauggggaaauugaguccagagaagggaagagauuuguccgagauaaggcuaucacaaaagauuugaggcguucuauggagcuguguuuuguuuugauuuuugagacggaguuucgcucuuguugcccaggcuggagugccaugacacaaucucagcucaccacaaccuucgccucccagguucuagugguucuccugccucagccucccgaguagcugggauuacaggcaugugccaccaugcccggcuaauuuuuuuguauuuuuuuuuaguagagaugggguuucuucauguuggucaagcuggucucgaacuccagaccucaggugauccgcccaccucggccucccaaagugcugggauuacaggugugagccaccgcgccuggccuagcuguguuuuuuuuuuaaagaugcuuucuucuccacaugccugucugugccauccuccacccaccccaaaugagcaggaauccccagacacaggacuugccaugccauaggagccugaaaguuggauuagacguaacuugacaacugaaacucuacugugaauggaaacaaaacacuagauguucccacuaaacucugaccuugaagaaguggcuuuccuuggagccuugguuuccuucucaguaaauagagacuuggcuacccccaguggauguggugagacuggccccgugcccuaaauuagagaaguggcuauuuuaaguggaaagacccuuuguaaggccagucuggguguacaaaugauguaaacagccccaagaugauccuugucuaguaccgagccauccagggauucgacccuauuugccccggagcugggccagccucaaaucccccguaaucagcuugugacuucaaggagcucagcuuugcccagugccuccuggucacggggugucggcccagagcucugcucaaguaccaaggguacagccauccagcucccugcuuccccaagacuggcaaagcuggggaggccuggaacaaagaggaaagugugcaguguuggcuuggggccugcaaccucaccccuucccccaccucacuccugggcauaaaggugauaaagccgcucacucagucugcagucugguaaccgacguccccaugauggcggaggcugggaggccuccugaccagauucaugggcucagagaggcuguguccaggccugcaggcccagcccuggcuacccuaacaagccuccaauuguuaccucucuccacgggagggguggacuggagccugaggcucugucuuccagccaccaggccuggcaguagcugaugcauaaacauuaggguuuugcaguaacugagcagggcucccaggccuugaaccugggcagaaagaagacagcaucuccucucuuugugaccacacugacuugccucccugaggcuucugcacccuggaaugggagagagcucuugccaggccucagcugauggagccuuuggcuacugaggccucugcuggacaggaagucugccuaugucuccuagcccaguuuaucucccccugcccuggcauuugggaguggggaggaaacggcuccaucagaaacagcucuaccauuggaccuuaggccagccacacuucuuguuggagcuuguguccucagcuguacuggggaugagagcuagcugucugggucagcggcacugaggcuccaggggagcauguggucugugcagcaggcuuggggagugcugagcagcacagauuggguuucauagcacagugggagcccagacaggccagcuagccauaagcaccucugcuggaggaagagguggacucucuugggcuggagggcccaguucaaggaaagaaacaaacagcuacacugggcuccuugaucacccagcuguggcaguucuucuugaggacuuccugccccuaggugggggcugccuucagcucccugcugcgugugauaacuuggguguggcccucacagcugugcagaagcuauucccagaggguucuggccccagguaaacagauucugcucugggcucgccuugccuccaucccacagcccugugugcugucuguggcacagccuagagcagcacugccucguggcccuggcccuuaugcggcuggagcugauccugaaguccagugucccagcggucauggcuggcaucaucaccaucuacaaccuggugauggaaguccuuauccccaacucgcugaucgacugcaucagccucuacgggaaucuccuccagccaagcgcuaggcugagugugggccugaguggcccggcagccagcuaugucaucagcacugugggggacacagugcugccuagaagcccgggcuauuugugggcuugauccugauccucauuuucacugcauggucucauucucuccacaaaguagccuuugagcccaccagccacagaaugugauauaaagaucaccccugcuuauuccagaaugaacagccugagacacauaucccuucaguaguuggucuugugaaugcaguguccuagugcaaaugcccaucaucuguugaccccauccuugccccugccugccccaugcuguggauaucugggcccccucaucacccauccuggcccccugaccagugaggaugcccccucccaucuaggguacucugcgucuaaggaugaauuccaguguaauuuucucucuucuguagguuuauuuauggaagauuggaccuguucauacaucuguggggcagcccuccaucucccagcuauauaaagucucuaaccacaguguugcauugugggguuaccauguggucugacacuuccuugcaugaacuacccucacuccagcccuggacaguccagggccuagcaggcaguguguggggccuaccagguccuggcauccaagcuguguccaauaaaguucuuagaugugacuggaaaaaaaauuggauuaaaaaaaagcuucagaaguuacagagccaacuacagagaagcauaauaaaugaaagagugucuucuaguuuugacaguuugguguuuacccuaaagacuucucuuugugcauguguagauacaugccuauaaauagaauauuuguguaguuggaucccacuuucugcauaguucuuugcaacccauucuguucaccaaaccaacccuuagagguaaauacuggcaguguuucucucugcacauacaaccaagugccacuauacaaguucacuaacucccuguuccuuacacaauauguacauccuauugcuuuuuuuccccccugaacaaucuacccugguacucuucauaacacauacauguuaugugaaacacagauguguuucauucuuuccaauagcugcauaauacuucauuacaggcaugucccaccaugauuaagaaauagcagccccaucaccuucuucauaccacucaccaccugauguauuacauguauuuauuuucugccccagccuucaacuaaccuaucaaguuccauaggcagggauuugguauaguuuuaucgcugaauuuccauugacuagaagaguguugggagcaugcauucaggcauaaucuuuccuuagcaauaucauuuauucauagaagauccucucuuauggagaauuaacugaagcuuagaggaagagacuuuuuuuugagacggaguuucacucuuguugcccaagcuggagugcaauggcgcgaucucggcucacugcaaccucugccucccggguucaagugauucuccugccucagccucccgaguaguugggauuacaggcgcgcgccccccacgcccagcuaauuuuucguauuuuuaguagagacgggguuucaccauguuggucaggcuggucuugaacuccugaccucaggugauccgcccaccucagccucccaaagugcuggaauuacaggcgugagccaccaugcccagccaggaaaggacuuuuuuaaggucacacaaguggaggagcugggacuuaaaugugucugcugagagugacagugaacuuugcaugugcccaaucuuaccaaauuaauguucucuuaguugaauuauugcccaucucaccaccaaauguguaucuucucaggggugucaguuuccccaggguccagauccuggccccacacccacacauggccaaggagccauuuacauuuaacauuccauaauaggaugcauaccuuuucgguuauuuagggaggaugugguuuugccuggaaggcuuugagaaugcugggcagcuagcucaggggacguggggcuuaaagcagaggccgaucaacuuuuuucuaaagggccagauagagcguaaauauugucagcuuuguuggacauguaguucucggccugccacucagcuuugcuguugcaguacaaaagcagcuguagacaaaugaguguggcuguguuccaauaaaacuuuauucauggucacugaaaugugaauuuaauauaauucuuacauaucacaaaauauuagucauugucuuuuuuuucuccccagcuacuuaaaaauguaaaacucauucuuagcugccauaguuugccaacuuuggcuuauagcaaaugcagcaaaguggcccaaagguuucugagccugugcccgggcugucucagcucagagugggcaaggcucagagaguugcuuuuauggaauuugaccuacauagaaagcaccagguagaaaccuuguuuccuucagggaccaguacccggaaacaagggggaggaccuaagcaggaaagccauagaauuuggcaucagagacccccaauuggaaacuucccugaagccuagaguccccugguucugcgcuuuucccucucucucauuucucaucugugaaaagggaguaaucgcuccccaaaagcuuguucauggugguuaaucagaaugugugagcagccucuggcagggugccucagcucgcugcugcugcugcugcuaaaugcaccagcccccuccucucaguucuacuuugaagacuggcgagugccuucugccucgagggcaaccaggggugucuggagguucagucaugcaagggucuugauaucauuggaaggcuuaaaggaaguggcuucaggagcacuuaaugcuugaggucacccuaaggucagguuuuggacuguuaguccaucacucuucuuuuuuaaaaggcuuggcaggauggaaccggucagaggguagaaugccaggcuaggaaaccaaacaacucuagucccaacccuggcuuuuguuuguaugcuaggcugggcaccugcccucugaccucaggugccuccugucaagugccgauguuacagcagucugcaauuucuugagcuucuuucuuucuuauugcagccaaagcugucuuauuuuuuuuucuuuugagagugucucacucugucgcccagacuggaaugcagucgugcaauaucugcucacuacaaccuccgccucccagguuaaagugauucuauucuccugccucagccucccaaguagcugggauuauaggcaugugccaccacaccccacuaauuuuuguacuuuuuuuuuuuuuuuuugagacagagucuugcucugucgcccaggcuggagugcaguggcgcgaucucagcucacugcaagcucugccuccuggguucaagccauucuccugccucagccucccgaguagcugggacuacaggcaugcgccaccaugccgggcuaauuuuuuuuuuguauuuuuaguagaaacgggguuucaccguguuagccaggauggucucgaucuccugaccucgugaucugcccgccuugccucccaaagugcugggauuacaggggugagccaccgugcccggcuccaacuuuucuauuuuuaguagagacaggguuuugcuguguuggccaagcuggucuggaacuccuggccuuaaccaauccgcccgccucggccuaccagagugcugggauuauagguguaagccaccgcgcccagccuugagguucuuucuuuuaaugcccagaaguucauuuaaaugaguaagaaacacaacaaaacaaauuaaaagggagcugucauggauucagguaaaccccucccccacuccuuugagccguggacuaagcaguuggaaagcccugcguccccugcuucccugcaccuggggaacccaugugggaugcugugggaagaggacaagauggagcaacaucuggagucugccagcccugggacccuccucuugccaggaauacccugccucugaguagcaguagccacgugcccuuccugugccaauauagauugagaaccugcugcaggccaacccuggggcuggagcgcaaugcugacacacugacaugggucaaaaggccacaguguuuggcaaguuauacaauguggccagggccaucuggcauccgagcguugggggagagguccugaaucuuaacaccucauccauggcuuccugggagagggagggcucuugugggucgugagacccccagcggugggauagggagggugagggguggggacaugagaaaugcuucucugugcuggacccugagcccaguugcuggccaagcugggaggccaugacucuccuaggagagucaggauuugaacucagucugccugacuucagagguccuuccuugacagcccugugggcuuggaguggaggguuuuguggggugcuguauuuaccucucagagcucugauguuccagcacucgucagggguuugauaaauggcuaaggaugaacacuggucuggcacaacagauacucacagagccagcuuugcccaaaagccaaauugaaaaguggcagguuucuuuguuuggcaauuagcaugugcuguucccuacucucgucacucuggcugcagacacgguaugacccagguuccauuccuuuuuuuuaucucacucuguugccgaggcuggagugaaguggcaugaucuuggcucacugcaacuucugccucccaggcucaggugauacagaugugugccaccauauccagcuguuuuuuuuuuuuuuuuuuuuuuuuuguguguguguguguguaauuuuaguagagaccugguuucaccauauugcccaggcaggucuugaacuccugagcucaaaugauccgcccaccuuggccucccaaaguucugggaucaccgcguccugccccugguucuauucuuaaggaguucccaaacugaguggcagauggguaauaagcuagagacugcagaggacauagcaagagcaaaggccuggaagagaauggaauguucuagaaaguagucucauccccagggagugcugaugggcugcuggggaucccagacucugggcuguacauugcuccccaccaguaaaaaaggcucccacaagaaaaucacaagcucuauggggcuaguacccuucucuaagucaucaccaacuguucaucagcuugacaccagaauaaauaaauacacguugagugaauggacuucauugccauguuccaguucuagccacuggcuggugggggcagauggugcugaggcugcccgaucgaggguagcuugcuauucuucaccgauccagcaaacacuuguggagggaauucugccaggcuucaugauggauacugauagaaaacguaacagcaacccuuuaaggaaggaacuuucauccccguuuucuaggugaggaaaccaaggcccagagcagggcugccuuguauccaacuccaaggugaaaggaggcagcuugcugcauuuaaacgugggucugcuuccaagcccagcaaugaucaagccggcuauagugggcgcagcagaguggcagcaugaaucugagauuggucgcagugucuugugccuacugaggagcaggggccaugucccucccccuacaccuagcacugagccacacugagcacgcuguuucuuaaucugacugguccccauuucuucuccuugcacauacuguucuguccaccuggaauguagccuugccacugcuuucccacuuggcagacucucuguguguccuucacagcccagcuccaaugucaccuccugggaacucaucuuuuuuuguacccaggcaaaacuggaaaucuuucccuccaggguucucacagugccucauaccagcccccuguugaagcccagaccacacuagccucucaucuucaucugccuccccacugcccccaccccacuguacuggaaacuccuuccuuggugucaggacuggguccaguuucauccggggccccagcucuacuuagcaugagaccuagagcaugggucacugguauuuuagucaguccuagugcagcagcugccuggguggauguggauaugacccagggaguggguaggcagguuuucuaaagucgaguuugaccucgaccugcugaugacaagguccagcggagggguauguccuuggccuccagcagcccccauugacagaggcuacagucgagcagcugcucaguggggccccagggaugacuucagaggcuccagaccccuggaacaucagaugcagaccucaguaaaacagggccugugauaauagcacuuaccucacauagccagugucauucacucaugcucuaccaacauaauuuuugccagauccauggaucauuuguauuauuuuccacuuaauguuuuuauuuaaauugcuuuguucuaaguaauaugaaaucacagggcuuguaaaaauuauuuugaauaggugauuccauucacaccauucagaauucaaaaaagugccaaaggcuauaaaaugaaaucucccuuucacccuguccccagucacccaggcccccccgggguuagaauguuaccuuucuuguacauucuuguuuuuuguuuuuuguuuuuuuuuuuuuuugagacagagucugcucugucgcccaggcuggagugcaguggcgccaucucggcucacuucaucucccagauaaagugauucuugucccucagccucccaaguaguugggacuacaggcacgcaccaccaugcccagcuaauuuuuguauuuuuaguagagacaggguuuugccauguuggccaggcuggucucgaacuccuggccucaagcugagauuauagaugugagccaccgugccuagccucuugugcauucuuuuaaauagauguguauauucucccccuacccccagccaauuuuuuuuuuuaacccaaaagguagcauacaauauacacacugcucuguuuuugguuucgcuuuuguuuuuugggacagagucucacucugucacccaggcuggagugccauggggugaucacagcucacugcggccucgaacucccagguuauguauuccauuauaucacuaugccacguuuucuuaaaugauagauugaugucacugcauugcuuguuuuuuaaucuauucuaauguguuccagaaaaauacaguauauacuuugcaucccaugagcaaaugcagguaauaccgcaggcagaaagcccagcacguggcgggccuagcagucgcuguuuagugagcccuccuggugaugcuuagugccuugccacagccucugaauuaguguccacccuaugaauuaggcuugaccuggugugucgcuggggucccccagaaauuugucagcugcucacuacccacucggaacaacagcucugggccugaaggcuccccagagaauugagagaagggagauucugggggcagugccaggacauacggggggugggggcugucuuucuaguugggcaaugcagaggauuuagagggaauggagucccugugguaugagggaagccccagcauguggaauaaauguccagaggcaggcuaaggggucagguagacagacuaaugggaaggaaggaugcagcgcacacacagagggggcucugagcugcacacuccuccugggccgaagccuucuuccucuuucgcagccucugaugugagagccuuggcuuuugcagucguugcccugacugacgcuuucagagaaugaaaagaccauacugggaauaugccugguaacagcuaugcccagggcuaucugugaugaucuugaaguaaaggcugcuucuggguucuguggaaaccaaggcccagagacccacagccaggccauggccagcuccacccacuuccagggcccagcuugguauagugugcguagugaaugccagucguuucuuuggcaugccucccgcagcccuguucucccacaaucaguuaaaggccugccuaaugucacauuuccugacuuccucauuuuuauagcugaaaagagcacuuuucuucagcagggcugacacccugcuggccucucagucaccuguggcuaagcagggcucuucaccugcuggccucugcccuuccugcugccuuagguccucggcuuccaauggacagaagcaaacugcucuuuuucucucccaucccuuugcccauuggaaacaccuuagccccacacucuuacucaccuugugcacuuuuccaaagugcauucccgccuagcaugucgucuauguccauauaaccuugggaggcuuaugguuuggggauuauugccgugaggagcacuggguaaggaguccggagcccugagcucugcugcaggcuccugagugaucuggaacuugccucacccucucagggcucaguuuccugcccugugaacagcaggaaggguagggcaaggugggaucacaucuccaaugugacaaacgaagcuguugccauuuugcugacaagcaaauggaggauaggggagaggugguacaugggggacuuagccugcuggaauucacagagcaaacaggcagaugggcuggaaucagaagccagcggcuucagcuccaaauccagggugcuucuccuaucuauaucugugcuauuccuaccaaguaauuugggcccccucgcauaggagggcugguuccugggccucccagucagagagucuagaaccaccagacccuaggcauggcuccaccagggaaaugagacccccaagaauccaaagccucucccucucugagaccuggcuacagagagagaagaucauacuuccccucucuccccaggaaauggcccggccagcccaguaucuugaagucagcuaggcugguuugggcaccuaaggucaggaauuggccaaguuuccugggagaaagacugguguggugccaagagucaggcaagauaucugaacacagaaacuugccaguccaggcccugcccuguaguaaccugcucccagacacgccuauaacagugugguuuguuucuccgcagaagcugacgggucgccucaugcuggccgugggaggagcagugcuuggcucccugcaguuuggcuacaacacuggagucaucaaugccccccagaaggugaguacugugccaucguuggcuuauggacaccagccugcucuguugcacaucacacaugcccacagucucacgccaccaccugaauuagagucauuuauaugaacgcacuguacugucugccucuccagccaguuuucuggcccugaucaugucagagacucuucucuugcuuuggaaucaggguggcagaauucuagaaucucaggucccacagaauccuggggucuuguauaggcccucuugaccaaccccccacccaacucagucauuuaauaauauguuugaugauauaauaaacucaaagcaaagcucaauacaauaaugcugcauuuccguggcauucuggggcugcagaggguuuucaugggcuugucucacuugaugcucacugcagcacugucaggaggcagcaggcaccacucccagccugcaggugugggaaacggccagagagaggaaacccgcccaauaucacccagcuaagucagagacagagcugguauccaacaccugccugccaggugguccuugagccugcacucauacccauccacaggcagcacacuuccuuuauuuguagguugaaaccgcguccucucccugaaggcccuguggcagucaaagcagaaauggcgucuugcccuagggagccacagggggugaaggucugugcuggcuuccuccucccugccgugcauccuagaucuguccucacuuguuuacuugaaugucaggaugggaagggaccuagaccaucuccuccagcccagccuacuugcauuaaggaggagagaagaggaaaaggggguaggggguaggaggcagggacaggaaaggaaacugagcccuuccucuguaccaggcauuuugcuuguguuuaugagauuggguggugauuuccauuuuguagacccggaaacugaggcccaggcagaugaaauggccgacaggcccaaggucacaaagcuauugaaugcuggagucagaagccaagcucuguuguuuccauggccucagguugucuuccuaaccagcugccuugcccguuuaaaaaucuguaccuucccagagaggaccaaaugagagugggcaguccucacgucaggaccacauuucuuguccagacggauggggcuagaaagugagugcagugacucccaaagaucaggguccuguuugggggaaccagguagugucuagaguuagcugggcuucuuccaaauaggcagacaguggcuauggggccacgcccgaugcugaggagcaagucaccaggaaggcuuggccugcugagucaugcucagcugcaggggaggugacaggacuuuuccaaguuugcugggcauggagaccgugggcccaugcuuggaccagccccaagcccugcauuugcuaagugcucuugacagcucuugccaaagugugugcuucagaacuggcucccuuugggaauccuuacagauggaaagucuguaagacaggcugggaggaaacagagggagguugagcucuccacuugguugcacauugggguuuccagaacgcccccagauucugauuuaauuggucugggaugcuguuugggcauucaauuaaaagcuucccaaccaauucgaaugugcagccaagguugacagcuacuggauuuaaugaugucuugacugugaucucauagugaguuaaugacagaacuaggacucuaaggccaggacagaggagguguuuuccagaaacagaacaggguuggggugagcagggggccuucaaagcaaaaugcccagaagacagaaagccuggcauucaguaaagcgugaguaguuuagugugucacuagagugaacaggaggaggggaaagguuggggaggucaacaagguaagguaggcaagagccagaccacaaagggccuugugaguauggcacggcacagucagaaggggcggaugggcaccagcacgggggcccagcuagggagcauggacuucaggaugaggacaauagggacccacugcccagggcagacgugaucagacuugcauuguagggaaaugacucaggcgucugguauggaggggcggacuuaagaaugugagacuagagacgggaaaccaucaagaaaguugccguuggacuagugacauaaaagcaaacccucagaggaagaauggacaggauuuggucaucaauuccgugcgagggcaacagagaaggguuuaaaaaugguuucuagguuucuggcaugggugaugugugguuugaagaaggagcaggugugccaggagcugagagguggccgugggaugugcaggaauggaggcguggggugacacagcuggagaugugcaggaggcaccuguauguaugggucuguuucuuagacccaggcuggagaaaaguugagaauuagucacugguauccacacaguggagaaagaucuucuagggagacuguggaauaaaaagagaaaugaagauuaaggccgggcauguggcucacgcuguaaucccagcacuuugggaggcugagguggguggaucacuugagcccaggaguucaagaccagccugagcaacacaucaagaccucaucucaauuuuauaauuaaauaaauaaaaauuaaaaguaaaagaucaaggccccagagaacaacccauugcuagaaaaagacccuaaguagaagaacaagagcugguaucucuaaaaccaggagaggauacccucccaagacagagggauaauguaagccaucgaagggccaggguauuugucugguuuguccacggccguguccuuagugccuagaacggugccugucauaguaauagacacugguggauagugaguggaggaaggccaucggguaccccagggguugaacugggcaagccucuccacauugcugaaugcagaagaggcgaugguggccuuguggccacucgggcugacuggguggcacagcguggauagaagccucacuacgauugggugaagagugagaggcagaugagaaaggguggagacggcucuuccaaaagaguuggugggagagggagaaaagaggagguuuggaaugaugguauggcuaggaauuuauuuauuuauuuuaaugaagguuauuuuuaaacauguuggaaggaaucagcaggagagggugaagauaaggaagugagggcggaggucuuccaggagggaggguggugucggagcagaagggaggggcugccuuuggccaggagggacugagauaccuuuuuuuuuuuuuuuuuuuuugagacggagucuugcucugcugcccaggccagaguacaguggcaugaucuuggcucacugcaaccuccgcuuccuggguucaagugguucucgugccucagcuuuccaaguagcugggcuacugguacagguguguaccaccacgcccagcuaauuuuuguguuuuuaguagagaugggguuucaccagguuggugaggcuggucucaaacuccugaccucaggcgauccaccugccuuggccucccaaagugcugggauuacagguaugagccaccaugcccagccagggacugagagacuucugaagauguagacaaaucugagaugaacuucugugauccccggggccucccaucuaaucagaaauaggcaagagguuauaacugucauggaauaugggcagaaccucugaccagggcaucacggggcuggucagcagcacagagggcccagaugagccuguaaacugcauucauaggaccauguauggucaccuguccaaaggucacuucaggaaccagccccagcagaccgaagcuggagaugugaguggccagaacugagaacgcugaaaucuagcgguguuucuugggcaagcacccagacacuuggucuguugacuuuuguacuuuacaaacacuucucacaaggcuggcuguaguuuuuccaaccaggagccagauuagaagugauacauguaacaugugaagagaggacagaaggacccaagaagaagaaaugaaagugaggcucagagcccauguguaguaacagggcagagagacuccugugcccgcguaggcugaaggccugcccuagggcgacacagagauuccaucuggccaacccuuucauucagccaggacuuccugagcauccacgcugugccagaugcgguccuagacaguaaggagagagaaguauagcugugaacacagcaggcacaugcuggcccucagggagcugccugagacacagucugagccaggcccugucuccacagcagugggagagaccccuuggagaaagccagagugucacuaacagagggcuucaaggugcugugagagcaaacggggcaacuaaugcuggggcuggggugacaggggagauuaaaaaaagggcuucacgaaggacuuggcagccaugcucgaccuugaaggguuaguugaccucauagggcaggaggggcaggugucugggcagugagaggggcuucugcagaggugcaggggugugaaauguucugcugaugcggaauugcuaacugccugcagugggcacacugacuucccuugucuguuuagaagaaccucucuuaggaaacagcauuggguuggccacaguuugccuacucuugagaagagacuuugccccacaaguggugaggaugccagaagcuuguucucuuccauaaaacaggccccaaagggcuuccuccuggaagugguuaauuaaucauacuaccuuauauguuuacaaagcaccaccccauaaauuaccaccucacagcaacucuacaaggcaggcggggcugacaucuuccccucuucuaaaugagggaacugaagccagaugagguaucuggagagugagaggcugagcuagaggugggcuccaggccuugugccuccccagcucugcacacugccccugcccugcugugagugugacaggacauuccugccaugcauccccuccuggaggaggaggacagagcagaagaggugagcccagccacagagggagcagcuaaaugaaccagggaauccugaccaucauacugggcucauccgagcacugccuuuccccuccccaaaugacugagcugccaguagagaugacugacggccacugagaaaccaugaaguccuggcccaagggacagugucaggcaugucugagaauaaggcauccucagaauccagaguuugggccagaaaggccucaguuguuugacaaacaacacuccuuguuugacaaaggaggaaccuggucugcagaggaggugaggucugcccaggaugacccagcuuggugagugaaagagcuggaggcaacacccgccucccaacccaagcccugugucccgucaggcugaacugggcuucgugcucuaggcagccucuccuucucucuccuauauccaaagaguucuaguccucucuccccuucacccgucaccacuaccauaaacccuuacugcuuacuuauagcuugcccaggcauuguuauacauacucuagaaauaguaauucaguuguucuucaaaauaaccccauuaggcagacaccauaauuuucccugcucuauaagaaacuggggcacaggaauguuaagcaauuaaagcaaggacacacagcuaguaaguggcaaggcugcaauguaacuccggggagucuggcccuagucugugcccuugaccauuguggaagauggacacagucccagaugggcaccuaaacacccuuucacucaccuacaacugccaccuagcuggcaguguguggucucacuuuggagcugagucaagcucagucauguaccaacaucucagguuucccacacacaguugcacaaucucuuacaccaucacacccugucauaucacaucaccccucaagcccuucaguuagauucauggcuuguuggucauuuagugucaacucugcaccuccaccaccgugcugggcaccagcaacauggaugcaucagacagaccaucuccgugcugagguuuacuguacagggagcacacgguaccuuacaguuagucuucuaaaggcgaugauggaaaugcgagcaagcacagugggagcagggaaggaagagggagagggugcuucgcccuuagagcaggguuucucagcuuggcacugugauguuucugcugguguuguagaggccugucccaugcauuggaggauguuuaucagcauccuuggcuucugcccucuagauaccaguagccaguguggcaaccaaaaaugucucugggcauuggcagauguccuaugggguaccaaagccgucucuguuugagaaccaguugcaguggagugggaggggugguucucgggaggaaggcuuuccagaggaguaucugugcauguucugaaaggugauuaggcccaagcaaaggugugaggugucuaggucguaugagggagucacugcgugugccuugugagucauaguugggguagaggagacacuuuauugcaagagcugagaagggcuucggguguggccacggcagugggaugauuccucugucuaccgggaggccuggccuggccuggccuugguuuggaggcuagccaugucagggcuguuccagggaagcagccugggugguccagcccucugcagggggguuggggcccagcucuagccccaaccugggccucuucccccaggccccaaagugaggccccaggggacccagugggcaggguuaucuguccagccccaccuggaacaucuggcuccaaucucccagcucacccugggguguggcugagaguugcuguggagaugaaggcccugggcugagagcuugugggaagggcaguguggggccagccccaacuggaagacaggggcaggcaaggaacaggggugaaggccaggcugagaggcuaagccggagaagcuggcccuuuccuccuuguaacuggcgcugaaagcuuggcuggcaguuuagccccuucuuccccacaauagcaucccguagagcacagggagaguugagaccgagccuaaaccuggcccagggaucccugcuggggaugaccuaacugaccuaguccuccugggguaaaggaaugucuagagggaaggauggugagaccagccagagguuccaaaacgcauaccccuccuggcaguggucuagaauccuagaucaaggguuggcaggagggccacauccagccagcagccuguuuuugugcaacccaugagcuaacaaugguuuuuacauuuuuacaagguugagaaaaaaagaacaaugagugacagaggccauauguggcucacagacccuaccuaauggauucuagcuagccuuuuacauaaaauguuuaccccaguccggcucuggagcacuuugacuugcaugcucccuacuuacagggaacucaccaccuguaaggugggcagccucauacccugaagucuauaaagcucuuccuuccccugagcuggagucuggcccuggcaccucugcccucuggggcuacagagugcuggguuccucugccaggagcagccgagcagggucuggagacuagcuuuauucccugaggcaggcccguaguuccuucagguuccuccuuacucuuacauucuuaggguaaugauuucuggcaauuucaaaauggaaaaccuugucccuaaggcuccuccgaaaguggugacuucuuuucuugagagagcaacagugacagcaguaacagcuuacccaugugccaggcaguguucgccgccucaugccccucuacaaaggggaagugagaaguuccuuggcagaugggcagacauguagucucacccacaguugccucgacuggcgggaggugguguggggauucccagguguccuuaggcuugggcaggccucccccucaccccaggagagccaccgggugaggaauagcuucgcguaccagaagccauccgguucaaaggaucucagcugcccagagucaaccugcuucuccaggguggucuccaugguggguguccucuaggcucagugaggcaccuggacagagaucuguaguagccccucagcucuaggcuggccgacaccauggcaguccccccaggaacuaaccagaaccgcuccucccuccucaacacgcuugccgccacccagacuccacagcugggugaagagacugggcugggaagggagcagagaagcggguggauggccgagccuggcacauuuggugugcaggacuccgacugcauucugaggggugguucacugugggaaauggggucugacuuugguggauaggaagagucgggagcagaauccagaugagacccagggcaggcugccuggguagagaaguaggacagacucggaggcagaaucgagaggaccuggugauggauggauguggggugguggcagcaucaaguguuuaaauccuaagcuugggacgggcaugugaggugggagcguucagaacaggcacgugccaggucucaccucacacaugacccaggguugcggaggcugcugggagccggcgggauugggccugugggauccugucagggcauaauaaguagacucuucuuuccugaggugcacccagacacuucuagggaggaugugaccccagagcuuuuccccauguaggguucuucucauucuccagcaucccccugccuuuccugggccaagagucagcguggaaccccauacgaauccccagggaggagagggcacagagcaccggaaccagcaguaggaauuggaaaaccaggcguggcuucuucccagaaaucucaggcaucaagaggcagaaacccacuccccagccucagcuuggccaggaagugcugcugugggcuggagaggaugggucuaggccaaggugaacaugcagagagcuggcugcucacccuuccuccaccccauaaaguggucugaguaacagagcagcuaggcagcguccaggagccagcccuggacaagguugggucccuuugacugugugaccacaggcaggagacguaacucaggguggagcucuggucacaccucacuuacacacagcccucuugucaguugccccaacaucucaagagaucuucaagcuuauuuagguaguuucaagccuuacuuagcaccuauuuacucuuucuuuguauacaauucaaacaaauuccauuugcugacuucuuggcaaauuucaaaagagguguggagaguuguacaagacaagccucugaaccacagaggguugggggaauaccuuagaacuauggaaugcagaaauuuagccaucaggagccagucugcacagggacaaacaccucuccuugccccuggagagagccccaagggcagacaccauugcccugcagcccugcuuguaggucugguugcucaggagagcaaagugaaaucucuucacauuuucaccccauaaugggucaggaaagauuggacccucagaagggcaagcgccauuuaucuggaccguucccauauccacccucauucagagcagccuguucuugguggagccugauaaacggggcauuaccguucccaaccaguccuccucugggguuaguuucguccacagaagaacacuuugcauuuuguuacucuguuuuuugucaaaaucugccuucugucugcccccagcagaaucaagggguucuaagaggagagccuaacaccuuugguucgauuccuccauuuccucaccagguaucccuggcacuggcucugggacagaccauggugugaaucaacugucuuccucagggaagacaaacuccuggagucagggaaaccuggaucucgaaagguuucagcaauaaggccagggguaccuuccaggcaggaguaguagcaucucaaaggcguagaggggugggagaugguguguagugagugcaaaggugugguagguagggagauuggauugauaccuggcaggagccccgauuuugaguuacggguugaaggcuuggggagacucuguuaguggucugcacagccuucaggccaccagugugcaguggggugauuuuagggaugaugacaccaagcacuguuucacugauucccugcagcacugugaagcagcuccugcuaaugucugcacuuuagaaauggggccauggaaacucacagaugaaauaacuugcucauggucacacuggaaauaagggguggagcuaggaccugaauuuaguuguguccagaaucagaguucagguuucuauucacugcccugcauggcguccuuggaacggacaagcagauccuuagggcuugccucugcccuaccaacuguccucgccccuuggagccuggccuccaucagaugccugcugacuugggacagguugugacagggcaggggaaaagauggcuagaggcugagcacccacagcaaugggaaggaaggcaccaggaggcaggcccagcauauuugaauaggugggcauuucugggacugcaggcuuugguuuggcaagugugccugcccacaccuucuucuucugcuagaccucaguggguuggaagggauagggaggaccaacagcagugauggaggcugcagaggcugcauaccgcugugugugcaugaaccuguggcaugcacacacacggagggguguugggauggguuggguucacauggaauugaguuugagcuguaagugguaggggaugaggggcaugugaguuugugacuggcuaaagcaggaauauuuagauucuaugagcacggguaugugugugugaugguauacgugcauaagaagccguuucuggguaacuagggccugcacucugcuauacguguggcugggugggucuggccagucccauggcacugagaguguggugagugugcucaggcagaacgggugcugccugccuaccacauccgugggagcuggccagggugggggcagggcuggugggcagggcugcccuaggacgggcguuuccaguuccuggaacugcuuccuuguguggaaccuuuccccauaccuccuagcugggcccuugggagaggggaggaggccguggguccuucaagggggugcucgcaggccagacacaagggagcuaggccuggggaacagaaagccacagcgugagucuuucaagcacuucugaagggugacaugugugaguuugucacaccaggcccucagugcggucagggagucuguacuuccuggauggcggaaccugucugucaagcccugcuuccuccccagcaagggguuggggggagggccugauggcaggagaugggccccuggggcuuugagacauggugaggagaaaaggggcaagugggaagacccuuuuccuucuguauuucucuuuuuuuuuuuuuuuuuuugagacauagagucucacucugucacucaggcugaagugcaguggcacagucuuggcucacugcaaacuccguguccuggguuuaagcaauucugccuuagccucccguguagcugggauuacaugcuugcgccaccacguccagcuaauuuuuuuuuuauuuuuaguagagauaggguuucaccauguuggucuggcuggucucgaacuccugaucuccagugaucugcuugccuugaucucccaaagugcugggauuacaggcgugagccaccacaccuggucuuguaccucucuguucuaugccugaacuuccaccacugaucacuugccaucaucccagcaagucacacugagccugugaaaccacagggcacuggaaaccacacguuaggggaagugggagaguuggcggggcucucagaugaacuccaaccccuuguuucucgccuggggaaagugaggcccacaaaaauagagggacuuggcucaagaacaugcagugaaucuguggcagagccaggcccuggcccucucuuagggaggggugcaaggggaaaggaaaaggaagacuggguccuggccccuggcuugcucacccaggcugcaucucccccugcaggugaucgaggaguucuacaaccagacauggguccaccgcuauggggagagcauccugcccaccacgcucaccacgcucuggucccucucaguggccaucuuuucuguugggggcaugauuggcuccuucucugugggccuuuucguuaaccgcuuuggccgguaaguaggagagguccuggcacugcccuuggagggcccaugcccuccugcccagggagucccagauggggugggagguaggggagacuuaucugccuguuccaggguauuaccucugacccagccccucggagcccaaggaaugugggcacuggccugaccugugaccccguccccaggcggaauucaaugcugaugaugaaccugcuggccuucguguccgccgugcucaugggcuucucgaaacugggcaaguccuuugagaugcugauccugggccgcuucaucaucgguguguacugcggccugaccacaggcuucgugcccauguaugugggugaagugucacccacagcccuucguggggcccugggcacccugcaccagcugggcaucgucgucggcauccucaucgcccagguaagcuggggcaggaucuaccugccuggcacggccccugcccacagcuucaguggcucucggaucugugcccagcagggcagaguuucucuuccgcccagcccccacagccuugcagaggacaacuaugguacacagguccagagaacacagcaccauggccucccaguugacagcaagaugacuugacucuucucagucccuuucuucucacucuaggcuuccaaccacagggcccgccuucccccaacaugccgcaggcuguuaugcacaguacccucucuccaggaggcuuccccuucccuguccccaaaacccucuuguggcagaguagcagcccccauucucugugcuggacacaucuguggccuugucauuuguccucccagcaacacugugggguagguccuacuuuucccaugugaccgaugaggaaacugagaaacagggcucaugcuaguggcagagccucuagaacuggggcccuucccugaagcagcagcugacacaaaguagggaaggccacucuggcaggacggggugggaaagggggucagggcagaggcgcucacggccccugcuucccccagguguucggccuggacuccaucaugggcaacaaggaccuguggccccugcugcugagcaucaucuucaucccggcccugcugcagugcaucgugcugcccuucugccccgagaguccccgcuuccugcucaucaaccgcaacgaggagaaccgggccaagagugguacgggcauggcccugcccuccuccccacucccugagcccuggccuucuucccacucugagccacccucaccuucccuccgguccccccagugcuaaagaagcugcgcgggacagcugacgugacccaugaccugcaggagaugaaggaagagagucggcagaugaugcgggagaagaaggucaccauccuggagcuguuccgcucccccgccuaccgccagcccauccucaucgcuguggugcugcagcugucccagcagcugucuggcaucaacgcugugagugcccccacccacccuuccugugccccagccaagcccucuggucaagugugcauggugaacaagucccaaacuugaaacaacagauacgccucugccgaagaaguuucccuuuagaccccaagcccguaaggucacugcagugcagugucccuucugccugaguauuuguccccuucauucuuuacucauccugggucccacauccacugcuacagaggcagggaagggccacaauguccagguaggccccaacaguuucucuugucuggcaggucuucuauuacuccacgagcaucuucgagaaggcgggggugcagcagccuguguaugccaccauuggcuccgguaucgucaacacggccuucacugucgugucggugagucuuugcuuacuggcccccccagccaaaccccagggaggaggcagugccaucuuccccacuggucuuugcagugcccugugacuuucucagcucuugaggcaaggccucuggguggguggguucagaagggcacuaggcagggguggcacugacacugucucugcccacagcuguuugugguggagcgagcaggccggcggacccugcaccucauaggccucgcuggcauggcggguugugccauacucaugaccaucgcgcuagcacugcuggugaguugcuagguucuggagagugagggaugcgggagaguuugccugggcuucauaucccaaaaugccugucucagccccaggcuggcaggccuuuugguggcugcauucucccuggcugugggucugacuuucuggcuccugaaguugucuccuuccaaaccacacacauccucucuugaacuugcuccucccugcuugauggauucucagcgcagcaccucuggucccagaccccaaacucucaccuccuuaaggaauugcuuugccuaauauuaacccuuuccaaucuucaucuguagccucaauucaucuucacagcaaccccgggaaguagugcuguccuccccauagaggcgcagaaacaugccuugccucauucaguucacacgacuggagguguaguucaguucuucccauuuuaugggggaggaagcuuaagucccagugagguuaguaacuugucagauaaaggaugaagccaggaaucaaccucagucccaggccugugacugugaccgcugugcuaacccugugccuggcacucacacacaggcacucguuuauuuagccucugggcaaggaaagcaccaugacugucauuuuacagcucaaccugggcuuggaaaguuuggugguugccgaaaggccagacaggcagcaaguggaaagcccauaaauuuucuacccuggccuccucaagaaugguuauaugcagaaccguaugcuuagcgcuuacucugugccagccugagcugggcaccucacacgccuuagaaccugaauccaccccacccccaggaauguucugcauccugccacaggcggacugugcugcaggcacagacaggggaccauggggccucuuagcaccguccacaugcacaccacauuaccacucccagcggguggacucaacacuugcagccacccugcaggacuuaaaucauuuuguucggaugaggaaacuuaggcccaaugcuggauacacaacaaauccaggaccauccccaggcuuccugccuucucgcauagcucugcucuggccucuguagcuucuguuuccccugaggauccaucacaacccagucuaacuuuucccccucuccgucauccucaacaggagcagcuacccuggauguccuaucugagcaucguggccaucuuuggcuuuguggccuucuuugaaguggguccuggccccaucccaugguucaucguggcugaacucuucagccaggguccacguccagcugccauugccguugcaggcuucuccaacuggaccucaaauuucauugugggcaugugcuuccaguauguggaggugagaacccccacugucucuauacucacccgcacgcaugaccccacagugcugugcaaagugcuggcccagcauucucauuaggaaucaugcugaggaggaaacugaggguaggaagcccaggucacaugaccaagaaugcugaccucaacuccaggguucuccccuuagccuugaauggugcuccuggagccuguuacauucuagguacaagcguggucucaguuaauuaugauagcaucccuggguagguggauguucccuuuucagcucaaaggcccaaagguaaagugacuuauccaaaguccuacagccaggauguagggucaugacuccaaccaagugugucugugugucuuucagcaacuguguggucccuacgucuucaucaucuucacugugcuccugguucuguucuucaucuucaccuacuucaaaguuccugagacuaaaggccggaccuucgaugagaucgcuuccggcuuccggcaggggggagccagccaaagugacaagacacccgaggagcuguuccauccccugggggcugauucccaagugugagucgccccagaucaccagcccggccugcucccagcagcccuaaggaucucucaggagcacaggcagcuggaugagacuuccaaaccugacagaugucagccgagccgggccuggggcuccuuucuccagccagcaaugauguccagaagaauauucaggacuuaacggcuccaggauuuuaacaaaagcaagacuguugcucaaaucuauucagacaagcaacagguuuuauaauuuuuuuauuacugauuuuguuauuuuuauaucagccugagucuccugugcccacaucccaggcuucacccugaaugguuccaugccugaggguggagacuaagcccugucgagacacuugccuucuucacccagcuaaucuguagggcuggaccuauguccuaaggacacacuaaucgaacuaugaacuacaaagcuucuaucccaggagguggcuauggccacccguucugcuggccuggaucuccccacucuaggggucaggcuccauuaggauuugccccuucccaucucuuccuacccaaccacucaaauuaaucuuucuuuaccugagaccaguugggagcacuggagugcagggaggagaggggaagggccagucugggcugccggguucuagucuccuuugcacugagggccacacuauuaccaugagaagagggccugugggagccugcaaacucacugcucaagaagacauggagacuccugcccuguuguguauagaugcaagauauuuauauauauuuuugguugucaauauuaaauacagacacuaaguuauaguauaucuggacaagccaacuuguaaauacaccaccucacuccuguuacuuaccuaaacagauauaaauggcugguuuuuagaaacaugguuuugaaaugcuuguggauugaggguaggagguuuggaugggagugagacagaaguaagugggguugcaaccacugcaacggcuuagacuucgacucaggauccagucccuuacacguaccucucaucaguguccucuugcucaaaaaucuguuugaucccuguuacccagagaauauauacauucuuuaucuugacauucaaggcauuucuaucacauauuugauaguugguguucaaaaaaacacuaguuuugugccagccgugaugcucaggcuugaaaugcauuauuuugaaugugaaguaaauacuguaccuuuauuggacaggcucaaagagguuaugugccugaagucgcacagugaauaagcuaaaacaccugcuuuuaacaaugguaccauacaaccacuacuccauuaacuccacccaccuccugcaccccuccccacacacacaaaaugaaccacguucuuuguaugggcccaaugagcugucaagcugcccuguguucauuucauuuggaauugcccccucugguuccucuguauacuacugcuucaucucuaaagacagcucauccuccuccuucaccccugaauuuccagagcacuucaucugcuccuucaucacaaguccaguuuucugccacuagucugaauuucaugagaagaugccgauuugguuccuguggguccucagcacuauucaguacagugcuugaugcacagcaggcacucagaaaauacuggaggaaauaaaacaccaaagauauuuguc

SEQ ID NO: 191406 - RNA, 33802 nt, Homo sapiens
gacaaauaucuuugguguuuuauuuccuccaguauuuucugagugccugcugugcaucaagcacuguacugaauagugcugaggacccacaggaaccaaaucggcaucuucucaugaaauucagacuaguggcagaaaacuggacuugugaugaaggagcagaugaagugcucuggaaauucaggggugaaggaggaggaugagcugucuuuagagaugaagcaguaguauacagaggaaccagagggggcaauuccaaaugaaaugaacacagggcagcuugacagcucauugggcccauacaaagaacgugguucauuuuguguguguggggaggggugcaggagguggguggaguuaauggaguagugguuguaugguaccauuguuaaaagcagguguuuuagcuuauucacugugcgacuucaggcacauaaccucuuugagccuguccaauaaagguacaguauuuacuucacauucaaaauaaugcauuucaagccugagcaucacggcuggcacaaaacuaguguuuuuuugaacaccaacuaucaaauaugugauagaaaugccuugaaugucaagauaaagaauguauauauucucuggguaacagggaucaaacagauuuuugagcaagaggacacugaugagagguacguguaagggacuggauccugagucgaagucuaagccguugcagugguugcaaccccacuuacuucugucucacucccauccaaaccuccuacccucaauccacaagcauuucaaaaccauguuucuaaaaaccagccauuuauaucuguuuagguaaguaacaggagugaggugguguauuuacaaguuggcuuguccagauauacuauaacuuagugucuguauuuaauauugacaaccaaaaauauauauaaauaucuugcaucuauacacaacagggcaggagucuccaugucuucuugagcagugaguuugcaggcucccacaggcccucuucucaugguaauaguguggcccucagugcaaaggagacuagaacccggcagcccagacuggcccuuccccucuccucccugcacuccagugcucccaacuggucucagguaaagaaagauuaauuugagugguuggguaggaagagaugggaaggggcaaauccuaauggagccugaccccuagaguggggagauccaggccagcagaacggguggccauagccaccuccugggauagaagcuuuguaguucauaguucgauuaguguguccuuaggacauagguccagcccuacagauuagcugggugaagaaggcaagugucucgacagggcuuagucuccacccucaggcauggaaccauucagggugaagccugggaugugggcacaggagacucaggcugauauaaaaauaacaaaaucaguaauaaaaaaauuauaaaaccuguugcuugucugaauagauuugagcaacagucuugcuuuuguuaaaauccuggagccguuaaguccugaauauucuucuggacaucauugcuggcuggagaaaggagccccaggcccggcucggcugacaucugucagguuuggaagucucauccagcugccugugcuccugagagauccuuagggcugcugggagcaggccgggcuggugaucuggggcgacucacacuugggaaucagcccccaggggauggaacagcuccucgggugucuugucacuuuggcuggcuccccccugccggaagccggaagcgaucucaucgaagguccggccuuuagucucaggaacuuugaaguaggugaagaugaagaacagaaccaggagcacagugaagaugaugaagacguagggaccacacaguugcugaaagacacacagacacacuugguuggagucaugacccuacauccuggcuguaggacuuuggauaagucacuuuaccuuugggccuuugagcugaaaagggaacauccaccuacccagggaugcuaucauaauuaacugagaccacgcuuguaccuagaauguaacaggcuccaggagcaccauucaaggcuaaggggagaacccuggaguugaggucagcauucuuggucaugugaccugggcuuccuacccucaguuuccuccucagcaugauuccuaaugagaaugcugggccagcacuuugcacagcacuguggggucaugcgugcgggugaguauagagacaguggggguucucaccuccacauacuggaagcacaugcccacaaugaaauuugagguccaguuggagaagccugcaacggcaauggcagcuggacguggacccuggcugaagaguucagccacgaugaaccaugggauggggccaggacccacuucaaagaaggccacaaagccaaagauggccacgaugcucagauaggacauccaggguagcugcuccuguugaggaugacggagagggggaaaaguuagacuggguugugauggauccucaggggaaacagaagcuacagaggccagagcagagcuaugcgagaaggcaggaagccuggggaugguccuggauuuguuguguauccagcauugggccuaaguuuccucauccgaacaaaaugauuuaaguccugcaggguggcugcaaguguugaguccacccgcugggagugguaauguggugugcauguggacggugcuaagaggccccaugguccccugucugugccugcagcacaguccgccuguggcaggaugcagaacauuccugggggugggguggauucagguucuaaggcgugugaggugcccagcucaggcuggcacagaguaagcgcuaagcauacgguucugcauauaaccauucuugaggaggccaggguagaaaauuuaugggcuuuccacuugcugccugucuggccuuucggcaaccaccaaacuuuccaagcccagguugagcuguaaaaugacagucauggugcuuuccuugcccagaggcuaaauaaacgagugccugugugugagugccaggcacaggguuagcacagcggucacagucacaggccugggacugagguugauuccuggcuucauccuuuaucugacaaguuacuaaccucacugggacuuaagcuuccucccccauaaaaugggaagaacugaacuacaccuccagucgugugaacugaaugaggcaaggcauguuucugcgccucuauggggaggacagcacuacuucccgggguugcugugaagaugaauugaggcuacagaugaagauuggaaaggguuaauauuaggcaaagcaauuccuuaaggaggugagaguuuggggucugggaccagaggugcugcgcugagaauccaucaagcagggaggagcaaguucaagagaggaugugugugguuuggaaggagacaacuucaggagccagaaagucagacccacagccagggagaaugcagccaccaaaaggccugccagccuggggcugagacaggcauuuugggauaugaagcccaggcaaacucucccgcaucccucacucuccagaaccuagcaacucaccagcagugcuagcgcgauggucaugaguauggcacaacccgccaugccagcgaggccuaugaggugcaggguccgccggccugcucgcuccaccacaaacagcugugggcagagacagugucagugccaccccugccuagugcccuucugaacccacccacccagaggccuugccucaagagcugagaaagucacagggcacugcaaagaccaguggggaagauggcacugccuccucccugggguuuggcugggggggccaguaagcaaagacucaccgacacgacagugaaggccguguugacgauaccggagccaaugguggcauacacaggcugcugcacccccgccuucucgaagaugcucguggaguaauagaagaccugccagacaagagaaacuguuggggccuaccuggacauuguggcccuucccugccucuguagcaguggaugugggacccaggaugaguaaagaaugaaggggacaaauacucaggcagaagggacacugcacugcagugaccuuacgggcuuggggucuaaagggaaacuucuucggcagaggcguaucuguuguuucaaguuugggacuuguucaccaugcacacuugaccagagggcuuggcuggggcacaggaagggugggugggggcacucacagcguugaugccagacagcugcugggacagcugcagcaccacagcgaugaggaugggcuggcgguaggcgggggagcggaacagcuccaggauggugaccuucuucucccgcaucaucugccgacucucuuccuucaucuccugcaggucaugggucacgucagcugucccgcgcagcuucuuuagcacuggggggaccggagggaaggugaggguggcucagagugggaagaaggccagggcucagggaguggggaggagggcagggccaugcccguaccacucuuggcccgguucuccucguugcgguugaugagcaggaagcggggacucucggggcagaagggcagcacgaugcacugcagcagggccgggaugaagaugaugcucagcagcaggggccacagguccuuguugcccaugauggaguccaggccgaacaccugggggaagcaggggccgugagcgccucugcccugacccccuuucccaccccguccugccagaguggccuucccuacuuugugucagcugcugcuucagggaagggccccaguucuagaggcucugccacuagcaugagcccuguuucucaguuuccucaucggucacaugggaaaaguaggaccuaccccacaguguugcugggaggacaaaugacaaggccacagauguguccagcacagagaaugggggcugcuacucugccacaagaggguuuuggggacagggaaggggaagccuccuggagagaggguacugugcauaacagccugcggcauguugggggaaggcgggcccugugguuggaagccuagagugagaagaaagggacugagaagagucaagucaucuugcugucaacugggaggccauggugcuguguucucuggaccuguguaccauaguuguccucugcaaggcugugggggcugggcggaagagaaacucugcccugcugggcacagauccgagagccacugaagcugugggcaggggccgugccaggcagguagauccugccccagcuuaccugggcgaugaggaugccgacgacgaugcccagcuggugcagggugcccagggccccacgaagggcugugggugacacuucacccacauacaugggcacgaagccuguggucaggccgcaguacacaccgaugaugaagcggcccaggaucagcaucucaaaggacuugcccaguuucgagaagcccaugagcacggcggacacgaaggccagcagguucaucaucagcauugaauuccgccuggggacggggucacaggucaggccagugcccacauuccuugggcuccgaggggcugggucagagguaauacccuggaacaggcagauaagucuccccuaccucccaccccaucugggacucccugggcaggagggcaugggcccuccaagggcagugccaggaccucuccuacuuaccggccaaagcgguuaacgaaaaggcccacagagaaggagccaaucaugcccccaacagaaaagauggccacugagagggaccagagcguggugagcguggugggcaggaugcucuccccauagcgguggacccaugucugguuguagaacuccucgaucaccugcagggggagaugcagccugggugagcaagccaggggccaggacccagucuuccuuuuccuuuccccuugcaccccucccuaagagagggccagggccuggcucugccacagauucacugcauguucuugagccaagucccucuauuuuugugggccucacuuuccccaggcgagaaacaagggguuggaguucaucugagagccccgccaacucucccacuuccccuaacgugugguuuccagugcccugugguuucacaggcucagugugacuugcugggaugauggcaagugaucagugguggaaguucaggcauagaacagagagguacaagaccaggugugguggcucacgccuguaaucccagcacuuugggagaucaaggcaagcagaucacuggagaucaggaguucgagaccagccagaccaacauggugaaacccuaucucuacuaaaaauaaaaaaaaaauuagcuggacgugguggcgcaagcauguaaucccagcuacacgggaggcuaaggcagaauugcuuaaacccaggacacggaguuugcagugagccaagacugugccacugcacuucagccugagugacagagugagacucuaugucucaaaaaaaaaaaaaaaaaaagagaaauacagaaggaaaagggucuucccacuugccccuuuucuccucaccaugucucaaagccccaggggcccaucuccugccaucaggcccuccccccaaccccuugcuggggaggaagcagggcuugacagacagguuccgccauccaggaaguacagacucccugaccgcacugagggccuggugugacaaacucacacaugucacccuucagaagugcuugaaagacucacgcuguggcuuucuguuccccaggccuagcucccuugugucuggccugcgagcacccccuugaaggacccacggccuccuccccucucccaagggcccagcuaggagguauggggaaagguuccacacaaggaagcaguuccaggaacuggaaacgcccguccuagggcagcccugcccaccagcccugcccccacccuggccagcucccacggaugugguaggcaggcagcacccguucugccugagcacacucaccacacucucagugccaugggacuggccagacccacccagccacacguauagcagagugcaggcccuaguuacccagaaacggcuucuuaugcacguauaccaucacacacacauacccgugcucauagaaucuaaauauuccugcuuuagccagucacaaacucacaugccccucauccccuaccacuuacagcucaaacucaauuccaugugaacccaacccaucccaacaccccuccgugugugugcaugccacagguucaugcacacacagcgguaugcagccucugcagccuccaucacugcuguugguccucccuaucccuuccaacccacugaggucuagcagaagaagaaggugugggcaggcacacuugccaaaccaaagccugcagucccagaaaugcccaccuauucaaauaugcugggccugccuccuggugccuuccuucccauugcugugggugcucagccucuagccaucuuuuccccugcccugucacaaccugucccaagucagcaggcaucugauggaggccaggcuccaaggggcgaggacaguugguagggcagaggcaagcccuaaggaucugcuuguccguuccaaggacgccaugcagggcagugaauagaaaccugaacucugauucuggacacaacuaaauucagguccuagcuccaccccuuauuuccagugugaccaugagcaaguuauuucaucugugaguuuccauggccccauuucuaaagugcagacauuagcaggagcugcuucacagugcugcagggaaucagugaaacagugcuuggugucaucaucccuaaaaucaccccacugcacacugguggccugaaggcugugcagaccacuaacagagucuccccaagccuucaacccguaacucaaaaucggggcuccugccagguaucaauccaaucucccuaccuaccacaccuuugcacucacuacacaccaucucccaccccucuacgccuuugagaugcuacuacuccugccuggaagguaccccuggccuuauugcugaaaccuuucgagauccagguuucccugacuccaggaguuugucuucccugaggaagacaguugauucacaccauggucugucccagagccagugccagggauaccuggugaggaaauggaggaaucgaaccaaagguguuaggcucuccucuuagaaccccuugauucugcugggggcagacagaaggcagauuuugacaaaaaacagaguaacaaaaugcaaaguguucuucuguggacgaaacuaaccccagaggaggacugguugggaacgguaaugccccguuuaucaggcuccaccaagaacaggcugcucugaaugaggguggauaugggaacgguccagauaaauggcgcuugcccuucugaggguccaaucuuuccugacccauuauggggugaaaaugugaagagauuucacuuugcucuccugagcaaccagaccuacaagcagggcugcagggcaauggugucugcccuuggggcucucuccaggggcaaggagagguguuugucccugugcagacuggcuccugauggcuaaauuucugcauuccauaguucuaagguauucccccaacccucugugguucagaggcuugucuuguacaacucuccacaccucuuuugaaauuugccaagaagucagcaaauggaauuuguuugaauuguauacaaagaaagaguaaauaggugcuaaguaaggcuugaaacuaccuaaauaagcuugaagaucucuugagauguuggggcaacugacaagagggcuguguguaagugaggugugaccagagcuccacccugaguuacgucuccugccuguggucacacagucaaagggacccaaccuuguccagggcuggcuccuggacgcugccuagcugcucuguuacucagaccacuuuaugggguggaggaagggugagcagccagcucucugcauguucaccuuggccuagacccauccucuccagcccacagcagcacuuccuggccaagcugaggcuggggaguggguuucugccucuugaugccugagauuucugggaagaagccacgccugguuuuccaauuccuacugcugguuccggugcucugugcccucuccucccuggggauucguaugggguuccacgcugacucuuggcccaggaaaggcagggggaugcuggagaaugagaagaacccuacauggggaaaagcucuggggucacauccucccuagaagugucugggugcaccucaggaaagaagagucuacuuauuaugcccugacaggaucccacaggcccaaucccgccggcucccagcagccuccgcaacccugggucaugugugaggugagaccuggcacgugccuguucugaacgcucccaccucacaugcccgucccaagcuuaggauuuaaacacuugaugcugccaccaccccacauccauccaucaccagguccucucgauucugccuccgagucuguccuacuucucuacccaggcagccugcccugggucucaucuggauucugcucccgacucuuccuauccaccaaagucagaccccauuucccacagugaaccaccccucagaaugcagucggaguccugcacaccaaaugugccaggcucggccauccacccgcuucucugcucccuucccagcccagucucuucacccagcuguggagucuggguggcggcaagcguguugaggagggaggagcgguucugguuaguuccuggggggacugccauggugucggccagccuagagcugaggggcuacuacagaucucuguccaggugccucacugagccuagaggacacccaccauggagaccacccuggagaagcagguugacucugggcagcugagauccuuugaaccggauggcuucugguacgcgaagcuauuccucacccgguggcucuccuggggugagggggaggccugcccaagccuaaggacaccugggaauccccacaccaccucccgccagucgaggcaacugugggugagacuacaugucugcccaucugccaaggaacuucucacuuccccuuuguagaggggcaugaggcggcgaacacugccuggcacauggguaagcuguuacugcugucacuguugcucucucaagaaaagaagucaccacuuucggaggagccuuagggacaagguuuuccauuuugaaauugccagaaaucauuacccuaagaauguaagaguaaggaggaaccugaaggaacuacgggccugccucagggaauaaagcuagucuccagacccugcucggcugcuccuggcagaggaacccagcacucuguagccccagagggcagaggugccagggccagacuccagcucaggggaaggaagagcuuuauagacuucaggguaugaggcugcccaccuuacagguggugaguucccuguaaguagggagcaugcaagucaaagugcuccagagccggacugggguaaacauuuuauguaaaaggcuagcuagaauccauuagguagggucugugagccacauauggccucugucacucauuguucuuuuuuucucaaccuuguaaaaauguaaaaaccauuguuagcucauggguugcacaaaaacaggcugcuggcuggauguggcccuccugccaacccuugaucuaggauucuagaccacugccaggagggguaugcguuuuggaaccucuggcuggucucaccauccuucccucuagacauuccuuuaccccaggaggacuaggucaguuaggucauccccagcagggaucccugggccagguuuaggcucggucucaacucucccugugcucuacgggaugcuauuguggggaagaaggggcuaaacugccagccaagcuuucagcgccaguuacaaggaggaaagggccagcuucuccggcuuagccucucagccuggccuucaccccuguuccuugccugccccugucuuccaguuggggcuggccccacacugcccuucccacaagcucucagcccagggccuucaucuccacagcaacucucagccacaccccagggugagcugggagauuggagccagauguuccagguggggcuggacagauaacccugcccacuggguccccuggggccucacuuuggggccugggggaagaggcccagguuggggcuagagcugggccccaaccccccugcagagggcuggaccacccaggcugcuucccuggaacagcccugacauggcuagccuccaaaccaaggccaggccaggccaggccucccgguagacagaggaaucaucccacugccguggccacacccgaagcccuucucagcucuugcaauaaagugucuccucuaccccaacuaugacucacaaggcacacgcagugacucccucauacgaccuagacaccucacaccuuugcuugggccuaaucaccuuucagaacaugcacagauacuccucuggaaagccuuccucccgagaaccaccccucccacuccacugcaacugguucucaaacagagacggcuuugguaccccauaggacaucugccaaugcccagagacauuuuugguugccacacuggcuacugguaucuagagggcagaagccaaggaugcugauaaacauccuccaaugcaugggacaggccucuacaacaccagcagaaacaucacagugccaagcugagaaacccugcucuaagggcgaagcacccucucccucuuccuucccugcucccacugugcuugcucgcauuuccaucaucgccuuuagaagacuaacuguaagguaccgugugcucccuguacaguaaaccucagcacggagauggucugucugaugcauccauguugcuggugcccagcacggugguggaggugcagaguugacacuaaaugaccaacaagccaugaaucuaacugaagggcuugaggggugaugugauaugacagggugugaugguguaagagauugugcaacugugugugggaaaccugagauguugguacaugacugagcuugacucagcuccaaagugagaccacacacugccagcuagguggcaguuguaggugagugaaaggguguuuaggugcccaucugggacuguguccaucuuccacaauggucaagggcacagacuagggccagacuccccggaguuacauugcagccuugccacuuacuagcuguguguccuugcuuuaauugcuuaacauuccugugccccaguuucuuauagagcagggaaaauuauggugucugccuaaugggguuauuuugaagaacaacugaauuacuauuucuagaguauguauaacaaugccugggcaagcuauaaguaagcaguaaggguuuaugguaguggugacgggugaaggggagagaggacuagaacucuuuggauauaggagagagaaggagaggcugccuagagcacgaagcccaguucagccugacgggacacagggcuuggguugggaggcggguguugccuccagcucuuucacucaccaagcugggucauccugggcagaccucaccuccucugcagaccagguuccuccuuugucaaacaaggaguguuguuugucaaacaacugaggccuuucuggcccaaacucuggauucugaggaugccuuauucucagacaugccugacacugucccuugggccaggacuucaugguuucucaguggccgucagucaucucuacuggcagcucagucauuuggggaggggaaaggcagugcucggaugagcccaguaugauggucaggauucccugguucauuuagcugcucccucuguggcugggcucaccucuucugcucuguccuccuccuccaggaggggaugcauggcaggaauguccugucacacucacagcagggcaggggcagugugcagagcuggggaggcacaaggccuggagcccaccucuagcucagccucucacucuccagauaccucaucuggcuucaguucccucauuuagaagaggggaagaugucagccccgccugccuuguagaguugcugugaggugguaauuuaugggguggugcuuuguaaacauauaagguaguaugauuaauuaaccacuuccaggaggaagcccuuuggggccuguuuuauggaagagaacaagcuucuggcauccucaccacuuguggggcaaagucucuucucaagaguaggcaaacuguggccaacccaaugcuguuuccuaagagagguucuucuaaacagacaagggaagucagugugcccacugcaggcaguuagcaauuccgcaucagcagaacauuucacaccccugcaccucugcagaagccccucucacugcccagacaccugccccuccugcccuaugaggucaacuaacccuucaaggucgagcauggcugccaaguccuucgugaagcccuuuuuuuaaucuccccugucaccccagccccagcauuaguugccccguuugcucucacagcaccuugaagcccucuguuagugacacucuggcuuucuccaaggggucucucccacugcuguggagacagggccuggcucagacugugucucaggcagcucccugagggccagcaugugccugcuguguucacagcuauacuucucucuccuuacugucuaggaccgcaucuggcacagcguggaugcucaggaaguccuggcugaaugaaaggguuggccagauggaaucucugugucgcccuagggcaggccuucagccuacgcgggcacaggagucucucugcccuguuacuacacaugggcucugagccucacuuucauuucuucuucuuggguccuucuguccucucuucacauguuacauguaucacuucuaaucuggcuccugguuggaaaaacuacagccagccuugugagaaguguuuguaaaguacaaaagucaacagaccaagugucugggugcuugcccaagaaacaccgcuagauuucagcguucucaguucuggccacucacaucuccagcuucggucugcuggggcugguuccugaagugaccuuuggacaggugaccauacaugguccuaugaaugcaguuuacaggcucaucugggcccucugugcugcugaccagccccgugaugcccuggucagagguucugcccauauuccaugacaguuauaaccucuugccuauuucugauuagaugggaggccccggggaucacagaaguucaucucagauuugucuacaucuucagaagucucucagucccuggcugggcaugguggcucauaccuguaaucccagcacuuugggaggccaaggcagguggaucgccugaggucaggaguuugagaccagccucaccaaccuggugaaaccccaucucuacuaaaaacacaaaaauuagcugggcguggugguacacaccuguaccaguagcccagcuacuuggaaagcugaggcacgagaaccacuugaacccaggaagcggagguugcagugagccaagaucaugccacuguacucuggccugggcagcagagcaagacuccgucucaaaaaaaaaaaaaaaaaaaaagguaucucagucccuccuggccaaaggcagccccucccuucugcuccgacaccacccucccuccuggaagaccuccgcccucacuuccuuaucuucacccucuccugcugauuccuuccaacauguuuaaaaauaaccuucauuaaaauaaauaaauaaauuccuagccauaccaucauuccaaaccuccucuuuucucccucucccaccaacucuuuuggaagagccgucuccacccuuucucaucugccucucacucuucacccaaucguagugaggcuucuauccacgcugugccacccagucagcccgaguggccacaaggccaccaucgccucuucugcauucagcaauguggagaggcuugcccaguucaaccccugggguacccgauggccuuccuccacucacuauccaccagugucuauuacuaugacaggcaccguucuaggcacuaaggacacggccguggacaaaccagacaaauacccuggcccuucgauggcuuacauuaucccucugucuugggaggguauccucuccugguuuuagagauaccagcucuuguucuucuacuuagggucuuuuucuagcaauggguuguucucuggggccuugaucuuuuacuuuuaauuuuuauuuauuuaauuauaaaauugagaugaggucuugauguguugcucaggcuggucuugaacuccugggcucaagugauccacccaccucagccucccaaagugcugggauuacagcgugagccacaugcccggccuuaaucuucauuucucuuuuuauuccacagucucccuagaagaucuuucuccacuguguggauaccagugacuaauucucaacuuuucuccagccugggucuaagaaacagacccauacauacaggugccuccugcacaucuccagcugugucaccccacgccuccauuccugcacaucccacggccaccucucagcuccuggcacaccugcuccuucuucaaaccacacaucacccaugccagaaaccuagaaaccauuuuuaaacccuucucuguugcccucgcacggaauugaugaccaaauccuguccauucuuccucugaggguuugcuuuuaugucacuaguccaacggcaacuuucuugaugguuucccgucucuagucucacauucuuaaguccgccccuccauaccagacgccugagucauuucccuacaaugcaagucugaucacgucugcccugggcagugggucccuauuguccucauccugaaguccaugcucccuagcugggcccccgugcuggugcccauccgccccuucugacugugccgugccauacucacaaggcccuuuguggucuggcucuugccuaccuuaccuuguugaccuccccaaccuuuccccuccuccuguucacucuagugacacacuaaacuacucacgcuuuacugaaugccaggcuuucugucuucugggcauuuugcuuugaaggcccccugcucaccccaacccuguucuguuucuggaaaacaccuccucuguccuggccuuagaguccuaguucugucauuaacucacuaugagaucacagucaagacaucauuaaauccaguagcugucaaccuuggcugcacauucgaauugguugggaagcuuuuaauugaaugcccaaacagcaucccagaccaauuaaaucagaaucugggggcguucuggaaaccccaaugugcaaccaaguggagagcucaaccucccucuguuuccucccagccugucuuacagacuuuccaucuguaaggauucccaaagggagccaguucugaagcacacacuuuggcaagagcugucaagagcacuuagcaaaugcagggcuuggggcugguccaagcaugggcccacggucuccaugcccagcaaacuuggaaaaguccugucaccuccccugcagcugagcaugacucagcaggccaagccuuccuggugacuugcuccucagcaucgggcguggccccauagccacugucugccuauuuggaagaagcccagcuaacucuagacacuaccugguucccccaaacaggacccugaucuuugggagucacugcacucacuuucuagccccauccgucuggacaagaaaugugguccugacgugaggacugcccacucucauuugguccucucugggaagguacagauuuuuaaacgggcaaggcagcugguuaggaagacaaccugaggccauggaaacaacagagcuuggcuucugacuccagcauucaauagcuuugugaccuugggccugucggccauuucaucugccugggccucaguuuccgggucuacaaaauggaaaucaccacccaaucucauaaacacaagcaaaaugccugguacagaggaagggcucaguuuccuuuccugucccugccuccuacccccuacccccuuuuccucuucucuccuccuuaaugcaaguaggcugggcuggaggagauggucuaggucccuucccauccugacauucaaguaaacaagugaggacagaucuaggaugcacggcagggaggaggaagccagcacagaccuucacccccuguggcucccuagggcaagacgccauuucugcuuugacugccacagggccuucagggagaggacgcgguuucaaccuacaaauaaaggaagugugcugccuguggauggguaugagugcaggcucaaggaccaccuggcaggcagguguuggauaccagcucugucucugacuuagcugggugauauugggcggguuuccucucucuggccguuucccacaccugcaggcugggaguggugccugcugccuccugacagugcugcagugagcaucaagugagacaagcccaugaaaacccucugcagccccagaaugccacggaaaugcagcauuauuguauugagcuuugcuuugaguuuauuauaucaucaaacauauuauuaaaugacugaguugggugggggguuggucaagagggccuauacaagaccccaggauucugugggaccugagauucuagaauucugccacccugauuccaaagcaagagaagagucucugacaugaucagggccagaaaacuggcuggagaggcagacaguacagugcguucauauaaaugacucuaauucaggugguggcgugagacugugggcaugugugaugugcaacagagcaggcugguguccauaagccaacgauggcacaguacucaccuucuggggggcauugaugacuccaguguuguagccaaacugcagggagccaagcacugcuccucccacggccagcaugaggcgacccgucagcuucugcggagaaacaaaccacacuguuauaggcgugucugggagcagguuacuacagggcagggccuggacuggcaaguuucuguguucagauaucuugccugacucuuggcaccacaccagucuuucucccaggaaacuuggccaauuccugaccuuaggugcccaaaccagccuagcugacuucaagauacugggcuggccgggccauuuccuggggagagaggggaaguaugaucuucucucucuguagccaggucucagagagggagaggcuuuggauucuugggggucucauuucccugguggagccaugccuagggucuggugguucuagacucucugacugggaggcccaggaaccagcccuccuaugcgagggggcccaaauuacuugguaggaauagcacagauauagauaggagaagcacccuggauuuggagcugaagccgcuggcuucugauuccagcccaucugccuguuugcucugugaauuccagcaggcuaagucccccauguaccaccucuccccuauccuccauuugcuugucagcaaaauggcaacagcuucguuugucacauuggagaugugaucccaccuugcccuacccuuccugcuguucacagggcaggaaacugagcccugagagggugaggcaaguuccagaucacucaggagccugcagcagagcucagggcuccggacuccuuacccagugcuccucacggcaauaauccccaaaccauaagccucccaagguuauauggacauagacgacaugcuaggcgggaaugcacuuuggaaaagugcacaaggugaguaagaguguggggcuaagguguuuccaaugggcaaagggaugggagagaaaaagagcaguuugcuucuguccauuggaagccgaggaccuaaggcagcaggaagggcagaggccagcaggugaagagcccugcuuagccacaggugacugagaggccagcagggugucagcccugcugaagaaaagugcucuuuucagcuauaaaaaugaggaagucaggaaaugugacauuaggcaggccuuuaacugauugugggagaacagggcugcgggaggcaugccaaagaaacgacuggcauucacuacgcacacuauaccaagcugggcccuggaaguggguggagcuggccauggccuggcugugggucucugggccuugguuuccacagaacccagaagcagccuuuacuucaagaucaucacagauagcccugggcauagcuguuaccaggcauauucccaguauggucuuuucauucucugaaagcgucagucagggcaacgacugcaaaagccaaggcucucacaucagaggcugcgaaagaggaagaaggcuucggcccaggaggagugugcagcucagagcccccucugugugugcgcugcauccuuccuucccauuagucugucuaccugaccccuuagccugccucuggacauuuauuccacaugcuggggcuucccucauaccacagggacuccauucccucuaaauccucugcauugcccaacuagaaagacagcccccaccccccguauguccuggcacugcccccagaaucucccuucucucaauucucuggggagccuucaggcccagagcuguuguuccgaguggguagugagcagcugacaaauuucugggggaccccagcgacacaccaggucaagccuaauucauaggguggacacuaauucagaggcuguggcaaggcacuaagcaucaccaggagggcucacuaaacagcgacugcuaggcccgccacgugcugggcuuucugccugcgguauuaccugcauuugcucaugggaugcaaaguauauacuguauuuuucuggaacacauuagaauagauuaaaaaacaagcaaugcagugacaucaaucuaucauuuaagaaaacguggcauagugauauaauggaauacauaaccugggaguucgaggccgcagugagcugugaucaccccauggcacuccagccugggugacagagugagacucugucccaaaaaacaaaagcgaaaccaaaaacagagcaguguguauauuguaugcuaccuuuuggguuaaaaaaaaaaauuggcuggggguagggggagaauauacacaucuauuuaaaagaaugcacaagaggcuaggcacgguggcucacaucuauaaucucagcuugaggccaggaguucgagaccagccuggccaacauggcaaaacccugucucuacuaaaaauacaaaaauuagcugggcaugguggugcgugccuguagucccaacuacuugggaggcugagggacaagaaucacuuuaucugggagaugaagugagccgagauggcgccacugcacuccagccugggcgacagagcagacucugucucaaaaaaaaaaaaaaacaaaaaacaaaaaacaagaauguacaagaaagguaacauucuaaccccgggggggccugggugacuggggacagggugaaagggagauuucauuuuauagccuuuggcacuuuuuugaauucugaauggugugaauggaaucaccuauucaaaauaauuuuuacaagcccugugauuucauauuacuuagaacaaagcaauuuaaauaaaaacauuaaguggaaaauaauacaaaugauccauggaucuggcaaaaauuauguugguagagcaugagugaaugacacuggcuaugugagguaagugcuauuaucacaggcccuguuuuacugaggucugcaucugauguuccaggggucuggagccucugaagucaucccuggggccccacugagcagcugcucgacuguagccucugucaaugggggcugcuggaggccaaggacauaccccuccgcuggaccuugucaucagcaggucgaggucaaacucgacuuuagaaaaccugccuacccacucccugggucauauccacauccacccaggcagcugcugcacuaggacugacuaaaauaccagugacccaugcucuaggucucaugcuaaguagagcuggggccccggaugaaacuggacccaguccugacaccaaggaaggaguuuccaguacaguggggugggggcaguggggaggcagaugaagaugagaggcuaguguggucugggcuucaacagggggcugguaugaggcacugugagaacccuggagggaaagauuuccaguuuugccuggguacaaaaaaagaugaguucccaggaggugacauuggagcugggcugugaaggacacacagagagucugccaagugggaaagcaguggcaaggcuacauuccagguggacagaacaguaugugcaaggagaagaaauggggaccagucagauuaagaaacagcgugcucaguguggcucagugcuagguguagggggagggacauggccccugcuccucaguaggcacaagacacugcgaccaaucucagauucaugcugccacucugcugcgcccacuauagccggcuugaucauugcugggcuuggaagcagacccacguuuaaaugcagcaagcugccuccuuucaccuuggaguuggauacaaggcagcccugcucugggccuugguuuccucaccuagaaaacggggaugaaaguuccuuccuuaaaggguugcuguuacguuuucuaucaguauccaucaugaagccuggcagaauucccuccacaaguguuugcuggaucggugaagaauagcaagcuacccucgaucgggcagccucagcaccaucugcccccaccagccaguggcuagaacuggaacauggcaaugaaguccauucacucaacguguauuuauuuauucuggugucaagcugaugaacaguuggugaugacuuagagaaggguacuagccccauagagcuugugauuuucuugugggagccuuuuuuacugguggggagcaauguacagcccagagucugggauccccagcagcccaucagcacucccuggggaugagacuacuuucuagaacauuccauucucuuccaggccuuugcucuugcuauguccucugcagucucuagcuuauuacccaucugccacucaguuugggaacuccuuaagaauagaaccaggggcaggacgcggugaucccagaacuuugggaggccaaggugggcggaucauuugagcucaggaguucaagaccugccugggcaauauggugaaaccaggucucuacuaaaauuacacacacacacacacaaaaaaaaaaaaaaaaaaaaaaaaacagcuggauaugguggcacacaucuguaucaccugagccugggaggcagaaguugcagugagccaagaucaugccacuucacuccagccucggcaacagagugagauaaaaaaaaggaauggaaccugggucauaccgugucugcagccagagugacgagaguagggaacagcacaugcuaauugccaaacaaagaaaccugccacuuuucaauuuggcuuuugggcaaagcuggcucugugaguaucuguugugccagaccaguguucauccuuagccauuuaucaaaccccugacgagugcuggaacaucagagcucugagagguaaauacagcaccccacaaaacccuccacuccaagcccacagggcugucaaggaaggaccucugaagucaggcagacugaguucaaauccugacucuccuaggagagucauggccucccagcuuggccagcaacugggcucaggguccagcacagagaagcauuucucauguccccaccccucacccucccuaucccaccgcugggggucucacgacccacaagagcccucccucucccaggaagccauggaugagguguuaagauucaggaccucucccccaacgcucggaugccagauggcccuggccacauuguauaacuugccaaacacuguggccuuuugacccaugucagugugucagcauugcgcuccagccccaggguuggccugcagcagguucucaaucuauauuggcacaggaagggcacguggcuacugcuacucagaggcaggguauuccuggcaagaggagggucccagggcuggcagacuccagauguugcuccaucuuguccucuucccacagcaucccacauggguuccccaggugcagggaagcaggggacgcagggcuuuccaacugcuuaguccacggcucaaaggagugggggagggguuuaccugaauccaugacagcucccuuuuaauuuguuuuguuguguuucuuacucauuuaaaugaacuucugggcauuaaaagaaagaaccucaaggcugggcgcgguggcuuacaccuauaaucccagcacucugguaggccgaggcgggcggauugguuaaggccaggaguuccagaccagcuuggccaacacagcaaaacccugucucuacuaaaaauagaaaaguuggagccgggcacgguggcucaccccuguaaucccagcacuuugggaggcaaggcgggcagaucacgaggucaggagaucgagaccauccuggcuaacacggugaaaccccguuucuacuaaaaauacaaaaaaaaaauuagcccggcaugguggcgcaugccuguagucccagcuacucgggaggcugaggcaggagaauggcuugaacccaggaggcagagcuugcagugagcugagaucgcgccacugcacuccagccugggcgacagagcaagacucugucucaaaaaaaaaaaaaaaaaguacaaaaauuaguggggugugguggcacaugccuauaaucccagcuacuugggaggcugaggcaggagaauagaaucacuuuaaccugggaggcggagguuguagugagcagauauugcacgacugcauuccagucugggcgacagagugagacacucucaaaagaaaaaaaaauaagacagcuuuggcugcaauaagaaagaaagaagcucaagaaauugcagacugcuguaacaucggcacuugacaggaggcaccugaggucagagggcaggugcccagccuagcauacaaacaaaagccaggguugggacuagaguuguuugguuuccuagccuggcauucuacccucugaccgguuccauccugccaagccuuuuaaaaaagaagagugauggacuaacaguccaaaaccugaccuuagggugaccucaagcauuaagugcuccugaagccacuuccuuuaagccuuccaaugauaucaagacccuugcaugacugaaccuccagacaccccugguugcccucgaggcagaaggcacucgccagucuucaaaguagaacugagaggagggggcuggugcauuuagcagcagcagcagcagcgagcugaggcacccugccagaggcugcucacacauucugauuaaccaccaugaacaagcuuuuggggagcgauuacucccuuuucacagaugagaaaugagagagagggaaaagcgcagaaccaggggacucuaggcuucagggaaguuuccaauugggggucucugaugccaaauucuauggcuuuccugcuuagguccucccccuuguuuccggguacuggucccugaaggaaacaagguuucuaccuggugcuuucuauguaggucaaauuccauaaaagcaacucucugagccuugcccacucugagcugagacagcccgggcacaggcucagaaaccuuugggccacuuugcugcauuugcuauaagccaaaguuggcaaacuauggcagcuaagaaugaguuuuacauuuuuaaguagcuggggagaaaaaaaagacaaugacuaauauuuugugauauguaagaauuauauuaaauucacauuucagugaccaugaauaaaguuuuauuggaacacagccacacucauuugucuacagcugcuuuuguacugcaacagcaaagcugaguggcaggccgagaacuacauguccaacaaagcugacaauauuuacgcucuaucuggcccuuuagaaaaaaguugaucggccucugcuuuaagccccacguccccugagcuagcugcccagcauucucaaagccuuccaggcaaaaccacauccucccuaaauaaccgaaaagguaugcauccuauuauggaauguuaaauguaaauggcuccuuggccauguguggguguggggccaggaucuggacccuggggaaacugacaccccugagaagauacacauuugguggugagaugggcaauaauucaacuaagagaacauuaauuugguaagauugggcacaugcaaaguucacugucacucucagcagacacauuuaagucccagcuccuccacuugugugaccuuaaaaaaguccuuuccuggcugggcaugguggcucacgccuguaauuccagcacuuugggaggcugaggugggcggaucaccugaggucaggaguucaagaccagccugaccaacauggugaaaccccgucucuacuaaaaauacgaaaaauuagcugggcguggggggcgcgcgccuguaaucccaacuacucgggaggcugaggcaggagaaucacuugaacccgggaggcagagguugcagugagccgagaucgcgccauugcacuccagcuugggcaacaagagugaaacuccgucucaaaaaaaagucucuuccucuaagcuucaguuaauucuccauaagagaggaucuucuaugaauaaaugauauugcuaaggaaagauuaugccugaaugcaugcucccaacacucuucuagucaauggaaauucagcgauaaaacuauaccaaaucccugccuauggaacuugauagguuaguugaaggcuggggcagaaaauaaauacauguaauacaucagguggugagugguaugaagaaggugauggggcugcuauuucuuaaucauggugggacaugccuguaaugaaguauuaugcagcuauuggaaagaaugaaacacaucuguguuucacauaacauguauguguuaugaagaguaccaggguagauuguucaggggggaaaaaaagcaauaggauguacauauuguguaaggaacagggaguuagugaacuuguauaguggcacuugguuguaugugcagagagaaacacugccaguauuuaccucuaaggguugguuuggugaacagaauggguugcaaagaacuaugcagaaagugggauccaacuacacaaauauucuauuuauaggcauguaucuacacaugcacaaagagaagucuuuaggguaaacaccaaacugucaaaacuagaagacacucuuucauuuauuaugcuucucuguaguuggcucuguaacuucugaagcuuuuuuuuaauccaauuuuuuuuccagucacaucuaagaacuuuauuggacacagcuuggaugccaggaccugguaggccccacacacugccugcuaggcccuggacuguccagggcuggagugaggguaguucaugcaaggaagugucagaccacaugguaaccccacaaugcaacacugugguuagagacuuuauauagcugggagauggagggcugccccacagauguaugaacagguccaaucuuccauaaauaaaccuacagaagagagaaaauuacacuggaauucauccuuagacgcagaguacccuagaugggagggggcauccucacuggucagggggccaggaugggugaugagggggcccagauauccacagcauggggcaggcaggggcaaggauggggucaacagaugaugggcauuugcacuaggacacugcauucacaagaccaacuacugaagggauaugugucucaggcuguucauucuggaauaagcaggggugaucuuuauaucacauucuguggcuggugggcucaaaggcuacuuuguggagagaaugagaccaugcagugaaaaugaggaucaggaucaagcccacaaauagcccgggcuucuaggcagcacugugucccccacagugcugaugacauagcuggcugccgggccacucaggcccacacucagccuagcgcuuggcuggaggagauucccguagaggcugaugcagucgaucagcgaguuggggauaaggacuuccaucaccagguuguagauggugaugaugccagccaugaccgcugggacacuggacuucaggaucagcuccagccgcauaagggccagggccacgaggcagugcugcucuaggcugugccacagacagcacacagggcugugggauggaggcaaggcgagcccagagcagaaucuguuuaccuggggccagaacccucugggaauagcuucugcacagcugugagggccacacccaaguuaucacacgcagcagggagcugaaggcagcccccaccuaggggcaggaaguccucaagaagaacugccacagcugggugaucaaggagcccaguguagcuguuuguuucuuuccuugaacugggcccuccagcccaagagaguccaccucuuccuccagcagaggugcuuauggcuagcuggccugucugggcucccacugugcuaugaaacccaaucugugcugcucagcacuccccaagccugcugcacagaccacaugcuccccuggagccucagugccgcugacccagacagcuagcucucauccccaguacagcugaggacacaagcuccaacaagaaguguggcuggccuaagguccaaugguagagcuguuucugauggagccguuuccuccccacucccaaaugccagggcagggggagauaaacugggcuaggagacauaggcagacuuccuguccagcagaggccucaguagccaaaggcuccaucagcugaggccuggcaagagcucucucccauuccagggugcagaagccucagggaggcaagucaguguggucacaaagagaggagaugcugucuucuuucugcccagguucaaggccugggagcccugcucaguuacugcaaaacccuaauguuuaugcaucagcuacugccaggccugguggcuggaagacagagccucaggcuccaguccaccccucccguggagagagguaacaauuggaggcuuguuaggguagccagggcugggccugcaggccuggacacagccucucugagcccaugaaucuggucaggaggccucccagccuccgccaucauggggacgucgguuaccagacugcagacugagugagcggcuuuaucaccuuuaugcccaggagugaggugggggaaggggugagguugcaggccccaagccaacacugcacacuuuccucuuuguuccaggccuccccagcuuugccagucuuggggaagcagggagcuggauggcuguacccuugguacuugagcagagcucugggccgacaccccgugaccaggaggcacugggcaaagcugagcuccuugaagucacaagcugauuacgggggauuugaggcuggcccagcuccggggcaaauagggucgaaucccuggauggcucgguacuagacaaggaucaucuuggggcuguuuacaucauuuguacacccagacuggccuuacaaagggucuuuccacuuaaaauagccacuucucuaauuuagggcacggggccagucucaccacauccacuggggguagccaagucucuauuuacugagaaggaaaccaaggcuccaaggaaagccacuucuucaaggucagaguuuagugggaacaucuaguguuuuguuuccauucacaguagaguuucaguugucaaguuacgucuaauccaacuuucaggcuccuauggcauggcaaguccugugucuggggauuccugcucauuugggguggguggaggauggcacagacaggcauguggagaagaaagcaucuuuaaaaaaaaaacacagcuaggccaggcgcgguggcucacaccuguaaucccagcacuuugggaggccgaggugggcggaucaccugaggucuggaguucgagaccagcuugaccaacaugaagaaaccccaucucuacuaaaaaaaaauacaaaaaaauuagccgggcaugguggcacaugccuguaaucccagcuacucgggaggcugaggcaggagaaccacuagaaccugggaggcgaagguuguggugagcugagauugugucauggcacuccagccugggcaacaagagcgaaacuccgucucaaaaaucaaaacaaaacacagcuccauagaacgccucaaaucuuuugugauagccuuaucucggacaaaucucuucccuucucuggacucaauuuccccauuugucaaauggagggcugggccauggcuggaaggccccuccugcucuggguuccuuccacccucuaaugucauccuggaaaggcuggcagcaugucuuggggugggaggcucagugugugaucuuggcaaagucauuuuuuauuggaccaugaggucacuguaacuuguaucacagggcaguugugaggacccuuggaguuaauggacaugaaugucccuuucaaacuaucccaagggugacccaaauucagaaagguaggcaggaagccuaaggcaaaaaagcaaagcaaagaagcccaaagcagcgcagggcacucacaugagcugacccucccuggccuggcacucucacccaugugccaugccuacucacuucccaacaagccccuacuaggaagaauggguuagugggagcuuuaaugauuuaccugacuuaauacccaugggccagcauccugacuccccaaaagcucauacugccagaaugccagcuuuuggauaaaggccaaggcccagguacaagucacccacagcccagguaaggcaucaugggaguccaaggaagcaagaaauauuuauggagcaucuauggggacagagacguacauucuuuucugaauuccuagacacuguaaugaugaaaacugggcaacuaagcuaagcugggauucaaaaccacauaugcaaacaucuauguuuggccgggugcgguagcucacgccuguaaucccaacacuuugggaggcugaagugggcggaucaccugagcucaagaguucgagaccagccugggcaacauggcgaaacccugucucuaccaaaaauacaaaaauuuagcugggcacggugacgcaugucugugguuccagcuacucaagaggcugaggugacagaaucgcuugagccugggagguagagguugcaguaagccaagauacuugccugggugacagagugagaccucgucucaaaaaaagacaaaaaacaaaaaacuaugcugucugcaccacaaaggggcugagaaagccugcagauuucugauuuuuccuuuucuggaagguagagacuggccagaaaagugaugagugaugggcauaggcaaggcuaguuacaaguucuucacgaaggguggggugagacaucuggggcagggcucacccuugcgugcugcccaggagagaucgugggcgaaccccuggcuuguaggcaaggugauuccaucuguccccuacuuccuauucagcuaagcucauuacugugaguuacagaggagcacaauggaacacggggaaguuaguuaagucaguucccauuuccuaggagacaaagaggaacauagcagaaccaaggcuuuggagccagacacaccugguuuucagaucuugugugaaaggcaagcgauaugaccuccccaggccucuaacaucaugcacaaaaaggcugugcuugcaggucaaaucagcagucuccaaagggaagggcuuuauuccagaauguauauggaaugaucuacacaagauuuggaggggaaaaugacuauaacugcugucuuguaucuaucugucuuuugaaauuucuauuuuaugaaggcauaucaucuguuaguaucaaacugcaugugcaugaauuuaaaaauacagccgggcgugguggcucacgccuguaaucccaggccuguaaucccagcacuuugggaggccgaggcgggcagaucaucugaggucgggaguucgagaccagccugaccaacauggagaaaccccgucucuacuaaaacuacaaaaaaaaaaaaaaaaaaaaaaaaaacauuagcugggugugguggcacaugccuguaauuccagcuacucgggaggcugaggcagaagaaacgcuugaacccgggaggcagagguugcagggaguugagaucgcgccauugcacuccagccugggcaacaaaagcgaaacuccgucucaaaaaauaaauaaauaaaaauaaaaaaauaaaaauacagauacaccacugugaaagagguguuccaacauuaauuacugacgagguagacaguggaaaacuuggagaacacuccaugaagagcacccaccugcuacacuauuuagaaccagcuggcacaaggggccaccuuugaagauaggcaaacucucucccuucugcccaaaauucaagaaauguuguggugaagagagacaguggagacagaaaugaaauuaaaucugaugggccuggguucaaauccaguucaaccacuuacuagcugugugacuuuggcaaacuuauuucccuucucugagcuccaggcuagugaguaaccagcagggcuauaagguccgugacgcuuaaaguaguuuggcuaagaaccugcugauuuucuccuccacuuuucugucuccacguaguauucccuuauccacucaacaaauaaauacccaugucuggcauaguaugcugaauagauaguuccuucccuagaggaagugacaaaagugaucucuuucagauggaaaaacugaggcccagaaguuaaguggccugcaagagcccugagauauuuggacuuccuugccacuagcuagaagagcuucucacugaacuuuuguuuaguuauaucccacccuuacggcucaccuaagauccugggagccuuccccgggaacuuccccggggucucaccucaagcgagggcccaggaagggugaaccaagucgucuggauuuauggauucaacagguguggggcggaaggccuuuuccugccgagggugcggcccagcgccaccccgcucagucucagcgggacaccuccacagccaguaggaagggcaguucaaaauucagugcuacccccgcgucccagcuaagaaaacaagggccauccaggugcccucccagcugacgagauggaaaaaucaaaguauaauagauaaagagggaccguuucaaaagaaaaaggggacuugaaaauauuguagacuagggggaggaaaggagguggaaagaaacaaugcccuacacacaggaggggcuccacaaacaauuuguugaaaagaaaucgcucugcggacgcuacaaagaugcccugcaggacaagcccacuuacacagaaaaaaagaaauccuaucuagggaguuguugguccccagaguccccaucccucauuccccaaccccguggcgugcgcgcuucccgcuagacuucagccuggggcucuuuccuggcccccagaucccccgccccuccgguugcgcuccccgccuggccccgaggguaaaccugccuccgcggaacacaucuccgcgagacugggccaaagcuuuggggccugcacuccucgcaaaggagagccuccgagaccggagguucaucucaacccccgcguucgagcccgggccuggagaaaagugcccuccccucggccucggccucgucaccgcgggggacuggcgggaggaguaggggaggccggugggacaccucgcaccaggccgcccaccuacaggggcguccgggcuaggggagcagacggagagcgggggcggcuccugacuccuccgcgcgccggggccggggccgggccgggggcucggcccgcucagccaaugggcgccgcgcucgggcccccucccccgcaccgggaggggccgaggcugggcugcugcugccgaggucgugugcgacgugccgcucccgggcccuguguccccagccccagcagggccgcguggacggcgcggcgcccccggaaggaggccaugugcucagugccggcgccaacuacgcacgcggcgcccuccggcccgcuagauccgaagcccauccccacugcggccagcggcccggcggggcgcugcgcucgggacccgcaccgagccaggcucggagaggcgcgcggcccgccccgggcgcacagcgcagcggggcggcgggggaggcccuggccggcguaaggcgggcaggagucugcgccuuuguuccuggcgggagggcccgcgggcgcgcgacucaccuugcugcugggcuccauggcagcgcugcgcugguggcucuggcugcgccggguacgcggguggcgacgggcgugcgagcggcgcucucccgcucaggcucgugcuccgguccggggacucccacugcgacucugacuccgacccccgucguuuggucuccugcucccuggcgugcucacucggggacccgcgacuagcgaccggcacgcucgcuguugcuaccucuugccucuugccagagagcgcgcggaccguagcguuuauaggaccccggccauuggcuggcgacgccggugugucaggggugugugggcaggaccucggggcggggccuggggcccagccuguccugggcggcgcucugcggggagggggugaggggaguggccggggccggggcccccccuaaccacugccucgcucaggcugccgaucggcucguucucucugcguugggaccgcggagggcauucgcugugugacucagggcaagugugcgcaccucucugagccuccgcggccuucucuagcaaaauggugga

SEQ ID NO: 191407 - RNA, 36124 nt, Homo sapiens
agaaacuaggagggacuagggagagucugcaaggggaagagugugucugugacacugccagcagcgcgcagagggagggaugggggcggguaucggcguaggggcccucggaaagaacggauauugcugugacaccgcggggacgcucugaagggacgagugucgguguggcaccggugcacgcugaaggagccggcggaaccggguggccauggggaugugggcaucgcuggacgcuuugugggagaugccggccgagaagcguaucuucggggccgugcugcucuuuuccuggacaguguaucuuugggagaccuuccuagcacagcggcaggugagccuagacaggguccaaccugacccccauacccggccagcccuggaguagccuuggcuucgacccugagacucuugauugcuucgguccccgcgccagucucgucuuuguggucccugcugagucucguaacuuggcccgauggcggacuguggcuuugaggagggucuuggugcgucaaggaaguuuucuguaacguuaucaugggacccaaucccuuuagggccuggaggaaggcuugggcucuugugcccucccugcagcuuccuugggauccuugggcccagacuuggccuccuuuaucuuuggaauaagccuuuaaaaggauuuagacacccaacuuccucaugacauuuauguaaucaugccuaaccauaggauuuugcaguccuuccaagaacuugcacucuuguuucuccuuaaagugcauauauuguuucugcuugaaaaaacaaacaaacaaacaaaaaacuuaucgggcccggcguggugucucaugccuguaaucccagcacuuugggaggccgaggcgggcggaucaccuggggucaggaguucgagaccagccugaccaacguggcgaaaacccgucucuacuaaaaauagaaaaauuagccgggugugguggcgcgcaccuguagucccagcuacuugggaggcugaggcaggagaaucauuugaacccaguaggcggagguugcagugagcugagauugugccacugcacuccagccugggcgacaagagugaaacucaaucucaaaauaaauaaauaaaugaaauuaaaugaaauauauuucucguuuuucauaaaaucaacauuauuuuaguuuaaauauuaaaaugguaaaauaaaaagugaaaguuaacaauuuaccugagauaaccaugguuuagagaucugaacuuuuauuuauuuauuuuuaaucuuuauuuauuuauuuaauuuuagagucuagcucugucaccaggcuggaguacaguggcguuaucucggcucacugcaagaaacuaggagggacgagggagagucugcaaggggaagagugugucugugacacugccagcagcgcgcagagggagggauguucaaaugauucuccugccucagcaucccgaguagcuaggauuacaggcacgugccaccacgcccagcuaauuuuaguauuuuuaguagagacgggguuucaccaucuuggccaggauagaauauuuauuguauuuagagacaggggcucacucugccacccagacuggagcacaguagcaucaucauagcucaaggcagccucgaacucgugggcucaaacgaccccuccaccuccaccucagccuucugaguugcuaggaccacaggugcggaucacugugccuggcuaauuguuugauuuuuuuguagagauguugcccgggguggucuggaguuccuggacucaagucaucuugccgccuccaccucccaaagggcugggauuacaggcaugagccaccgugcucgaucuccccucagcuuuuauuggcacacaacaauauauagggaaagcauguuguaguggcccauuauuuuguuugguauccauucucuguauuacauuuccuggacugaaauuacccuuaccuuuuauaauuuaguauaaugagauaguugaucuuucuccuuuuuuuuuuuuuuuuuuuuuuuuaaggagauagauucucugucacccaggguguagugcuguggcacaauaugggcuuacugcaaccucugccucccaggcucaagugauccucccaccucagccccccaaauagcugggaccacaggugcauaccaccacacucugcuaauuuuuguauuuuuuguagagacgggauuucaccacauugcucaggccagucuugaacuccugggcucaaggaauccuucugccccugucuuccaaacugcugggauuacaggcgugacccaccgugcccggcugaaaauuggucuuuucucacagaccugauauguuuccaucuggugauccucaaguuucuggcauuuaggaccaaauuuaaugagcagccucaguaucuguucauacucacaguuagcaugugugcuucuccuuugcaugaauuuguuuuccguauuauaggagguauguaauacccagaaugaguaguacauguaacaaaguugugauguuaacagcuuugguuuacauauacaaacugaagugugaugacaacccugauuauaguuuuaccagucaggucaccucagguucucuuguucugcuuuuauuuuccugcaucagucguuucauguacuugaucaagugcaauauuuguguagguauaaagcaaauucaacagauauaaguggcaagcuauaaaccauucgauguuugaucauaaaugacuauuguaauaaacaacuauuucacuaaaguguuuucuuuaaaauauuucagagaaggauauauaaaacaacaacucauguaccaccggaguuaggacagaucauggauucugaaacauuugagaaaucucgacucuaucaacuggauaaaagcacuuucagcuucuggucaggacucuauucagagacugaaggcacugugaguaauuuacuucuuggagagacagucugucugguuguuuucauuuucauauuuuuguaacacaaaagaggguaccacacuuacaagucccagaaugcuuucuuaaccuuuguuauugauaguaacggcuguggagcaaaaaagacagaaacauaacugcuuagucaguugaaaacuauagaauaugggaacuauuacccugaagccagguaggaaaaagauccucuuccauuaggauccagcugagaugucaugucuucuaagcaaccauuugaaacucccugccugacgaauguggauaggguagcauucuaucauuauuccugucagaguacuuaucucauuauguugaauuugccuggauuuuuuuuuuuuucuucuggcacagucuugcucugucacccaggcugaaguacaguggcgugaucuuggcucacugcaaccucugcuuccuaggcgcaaaugauccucccaccucagccucccgaguaguugggacuacaguugcaugccaccauaccgucucagagugcugggauuauaggcaugagccacacuguaccuggccugauuugacuguuuaauuggcagacugguaguuccuuaaagaaauaguuaagucuuguucaucauuuuauaccuagugccuggcauguaaucagcauauaguuccuauuuauugaaugaaauaaugugggguuuuuuuguugcuuuuuuuguuuuguuuuguuuuuguuuuugagcagugucuugcucugucgcccaggcuggagugcagucgcacgaucuuggcucacugcaaucuccaccucccggguucaagcgauucuccuaccuuaggcuccugaguagcugggacuacaggcgcgugccaccacaccuggcuaauuuuuuguauuuuuaguagagacgggguuucaccauguuagccaggauggucucgaucucuugaccucgugaucugccugccuuggccucccaaaguacugggauuacagucaugagccacugugcccugccacuuuuauuuuuaucauccugaucaucaucaucaucauuucucuagaacuuuuagaucuacuaguaccacuaagagaaagauuccuaaauuuaaaagaauuaugaucagcuaccaucauuguuucaugaguuaaagaaacuggcuuuauguagcugugguaaaugacagaauugucuagcucaucacaaaauuuuucuuaacaaguauggaauaauaagacuagugugguuagauccaaauuauuagaaacugcacuuauuucuucaaggugauggaaaauggcaaugcuucuagaagaguuaaauuuugguauuuagaaaaauuaauaaaugauuuggaaaacaaagucucauuggcuuuggggauacacagcuauugcuauuaaguaaucuuuucaauaaagacuuggcuuuaguuaauuuaucugagcauugcuucuguuagggacaugucacaaguaggaaaucauccuucagagacagauggaaguagaagugguuaauuuagacacuauucuuuuuuuuuuuuuuuuaaauagaugaaagagaguuuacuuauguauuuauauaauggccuugguccaaaaaagacuaaagggagcucaaaaaagaauuauaguaacuuuaaaaaauacauuaaacauauccaagaucuuaaauguaucauucuccccaaaagcuaguugcuuccaaacuugacuuaauauuuugcauguuuucccuccauugcuugguaaguguauuugccucuucuuucugcaguugaugucugacggcugaguuuugcuguuuugucaacugacauuuccccuucuguuucaccaguuccagagaauuguugaacaacuuaacaacacuaccugaagaaguaauacucaagaguucuuguucuauacugauuaauagcucccauauuuucuucaucucugaaaagucugaauucucuguuuaauaaugacaaggcaauuagaugagguagacacuauucucuuucugauguuugcuucuuggaaguccuuugacuuuacccacuacagggccauaguaaaauaauaggaaaagcauuuucaaucuccuugguugucccugguaaauagugccaggaaagauagacaguagcuugguaauuaugguuggugaccauaggaauggcuguuuguucuaggggaugacagaaauagggagaauacauauauaaagugagagcuuuguaauguacuguggcucaaacuagaagcaguacugaugggcuaagguugggaacaguaauaguuaauagucgucaugauuuucacuucauacauaguuuuuauauguauuguuugauguuuacaacagugaaguggaaaggauaggcauuauuauucccuucuuaugaaugaggaagcaaaggcuuggauaaauuaaaggguuugcauguuuaauugccaagggacaugcuaauaaguaggauaacuggguuucaaacucuguucugcugagucuuuaaaaugacauugaaaaauccauucuugaaacucuaaagacugcaacaugaaugugcuaaauuuaucucuggggauuuucuggcugcauuuaugcuuggcaggaagaauauuuuggguaacuuugaaaccuuguuuuguuuggaaacaaguucauuaauuucuauuuuguguugauuagaauuaauagguuuguauguuuuggucacagagaucaagugagaagauuagcuucgacuuuuuuuuuuuuuuuuuuugccguaguacuuucuaccugagggaaccuaaauagagucauuguguggccauuuaugguugccacuguucacauaaauaugacacugcacccagacagaaaauuccagccucucugagacacuuucucuaauaucucacagauaucaauaaagggcccacugaagaaauggaauggcuggggagcagaguaggucagggucgaaaaguuuaaauuguugcuucucuaauuuuugcauguuucuaugugagcaguuucaccuucuugagccuaaguuuucucaucuuuaaaaugagaagugggcuggguacgguggcucacgccuguauucccagcacuuugagaggccgaggugggggcggauuaccugaggucagaaguuugagaccagccugaccaacauggcgaaacccugucucuacuaaaaauacaaaaauuagccuggcguguuggcacaugccuguagucgcagcuacucaggaggcugagacacaagaauugcuugaacccgggagguggaggcugcagugagcugagauugcaacacugcacuccagccugggugacagagugagacuccaucucaaaaauaaauaaaaauaaaauaagaaguguguggauguuaagccauaccuuguaugguuuguggcaaggacuaagugagugagauagcguaaaugaagcucaaugcguaggaauuacuuagucauuggguuucuuuggacaaguuacuucaaccucucaguuaaaguaaccuuucaguuaaagaguuucaguugccucaucuauuaaauagagaugauuauacccuuuucccugccuguuuuucaagacuguaguagugaagccaggcaugaugacucaauccuguaaucauagcacuucgagaggcucaggugggaggaucacuugagcccaggaguuugagaccagccugggaaacauagugauaccccaucuuugcaaaaaaauuuuuaaaaaaucaacugaguguggugaugugcaccugcaguucuagcuacuuggaggcugaggugggaggguugcuggagcccaggagauggaggcugcagugagcugugaucacacugcuguacccccgccuggugacagagugagauccugucucaaaaaaaaaaaaaaaaaaaaaaagaauguagugaaauaauauaugucaaagcgcuggaauuauuuuuucugggaucauuaauuuugccauagaacaacccugggagcaugcuuagugaaauugucaacauagagacauuguacaguucaccaugcuuuguuuuucaguccccaaaagaaacuaaacaugcuuuguuuuucaguccccaaaagguuugcaguaucaguuuucaaaugcauuuauagaucauucagaauucauauuaaaacuacccuugaugcuuauuuaaauacuggacuuuuaauaauaguugcuguggccuuuacuaaaagcauuauaaguccuuaauuauacauuauuuauuaguauugggaauuggcugaaagaaauaccaucccaggucaauuagaucaacaacuacagcauaugucagacagugguaccaaagcaugucuuuugggaaaacaagguuuaugucuaagauugaauuaguuguaguaaaguggaaauaccuggagguaguguuaggggagccuuuugaaaagcaauuuauuggggcugagugcaguagcucaugccuguaaucccagcacuuugggaggccacagugagaggacugcuugaggccagccugggcaacauagugagaccccaucuguacaaaaaauuaaaauuagccaaguaugguggugcauacaguccuggcuacuuggggggcugacauggaaagauccuuugaacccaggaguucaaaaauucaguaagcuaugaucauaacacugcucccuagccugagugacagagugagacucugucucuuaaaaaaagaaaacaauuuauuaaagcaaugauuuucaaacuuuaguguacaucagguuuaccuagaaacugcugggccccacuuccagcuucugauuugguacaucugggguagggccugagacuuugcauuucuaagaaauucccagaugcuguugcugcuguccagagaccauauuugagacccaugauauuaaaccaauccaauguacugguaacagucuaaaagauggauaguuuaaagugugggugagauugugggaaaacagaaacacuggaguacugcugaugggaguguaauuuguuauaaacacuuuaggaaauauccugauaauaccaaauaaaguugaaguccaccauggauggaucuaagaaaauuuagaauauaaaaagcaaaucauagacugauaaguauaauaugaugucauuuauauacauucuuuaaaagcauacauaaaucacuauauuauuuguagauacauguaugaaaaugggaauuagauuggaaggguacccaugaaauaugauaguaccaaaaccccucaaaccaugaggaacuaugucugaaccagugggaauauugugcuucuagucaaggaaugugauugaucauuguguuccuaagcugcuguccuacagagagaaaaaauaaauugauuccucuugacaaaugaguuccacaaaguuguauguguuuugggcgguagaauucuuaaacaugcauucuucucaaauuuugagcugcuuccuagcuccuaauguccugguuauuuagugaaugucuguguucacuuuaucugcccaagaccaagacaaaggguggugcugaggaagagccuucuccugugaaagccgggccccuaccucaccucuuccugacccagcaaagacacagauaaucccauucuguuccccaguuuaguaaguggacaugacucuccacuucugugcuuuguucugauggaaaaggacuauuuucuuucacagaaaagacaauuauggagccauauuaaugugguucaaauuccauuucuaucacucauuagcuguuggauuucgaacaaguuuuuuuuuuuuuuuuuuuuuuuuuugagacagggucucauucugucacccaggcuggagugcaggcacgaucauggcccacugcagccucgacaucccaggcucaagcaauccuucuaccucagcucccccgaguagcugggaccacagaaucaugccaccauaauuggcucauuuuuguauuucuuguagggacagguuucaccauguuguccaggcuggucucgaauuccugagcacaagcaaucugccugccuuggccucccaaagugcugggauuacaggcauaugcuaccauacccagcuguuuaaccuuucuaaguuuaguuugugauuuuguuguggucuuuugacaaaagguuuuuuuuuguuuuguuuuagaacagcuuuauugagauaauucauguaccauacaauucauauaccauacaauucauccauauauaguguacagacaaaaauguuauauuaaccaccuaaauuuaguaucucaaugguuaguacucaucuaaaugcauaauuuaugcuaaaugugaaauaggucuauuuuuuaaaaaaauauuuuauuuuguuauuuuauuuuauuuuauuuuauuuuauuuuauuuuauuuuauuuuauuugagacagggucucaguuuauugccuugcuggagugcagugucacaaucacggcucacuggagccuugacuucccaggcucaggcaauccugucaccucagucccccaaguagcugggucuacagguacgcacuaucaggcccagcuaauuuuuaaauuuuuuguagagauggggucucaacucaccuuguugcccaggcuggucuugaauuccuggccucaagcgaugcuucugucucagucucccaaagugcugggauuacaggcaugagccaccguacuggccucuuuuguuuuuuuaauagagaugauuauuuuguccuuucuuucuuuauaccaugcuuucucauaugauaguuucuaguacuguucaacugugaucaaaguaugcuuuguuuuauagcuuauucuucucuuuggaggaauaccuuaucucuggagacuuucuggacgguucugugguuaugcuggcuuuggaccagaauaugagguaugugauucauuagcauguauuugucaugguauuucuuuuagcuuggcaggcuuuccacuaaaguuaauuuuuuggcuucugccaauguuaagauuugccucucuguuugcauaguccuugguuacccaugcuguauuggcauaacauuaguuacaauaacaaaucccagaauaucacaggcuuauuugcaaugguuuauuucucaaucacguaauaguccagugugaguauuuuuaguuaucaggugacuuucuuccaugugguaagccaagaauccaggcucuuuaucuuagggauuugucuguaugauuuaagguaccuuucauauagugccuguguaauaaaaaaggaauuguuuuguuucucauuuacuucucucaaaaguaaacuuuuuugaaggcagggaugauauuucagaccuuauguuauccauagaaucaagcauauugcuugggauguaguaaguaagugcucagcaaauacuuguugauuuguuugccaguaguucauaaaaacuggauuuuuguuuuuucuuuuguuuagaucacucagucccugguguuucugcuguuggcuacacuuuucagugcauugacugguuugccauggagucuuuauaauacuuuugugauagaagaaaaacauggcuucaaucaacagguauaauaaagaauacaaauguucucuuuuaaaugugaaaaacuucugugcuuuuguccuguacuguuuauaauuuaaacauaauuuacuauuucagaguaugaauugagaaaaaagggaacuacagauaugguaaagaucauagcugaaagucuugggggccgcgguggcucuggccaguugcccuggcacucggggaggcaaggcuacauguucgaggccaaccuggucaacacugauuuuaaaaaaaaaauacuuaaggccaggcccaguggcucaugccuguaaucccagcacuuugggaggcugaggcggguggaucccaaggucaggagaucgaggccauccuggcuaacaccgugaaacccgucucuacugaaaauacaaaaaauuagccgggcuugguggugggcgccuguagucccagcuacucgagaggcugaggcaggagaauggcgugaacccgggaggcagagcuugcagugagcugagaucucgccacugcacuccagccugggugacagcaagacuccgucucaaaaaaaaaaaaaaaaaaaaaaaagaaagaaaaaaagucuugacuggguacaguggcucacgccuguaaucccaacacuuugggaggcuaaggcgggaggaucacuugaguucaggaguucaagaccagcuuggauaguauagugagacuucaucucuacaaaaaaauucuaaaagccaguugugguggcaugcaccugaagucccagcuacuugggaggcuaaagcaggaggauugcuugagcccaggagguugaggcuacggugagccaucauugugccacuguacuccaaccugggcaacagagccagaccugucucuuaaaaaaaaaaaagaaauuuauguuauaaacuccuuuagcacuaauaucuauuguuuuucagcuacuaaucauuuguuuguuugcgacagggucucguucugucaccuaggcuggagugcaguggcaggaucauggcucacuguagccacgaccuuccagauucaagcaauccucccaccucagccugccuaguaucugggacuauagaugaauuauacuacacuggguuaauuuuuuuauuauuauuuuuaguagugacagggucucacuauguugcccaggcuggccuggaacuacugggcucaagcaauccucccaucuaggccuuccaaagugcuggaauuacaguugugagccacugcacucguccucaguuaauaagguuuaaaugaauuuucagcuguaaaaugcaagacauuuacccauugucuuaagcugccuaaugucauauaauauaguuucacugcauguuaauuuuaaaaauugcuuuaauaauguauccuuuguauuuauuuaucaguuauuuuaaaaagcagaaccaguuucucaguuucuugugguaauguuuucuuuuugcagacuuugggguucuucaugaaagaugcaaucaagaaauuuguugugacucaguguauuuuguugccugugucuucacuucuacuuuacauuauuaaaauugggggugacuauuuuuuuauuuaugccuggcuguucacauuaguugugucucuggugaguaaaaucuuuauuucguuuucuuuugcaaaaguuccuuggugagauuacuguaaucuucauuggcauguaaacaguucuuaagaagcagcugaaauauaaauaggugcuuauauacauuucccccuugguuucugcuuuugauuguagacacaggaguauugacugaccauaaauuuccuucuccuuaugcuaacucuucaggucauagaaacuaguuguuagucacuuuuaaugauucaguugucaggcaguuuuggguugugcauuugcgaguugccaccagaaugacuaagugugauaauuuaaugacuccugacugaccuccacugccuaaaaucaugguuauuuugaagagaaaugagauuuaagagggacaagagaaagaaagcauauacuuaacuggcuuucuucugcuucccuucccuugccuuucccuuccacguuagacacucucucccuucuuugccccaucugcuuccccuuccccuucuaucuuuuacccauucuucuuccuuuccuucuccugucuucccuuuucuccccaacugccaccuauuccugccucucuucuccuuuccuuuucccucucacucuuuucccccugauuuuucccucccucacaucuccuauuccucuucucuuuccauacucucaagugcuucacaacacaaacacuacaacgcagucaaaauggucuguucagggccaggcacaguggcuuaugccuguaauccuggcacuuugggaagccaaggugggaggauugcuuaagcccaagaguuuaagaccagccuggguaacacagugagacucugucucuacaaauaauaauuuuuaaaaaacccaaaugaaaaaacccaaaguggucuguucagugcacccagaaauuaucaucuaucagcucuucagcuccacugaugagguuuauuuuauuuuagagauagggccucccuguguugcccaggcuggaguacaguggcuauuucacaggcaugaucauagugcacuacagcuuugagcuccugggcucaagcaguccuccugccuuggccuccugaguagcugggacuacaggugugugacaccaugcccaagcugagguuuauuuuagucugaauuacauaaugcucauuguuucauuuuccauugaugggaucaagaucagaaaaugggcgcuaguuggauuuacagguaucuauuguauggcaaauuaaaguaagaugaaaaagagcagagaaaaugcucuaaaaaugcuuaaggaagugcuauuucaaccacauuguacaauuaugaacuacagguaauuaauuuuagcugauaagccaaccaaguaacagcacacaaucaaguucuacuaauucuuuuuugggaaagacuucaggucuauugugauuacgcuaaaagguagaacugcguguuaugauugacucaugaagcaucagaaauccccaagauaguuuugaaaggacuauacuuauuaccaccuagagauuuuaaucacuguuaguagcauuauccuuuaaaauaaaauucauaaguuuacucuguuaucagacuacucauuucaauuuaauucaucagacagauauuaugcucuuacuaucugguacuauuugggccugggaauaccagagcaaguaaguuccuuguucucaaguuugaggucaacauaguuguuuuaauauaauuuaaucuguauaauaaagaauguuuuuucuuuaagaacauguucauauguuauucugacauuuacuuuucagguucuugucacaaucuaugcugauuauauugccccuuuauuugacaaauucacaccucugccugagggaaagcuuaaagaagaaauugaaguaauggcaaagaguauugacuuuccuuugacgaagguguauguuguggaagguaaggcuaccuggggauaagaaaguuuuauccaagugguuuguuuuauuugauacuuuauucuuaaaauuuuaauaaaagaauuaaucaguuuuuguuuuuuucuuuuuaaaauuuguuauuuaaaggcuaggaguuuaccuuuuggcuuuuuaagauuuacagaaauugauaacauaggccagggauagaaacugguggcuugauaccaaauccugcucuugucugcagcuauguuuguuugguuuuacaguauuguuuuaaauuuuuggccaaggcuuuuucacucucuguuauguuaucuuauauauuagacugauuuauucacuucuguuaucugccuaguucuuuuagguaguuaaguuggacucuugaauagucaaauucuguuuaguauuaguuuggaggcucuuaaacaaagccaguguuauuggccuugucuccuccaagaaaauauccaguguucuggaggacucaccugaagauugauuaccaaagacugcaguaccacugaguacugcagauuuguuauacucugcuuuuuugaugauuacuuuugagauuuaaguggucucuugaccguuacucaaaucuugacuucccauuaacacccagucuauuacuuucuuugagacuuugguaguugacuauuaaagucucaaagaagacuacggagauguagagagaaacuguuguaagguucuaugacuuucagaauuuauaaaguccauauaaaugaauguaauaguucuguuccugccacuuaccaguuauaggaucuuggacaagugacuucacccuucuggguuucaguuguauuuccucuaagcuaugguuucacaaauguuuuuuguaaagggcuagauaguaaauauuuuagcuuugcgggccacuuguucucuguugcaacuauucagugcuacuauuauagcgcaaaagcagccauagacaauacuaaacaaaugaguguggcuguguuccaauaaaacuuuaugaaaauaaauggcagauuggauuuggccugugagcuacaguuugcugaucccugcucuaaaauaaaauauuaccagugagaagcagcaguguuagaugaaggaauagaagcagaaacaaucacaggguuagaggagaacagagauggucacaacugaaaagaaugaaucaacagcaacuggaagaacauagaaauuucagacaucuggcugggcgcuguggcucacgccuguaaucccagcacuuugggaggccaaggcaggcggaucaccugaggucaggcguucgagaccagccuggccaacauggugaaacccugucuuuacuaaaauacaaaaaauuagcugggcgugguggugcgugccuguaaucccagcuacuugggaggcugaggcaggagaaucgcuugaaccuggagguggagguuguggugagccaagaucaagccauugcacucuagccugggcaacaagagccaaauucugucuaaaaaaaaaaaaaaaaaaaaaauauauauauauauauauauauauauauauaugucagacauuuaguggcuccugaggauauacagcccaacuaaaggcacgauuggaguagcuuaaaagucuguggagaaaugguagaauaagccaguucauacuuacuucuuuagccucugaaauaacuacucuuuuuuuuuuagguaauauuaaacuagaaauuuaaucauuaaucaguacaacagaauagucucuaagcugcuuuuacugaaggagcaaccuaaguugcugaucccuuaaguuacaaucagauaacgugaaauaauaguuaaugcuaugacaguggagguagucaauagaauaugugaaauauaucggugcuauuuucuuuuuaucuuuuuuuuucccccuacaacauccagaguaugagagcuauuuucauuuuagauaaaauagucagggaaggcuuuauggaagguuaugaccugagcuggguguuaaugggaagucaagauuugaguagguugggggcagcauuucagacgucaggcuucagggucaaaaggcuuggguuugaaucauagcucuaccacagauuaccagugcugggcuugguggcuccagccuguaaucccaucuacuggggaggcugagguggaaggucaggaguucgagacaaacuacuugugugacuuugcgcaacuuagcuuugccaaacagcaguuuacucaccuauaauguauguuuuaauuguuguuaacaacaguaacaauucucaaaaauauuuugaaugaaugaauguuguugcugacaauaacaacacacauuacauauuuguaaauugguagggagauuguagugaaaagccaagaaucuugcucucaaaauauuaucagauagcaagugcuaugcagcaaauuaaacuaguuuggucugauaaguugauacuguagauuggucaucagauugagcugagaccuaaagggaggagccgcccauuugacgucaaugggaagauguucaaggaccaugaagaaguccaguguggcugcaccauagcaggagaguguuaggagaugaaaucugagacauaggcaagaaucaguccacauaggccuuuguaagucaggguaaggaguuuggauuuugaguucagugggaagagccauugaaggcuuagacaggaaagugacaugaucugcuuuguguuuuuaaaauauccugggcuacuguauggagaauauguuguagagacaggcaaaagucuagguaggacauaaugguagcuuagacuaggauaauaguaauuaauggagagaaguggauacauuugggacaaguuuuaggguagaguugauugaauuuucuaauugauugcauugggagaauaagggaaagagugacaucaaagauaauggccuagacuuuugaccugagcaguuagauauaugguaguuuccugagauggaaaaaaauaggagaagaguagguuuguggggaauuaagacuucuaauggcuauauuacauauugaggaaccuacuaaacauuguauuagaauucugcaagcaauagaaaccaacuguggcugauuuaagcagaaaaacugcuuauugaagcacuauuuggaccaggcgcaguggcuuaugcuuguaaucucagcacuuggggaggccgaggugggcggaucacuugaggucagaaauucgagacaagccuggccaacauggugaaacccugucucuacuaaaaauacaaaaaaaaaaaaaaaaaaaaaagccgggcgugguggcgggcgccuguagucccagcuacuugggagacuaaggcaggagaauugcuugaacccaggaggcggagguugcagugagucaagaucgugccacugcacuccagccugggugacaaagcaagacucugucucaaaaaacaaacaaacaaacaaacaaaaccaguauuuggccaggcgugguggcucacgccuguaaucccagcacuuugagaggcugaggcagguggauuaccugaggucaagaguucgagaccagccuggccaacauggugaaaccccaucucuacuaaaaauacaaaaauuagcugggcaugguggugcacaccuguaguuccagcuacuggggaggcugaggcaggaggaucgcuugaaucuaggagguagagguugcagugagucgagaucgcgccacuacacuccagccugggcaacaagagugagacccugucucaaaaaaaaaaaaaaaaaaaaaacaacguuugauaucucacaaaauccacaggaaaauuaaguuuacgaagcucagaaaaugggcuguuacauaggaaggcuaggaacuuauaaucauauugcagaaccugucuggugaggacacugcuguggcuacuucagaacaccggauucagccacuagcaccugcagaauuaauuccucacugcuuugcuuuuuuauguaauuagcuaacuauucagaaucccuaaggggcacaucugauugacuaagccagggcauggggcuagcugcucggagugcuggggaaacaaauaucuggccuuuuagauuucucaaaugagaagcagccucuuacauagugugacacuuccuaaacucugaaaggagauucuaauauuggacaagaaaaaagacuacacacaagaauacaaacaacaaauaagucuauagacaucccuguggagaugucagacagguaacuguauguaugagucuggaguuuuagggcgaggucagcgcuaaaaauacagauuuggaaguaucuggcacauagaugguguucagugcuauccaugaaggcacuuaagagaaggggaccagggucagagucagcagagaaacagccaggaaggaggcuaaggaggagaggcccuugagguaggaagaaaaccaggagaaacuggugucucaaaaaccaggagaagaucguguuuuaaggagaaaguggucaacuauguuaaaugcugcuaagagauuaagaggaagcauucuaaacaaaaaauggcaaugccuuacauuuuuguagaauguuuuuguuuuuggaguucucaaauauguuacuucauaccucaagcgauaucauuaauccauucaguaaauaaacaucauugaauauacagucaugcauugcuuaauaauggcaauauguucugagaaaugcgccauuaggcuuuucguugucaugcaaacaccauuauacucauacaaaccuagaugguguuaccuacugcacaccuagguuguaugguauagccucuugcuucuagacuacaaaccuaucuagcguguuacuauacugaauacuguaggcaauuguagcaugaugauuagcauuuguguaucuaaacauagaaaagauagugugcucugcuacaacauuacgguggcuaugaggucacuaggugauaggaauuuuucagcuuuauuauaauuuugugggaccacuguccuauauguagucuguugaccgaaaugucauuaugcgguacaugacuguaugcgacaugccaggcacagcgauauaaaaagcuuacaguacaguacagggauucuuuuuuuuuuuuuuuuuugagacggaaucuugcugugucacccaggcuggagugcaguggugcaaucuuggcucacuucaagcuccgccucccggguucacaccauucuccugccucagccuccugaguagcugggacuacaggcgcccgccagcacacccggcuaauuuuuuuguauuuuuaguagagacaagguuucaccguguuagccaggauggucucgaucuccugaccucaugauccaccugccucggccucccaaagugcugggauuacaggcaugagccaccgcacccugccagggauucuuaaacuuuaguaaguauaaaagucccucgagaguuuguuaaaagacagauuccugggcuucauucccagagauucugacuuaguagguguuuccaguaucuacuucuaacaaguaccccuaggugauuuuggcguauuccuuggaccacacuuugagauaccuggaccggugggagauaguaagacauuaauuuacuuuuauuugugugcauacaaucugcuuacuuucauaaauaacuucagauaguguuuaauaaauauuuuuaaauuaauuaaaaaauuuaggauuagcagccaggcgugguagcucacaccuguaauccuagcacuuugggaggcccagguaggcagaucaccugaggucaggaguucgagaccagccuggccaacaugaugaaaccccgucucuacuaaaaauacaaaaauuagcugggugugguggcgugugcauguaaucccagcuacccaggagguugaggcaggagaaucgcuggaacccgggaggcggaggcugcagugagcagagaucgcacuacugccagccuaggcaacagagcaagacuccaucucaaaaaaaaaaaaaaaaaaaaaaaauuuaggaucaggaaagauagagauagaaggauacccuguguucaaaggguaacacagacaaaauaagcaaacauguuuggcucuuccuggcaaccaaaccaaaaagaaauguaauaaugcaauaaauaaauaauagcuucuauuugucaaaguuuuacuacuaaacauacugccuaguacuuuucauuagaaauaugaguagauagaaaauucauguuuuuugugagagacuucaaauucccaagagaaauaaauguuuaucauuucuuuuuugaaaaaaguauaugaauaacaguaguaguauaaagaucagacagcauauuauugcuucacuuagaauaucucguguaacgaggucaggagaucgagaccauccuggcuaacacggugaaaccccgucucuacuaaaaauacaaaaaauuagccgggcgugguagcgggcgccuguagucccagcuacucgggaggcugaggcaggagaauggcgugaacccgggaggcggagcuugcagugagccgagaucgcgccacugcacuccagccugggcgacagagugagacuccgucucaaaaaaaaaaaaaaaaaaaaaaaaaaaaagaauaucucguguaauccaucaucuaacccaaugagguagauauuaggcucgcuucauaaauaggaaacuaaagcuuaaagaaauuaagaaaguuuucuaaauugacagaacuaauacauggcagagccaagauuugaacccaaagucugugcucuuaaucacuauacucaacucacugcacauuguaggacauuuagaaaucaaagaagugcauaaagaagaaaauaaaaaucaaccauaguucagguacuguuagcugcuauuaaaaauuuagguaugggccagcuguggugauucacaccuguaaucccagcacuuugggaugccaaggcaggagaauugcuugagcccaggaguuagagaccagccugggcaacauagcaagacccugucucuacaaaaaauuagccgggcauggugguaugugucuguaguccuagcuacucaggaggaugagucaggaggauugauugagcucaggaggucaaggcugcagugagccaugauuaugccauugcauugcagccuagacgacagagagacccugucucaaaagaaaaaaagguaugucuucuuccagucuuuauaaaaauugcuuuaauuauagaaguagguaugcugauuuuaaaagucuuugggaaaagaaaggaaacaaaaaucuauaauuuuagaauuuagugauaaacauuucaguauuuugguauguuuccuaauaggcaugggcuuaugcuuuucuguuaauauuuguuagguuggugcaaaaguaauugcaguuucagaccaugaauuuugaauccuuauaacuaggcucaaacacaucuuuauuaaucaaaagaagaaccauuacaaucaacacauuuuugccaacaagaaauacguuugcuuauuucuguaggguaaaacucugugcuucgggauuuggcaaacucuuggaaagcauuuucugcauccagcuaguugugaaaacguuuucucuuuaaaaaguuguugagaugcuugaauaagugguagucaguuggcaagaggucaggugaauguggcagaucaggcaaaacuucauagcccaauuuguucaacuuuugaaggauugauuuugcgauguucgguuggguguugucuuggagaagaauugggcccuuucuguugcccagugcugguugcaggcguugcaauuuucugugcaucucaucgauuugcugugcauacuucucagauguaaugguuuugccaggauucagaaagcuauaguggaucagacuggcagcagaccaccaaacagugaccaugaccuuuuuuuggugcaaguuuggcuuugggaagugcuuuggagcuucuucuguguccacccacugagcuggucaucgcccguuguucuauaaaauccauguuucgucucacgucacagucugauagagaaaugguuuguuguguaaaauaagagaagacgacacuucaaaacaaugauuuuuuuuaauuuuuauuuucgcuuagcucaugaagcacccacuuaucaggcuuuuucaccuuuccaguuugcuucaaaugccaaacgaccguagaauggucgacauugaguucuucggcaacuucuuguguaguuguaaggggaucagcuccgaugauugcucuccauuggucauugucaacuuccgauggccugccacuacgcuccucaucuucaaggcucucaucuccuuugcaaacuucuugaaccaccacugcgcuguacguucguuagcaguuccugggccaaaugcguuguugauguugcgaguugucucugcugcuuuacgacccauuuugaacucaaagaagaaaauugcuugaauuugcuuuuuuuuuuuucuuucuuugugagacagagucuccgucuguugccuaggcuggagugcaguggcgacaucucugcucacugcaaccuccgucuccuggguucaagcaguucucaugccucagccccacguguagcugggaugacaggugugcgccaccaugcccggcuaauuuuuuguauuuuugguagagacaggguuucaccauguuggccaggcuggucacgaacuccugacuucaagugauccgccugccucagccucccaaagugcugggauuacaggcaugagccacugcacccaguugaauuugcuuuuugucuaauauaauuucccuuaucuaaaauaaauauaaaauaaacagcaaguaaugucauuagcaaaaaacauaaagugagaaaugugcauuaaaaugauguauaacauaaccauauuuauuuaagaauguauuccaauaucaaacagcaaauuucaacaaugcaaaaaccgcaauuacuuuugcaccaaccuaauacaugcacauuuuuucuugacgauaauggaaccugauauacgugaaguuuuguauccuucacaauauauuggugagcuuuuucuuguuaaaauucuuuggaaguauaauuuuuuucuggcagcuuaaaauuccauuucauaguuuuacuauaauugaaucauuuguaacuguuggauguuuaggcuuuacuuauuuacuuacugcuauaaagcugugaugagcacauuuauuggcaaaaaacagacacucuccacugcugguggugaauuauguugauaugauuuuucuucacauauuaaaugauuugaaaauguuaauguccuuuccaguaauucaauuucuaggagucucuccaaaggaccccaaacuuuuuaauuauauuccaugcuuugaacugucuuuuccuuaggaucuaaacgcucuucccacagcaaugcuuauuuuuauggcuucuucaagaacaagcgaauaguuuuguuugacacucuacuagaagaguacucuguacuaaacaaagacauccaggaggauucuggcauggaaccccgcaaugaggaagaagggaacagugaagaaauaaaagcuaaaguuaaagugaguuauuuuuuccuaagagauucuaccuuaguuuuuauacacaguuccugugacaacucaaaauaacaucaauuucuaggcagugaguguugaauucagggagacuaucagaugaaaaccauggcuccuuuauaguucugguauuuaggagagaucaccacuauuauuacaugcuaacuaccuugcaagcuuuuauagaauguggauauuaaaauuggaagcucuuauaagaaaauucauaugauuauaagcuaucuuuaaaacaggaacuuguguguauauauauauauguguguguauauauauauauaauuucuuauguguuuaugaucaaagaauucccacaagcaagauaaagagaagauaaacaucuaauuuuuagcuuuauuaagacaguaauuguaggcuuuggcaauggagagacuuggauuugaauccugguucugucauuuaguagcuuuguauccuuggauacguuguguaauuuagucuguuuuauuuguuuaacacccauuuaugaaauguauacucugugcugagagacuuuacuuggcacuagguacacaaaaauaaaaaggaauaccuuccucuuaagcuuacagucuaaaggggaaauagucaugcaaucacaguacaauacgugaauugcuacugucaagcuuuagauucuagauauaguaacuggagcacaagaaaagacauuucucaaaucugacaugagagucugagaaagcugcuucugaauccuuuucguggauaagauugacugauauugauuagcagaauuuaaaguaucaagacuaaaugggggagaggggacaaugauaagaaacaauacaaacugucagaaaugaucaucaguauuuguaugugugauggaaugugccauugccuuuggugucauacagagaugauuuuagaugccuguucacucacugucuguguaacucugugcaaguaaguuaagcuuucauuuauuuauguauuuauuuauuuugagaugaggucuuguuauguuuuccaggcuggucgaacugcuggccucaaguuacccgccugccuuggccucccaaagugcugggauuauaggcgugugccaccgcaccccgccaagcuuucuaaaucuuugauuucuuaacugaaagaugaggccaguaggguuucucaagccccacgcuauuuuuuugagccagauaauuuuuuuguugugggagguaucuugugcaucacaggauguuuagcagcaucccuggucucuccccacuaggggccauuuccccuacaaccucuacaaauuguaacaacaaaaaugucucagaauauugccagauguccccuaaagguagcgguggggccgagucuccccugguugagaaauacuaggcuaaagauaccuacauuuuaggguuuugaagauuaaaugaaauaauaugugugaaauaccuuguacucucuacccaaauguagagaguaccagaaaaugauuagcaucugagcaucuguuuugacacuaaaaacagguucuaguaaaguaccuagccuguuauaaauacguagaugaaauaaaauucugugaagggauuagaagacaucuuaaagucaucuuauaaauaggaaaacugaaguccagaaagaauaacccagugauaacacuagagaaucaugcaaguuuagaaaguuaaucugcuuauggucaggcacuguggcccauaccuguaaucccagcacuuuggaaggccaagacaggcagauaacuugaggccaggaguucgagaccagccuggccaacaugacgaaaccccugucucuacaaaaaaauacaaaaauuaguugggcaugauagcgcacgccuguaaucccaguacucaggaggcugaggcacaagaguugcuugaaccugggagguggagguuacagugaacugagauccugccucugcacuccagccugggugacaaagugagacccugucuuaaaaaaaaaaaaaaauugcugauccuuuuguuacuuuuuuuguuuuuguuuuuguuugcuuuucuggaaguuuguuagaucuuucucuguuucaguguucuaaaauuucacauaccuugauggggaucuguuuucaucuaccauguuauaugcaucacacuguuuucauccacuguaauauaugcauuaggcccuuuuauucuggaaaucgagguccuaugguuguaagaaauuuucugaaauuauuuuguugauuuuucuccucuccauuuuuuaaauucuguguuuucagggcuccucuuacucgagugcuggauuuguuauacugaacucuccuaucuuuuuaacccucuuuuccauuuuaaauauaucucuuucugcuuucuagaauucccucaucaucuuccaauccuuuauuguauugaacuuucuuucuuuuuuuuuuuuuuuuugagauguagucuugcccucucgcccaggcuggagugcaguggcgcgaucucagcucauugcaaccuccucccggguucaagcaauucuccugccucagccuccugaguagcugggauuacaggugugcaccagcaugcccagcuaauuuuuuuuuuuuuuuuuuuuuugguaucuuuaguagagacgggguuucaccauguuggccaggcuggucucaaacuccugaccucgugauccaccugccucagccucccagagugcuggcauuacaggcuugagucaccaugccuggccuucagcuuggauuucuaauaauuuuuuuaucugaauuuuccaauuuacagcauuucguuacuuuuucuuaggugcaaugucuuaauuuucuaaacuuucucuuuauauaauuuauuucauguugcuuuuuuuguggaucagaucuucuguguuaacagcuuaccucauauaucugguaaauccuugguuauuugcuccuuaguaagagaaugggacuaggccccacacagcggcucaugccuguaaucccagcacuuugggaggccaaggcagguggaucaccugcagucaggaguucgagaccagccugacucacauggugaaacccugucucuacuaaaaauacaaaaauuagccgggugugguggcaugcgccuguaaucccagcuacucaggaggcugaagcacaagaaucacuugaacccaggagguggagguugccgugagccgagaucgugccguugcacuccagcuugggcaacaagagugaaacuccaucuaaaauaaauaauaauaacuacuguuaacauuuguauauacuuucagucuacuuuuuauauuuguauauuuuuauauacacauucacauuguuucauaauuagaaucauacuauauauuuuuaguuugugucuuacuuucuucaccuaaucauuuuccaaugucaaaacaucaucccuuuuuuuuuuuuuuuugagauggagucucacuuuuucaccuagguuggaguacaguggcgugaucuuggcucacuacagacuacgccucccaguuucaagcaguucucaugccucagccuccugaguagcugggauuacaggcaugcaccaccaugccuggcuaauuuauuauuauuauuauuauuauuauuauuuugagauggagucuugcucugucuccuaggcuggagugcaauggcgugaucucagcucacuggugaucucagcucacugcagccucugauucuccugccucagccuccagagcagcugcaauuacaggcgcauaccacgauacccugcuaauuuuuuguauuuugguagagacaggguuucaccauguuggucagucuggucucggucuccugaccucgugauccacccaccuugaccucucaaagugcugggauugcaggcaugagccaccaugcccagcaauauuuuguauuuuuaguagagaugggauuuugcuauguuggccaggcuagucuggaacuccuggcuucaaguuaucugucugccucgguuucccaaaguguugagauuacaggcgugagccacugcaauuggcccuaaucuuugaaaacaaaauuucuaaugauuuuguaauauaaugugacugucauauaacuuuaucaugauuuauuuaacuauugucccauuauaaagauuucuauuucuuccaguuuuuuuuuuccuaaucuaaguuagucuagacugugagcuuuauguagucugggaauguccaucuuguucgucauucuaucuaucuucagugcuuaacccacugucucauguggagcagugguucagggaauguuuuguuaagacaaucaacaguuuugaacaaaacugauuauuucuuuaaguuaaaaucuaugaagggcuauuacuggguuaaaagauaaaacuuuuuaaagguucucaauaauuuauuuuugauuuuuuuuuauucagaauaagaaacaaggauguaaaaaugaggagguacucgcuguacuaggccaugaacuggggcacuggaaguugggacauacagucaaaaauaucauuauuagccagguaaguguggagugacaauucuuuuuuuauggcaugauagucaaauuagaacuauggcaggcaugagaggucauauaagagaggccaaggcagacaccacagccaggcuaccugguuuccuaucacagcucccugacuuacuaccugugugaccucaggcaaguuccuuaaccucugccucuguccccucauugaaugauaauaccucauaggacugguuaagaauuaagugaguuaauacauguaaagaguuuagacuagcaccuggaacauggugaguacuauauaaauuauuguuaucaccaccaucaucaccuccagaguaagaacuuggaaaaucaaaaggaacaagccuagauaaguuggacauuaaaaugcuuuuuaaaauuaaauuaaaaaaauuuuuuuugagacagagucucgcucugucacccagacuggagugcagugaugugaucucggcucacugcaaccucugccucucagguucaagcgauucuccuaucucagccuccugaguagcuuggacuacaggcacccaccaccaucccuggcuaauuuuuguauuuuuaguagacacaggguaucaccauguuggccaggcuggucucgaacuccugaccucagguaaugcacccaccucggccucccaaagugcugggauuauaggcgugaaccacugugcccacccuaaaaugcuuuuuuuuuuuuuuuugagauggaguuucacucuuguugcccaagcuggagugcaauggcgugaucucggcucacugcagccucugccucccggguucaagcaauuccccugccucagccuccugaguagcugggauuacaggcacacgccaccacacuugacuaauuuuuuuuuguauuuuuaguagagacgggguuucucaauguuggccaggcuggucucgaacuccugaccucaguugauccgccugccucagccucccaaauugcugggauuacaggcaugagccaccacucccggccucuagaaugcuuuuuaaaaaacauuuuuuucuuuuucuuuucuuuuuuuuuuugaaauggggucucucucugucguccaggcuagaaugcaguggcgugaucucaacucacugcaaccugcaccucccaggcucaagccauccuccagccucuaccucccuaguagcugagaccacaggugcaugccaccgcgcccggcuaauuuuuuuguauuuuugguagagaccgguuuucacuauguuguccaggcuggucuugaacuccuaagcucaagcgauccacucgccuuggccucccaaagugcugggauuacaggcauaagccaccgugcccggucuaaaacauuuuuuucauuuaaaaguuauugccggcgugguggcucaugcuuguaaucccggcacuuugggaaguugagaugguggaucacuugaggucaggagaucgagaccagccuggccaacauggugaagcccuaucucuacuaaaaauacaaaaauuagccaggcgugguggcacgccuguaaucccagcuacuugggaggcugaggcaggagaauugcuugaacccaggaggcagagguugcagugagcugagaucgccccagugcacuccagccugggcgacagagugagacucugucucaaaaaaaaaaaaaaaaguugccauauauucauuggaaauuguagaaaauacaaaaagaaagcaaucccaauaauguuccucuucucgguucuagaaccucuaaaccaacagauguuuaggcuuugggugaaaaagcacuauaucauguugacuaguucugagcauauguggccuuaacugaaucuucaguggauuuucagaccuuuaaaaaggcuggcugagcaaggcaugguggcucaugccuguaaucccaauacuuuggaagguugacgagggaagaucaucugaggccaggaguuugagaccagccugggcaacauagcgagacccccuucucuccaaaagguuaaaaaauuagcugggcuuggugguaugcaccuguagucccagcuacuugggaggcugggaugggaggauggcuugaguccaggagaucaaggcugcagugagccaugaucacaccacugcacuuccagccugggugacagacccugucucuaaaaaaaauuaaaauaaaaaggccagcugguucugggugauggauuauaugggaagacuugugaacuccugugggcacuuuccuauaucuuuagguauagaaaugcauuccuuggccugaagcuauguuguguggauacauggcacugaguaagauuaaauaaguccagguccaaguucaauugaguuuucagucuaauaaggaaaaucacugccccuuccaugagggaaaggguuccaauggaaucagccuaccacaagguggcuaaauggucccugagaugugguaccuuaucaaggcugggauugauugcuucucuggacagauugggcauauggcaugcgccagugaggaggguaucuguguugacuaauacauuaacuccaucuuugucgcuguggccacucuauucauaagucccuugaccaagucauggagcggcuacagagaaaggcuagcugaccuucacagagcaggugucuuccccacuugaccaagagccuccuugaccaugggacucuuugggugaacauuaacauuaggccaacuguagucaaacucuauaguccaaacaguaauuuuggaaguuuuucacauaccucuuuuccaaaucucguuagccauccucuacuuuuuuccaaggcccuaauaauucagccgaaccauuuuuuucccacugccaauaaauuaggauauauauccuugccucaggcucucucuccucccaggcugaguagacagugagauauacaccuuaaaguucaccucaccgagaguaauucccuucaccacugccuuccaagaccaucccugaguggcucuguaauaccacagcaguccacuuucaucuggugccagcauauuguauuaaguuauuguaaaauaggcucugauuuuguuccuguucaacuaauugauuauagggaacagcauaugaguaaggguugguugaggguuguuggugguaggaguugguguacuagaguaugagccaucugcuuauuuaacuuacuggugccuucauaacuugcuucauuuccacucuuauaucuaccacuuguccuugaugaugaagugcuucugcgcauagcaguuuccuggcuaggcagauuaacagauuaacauagcacccaguucagaagggauaguucaguuugcaggaucacaguaucccauggccaggaauucagucuguaguagggcccaguagcaaaccaaaaguuauuuuucaaaaggacaaugguuacuugacaaaaguggaugcauagauuauaaguguaggagacuucacugaguuuucuguuggagcuugucauauuggauccacugaguuauaaggaugagugucgaagcugcuuguccuggggcagcuggugagccuucuuaugcucuaagccccauucuaagcugacagcuucuugggucaucucguuugggucaaaugguuugaagcaacacacuuaaauaagguacauguggccuccaagauccuaauuugcacagaaaaagaauguuguguguucuccaaccuuacuccaagagguuguauuuugguauagauuuuuuauuuuuuucuccucucauuuauugaucaagauggaucuacuuuucccccugaccuuucuaacuaucugguacagcuccagugggccuagagaggauucaagggaagccuguuucuuuggagccuccgcuucaaagucaggugggaggcguuguaucugauuacaguguuauaaaacaaggccagaauccauucuagcccuucacccuuuuacagagagaaaauaucccauugcuauugaccacuucaaacccucaaugauaggagccucaacuuaagcuugcccuuauagaaaaugauacaguuuauacauuugggaacauuuuauuuuacuuuugaaauaaaagugaaacuaaaaacuacuggcggggcaguaugguucaugccuguaaucccagcacuuugggaggcccagguggguggaucaucugaggucaggagauugagaccauccuggcuaacacagugaaaccccgucucuucuaaaaauacaaaaaauuagccgggcaugguggggggcgccuguagucccagcuacucgggaggcugaggcaggggaauggcgugaacaugggaggcggagcuugcagugagccgagaucgugccacugagcuccacccugggcgacagagugagaucugucucaaaaaaagcuacuuaaauaauuuguucugugaucacacuaauaccuuucuuaaaaucacacuaugaauuuuuuuuuuuuuuuuuuuuuuuuuuuugagauggagucucacucuguugcccaggcuggagugcaguggcgccauuucagcucacugcaagcuccgccucccggguucacgccauucuccugccucagccucccgaguagcugggacuacaggcauccgccaccacguccggcuaauuuuuucugcauuuuuaguagagacgggguuucaccauguuagccaggauggucucaaucuccugaccucgugauccacccgccuuggccucccaaagugcugggauuacaggcgugagccaccgcgcccggccacacugugauuucuuauacuuuauggaugcuacugaucccauagugaaaucagcuugguaauaacuuagaaauuucauguccuucuuucuagaugaauucuuuccuguguuuuuuuuuauuugcuguauuaauuggucgaaaggagcuuuuugcugcauuugguuuuuaugauagccaacccacucuuauuggacuauugaucaucuuccaguuuauuuuuucaccuuacaaugagguaauguaugaucuuuaaaauuaucacacauaugcucuugccugcuucaaaucuagagcuuucaggauagugaaaaaggaaauagaacaguacaguuuuaacaaauagaugaaacaaagucuuuuaguccccugauucacuggucaguaugacaaaguagcagaaaaauucaagcccaaauaaauaaacguuugcauacucuuaggaaaguauaaguagaaaacuagacuucaguggugaacaccuaaaaggacucgguagauggagauuaacuauuggaauguuguguccuaggccacauauucaccagugcuuggguaaaaaucuuauguguaugaggggacaaagcaaacacuaauugguacagcucaguaagggaggcuuagugacuguuccucugcuccaugaccaccugccuccauauagccugagggauccacccaaacccacaaaaucaaaaucggguauuuugugguaaaugaaacuuaagaacauugcucuguguuagcucauuagggguauuccgugugagugauaauacauagguuaaugugagacuauauaacaaaccugacaauggcaucauuucaugauguuugguaaggcuuccaaauuaagcuaagaaauaauauugaagaucuugagguaucuccauucagaagaauucuuucuugggauagauuguagaguuaagaugagcuaaaugaauuauauuuuucuauuauguaugguggggacaccaggaaagaaaaauggaggggcauagaucauauucauauagcauuguccacauaaacaaaaauaaauuuggcagagaacugagauguauuaucuuaaaacucuuuuuuuuuuuuuuuuuuuaagauggagucucgcucugucucccaggcuggagugcaggggugucaucuuggcucacugcaaccuccgccucccggguucaagcaauucuccugccucagccuccugaauagcugggacuacaggcacccaucaccacgcccagcuaauuuuuguauuuuuacuagagacaggguuucaccauguuggccagguuggucucgaacuccugaccucaggugauccaccugccucagcuucccaaaagugcugggauuacaggugugaggcaccacacccggccugagcaugacuuuugagucucaugucagcacucaaaaguuucagauuuuggaacauuucagauuucaaguuuuugguuagggauguuuaacuuuuauauguguuucuggccuguuugcuugggggagaauaaggcucaauuuauaauuuccucacccuagguccccuaaauauuagugaucuuucuuuuguccugccauuccucuuaucccaagccaaacuucucuacagucucagcucauggaaccuuuaguaacaacaaagaggugggcaguggcuaaaacccuuucauuuucuuuuucagguucuuucuuuuugccuaacaguccuaagccgcagauuugaguuucaagcugaugcauuugccaagaaacuugggaaggcuaaagacuuauauucugcuuuaaucaaacuuaacaaagauaacuugggauucccuguuucugacugguuguucucaauguggcauuauucucauccuccacugcuagagagacuucaagcuuugaaaacuaugaagcaacacugagauguccaggaucugugacugaagacauuucugauuauuucuguccuggcagcauguuccagcucuugauguuuuuaaacuuuuuuuuagaagaaaaauuaaguacagaaaagcccagauuuaaauacauuuaauaugucauuuuaaaaaugauuuuaauaauucauuucuuaaaacacugaaugaauuuugaagcuuaauguuuuuaaaggcauaguuuuaucuuugacaucuaauuuaccaucaaguuguaaaauuauuuggaaaaauacagaacucguuuuauuuguauacuuauauggaaucugcaugugagguguuugagggcauauguuugaaagagggagcaucaccacaggaauccuuucugugagguggaaacagugguccugaaucauugugcucacaccuaacuugaaaucuggucuuacuuucaugcuguuaugauuucaccuggugaaucaguguuuuaaauaagaaagguaauaguugguaaggccaauguuauuuaaaugaaaguaguuagaaaaaugcucuccuauucuaccaaauuuuuaauuucuuucuucccuuucuugcuacacagugaucaagaguuucucauagugcuuugaaguuagaaauuauguauaggauauuuuaaaucauugaguuuugugggguuuuuuuguuuguuuguuucuuuuguuuuuuggaaaauccgugucuuuaucuuuuuuucccacgugguagauaugaucccauuggagguaaauuguagcuucuucucauucaugcaguaaauaauacauccuuucacucagcagagauggccauauuaaacacguuuugcuauguuaaaaguggcagaacaggaaagacgaauuaaaaauaacauuuuuuaagcgacauaaggaugaaauacugaugaaucucugugacauuacagggaaaaaaauauaguuuucuaucucuuucaagggcagaagaguuuucauuuuuauuuuuguaauuuuaucuguaagucauaaauauuacuuaaucaggccugauucuacuuuugaaaauuacaguucuugaaaugcagauaauguuuacuuugaaaacaaaugucaugaaugauuuccaguuuuuaaagcuauauguuucacugcuucauaucucuguccacuuucugaaugagaacuuauuuugugccuagagcucucacucacugauaaugcuuauuaccuucugggcauuuauuccaaagugggaucaacuguacgccuuugguaucugaccauaaagucuuuugcuccgcugacauuugggugaugucuucacauggaaauauaauaaaaauaaaaaucuaguuuaauacugcauuauuuauuuuccuaaggcuaaagaggagcaguccuaugcuuuuauucagcauccuuuaucugugacuucaugcucugauaacugccuuuccuuccuucugugccuuugaauacaaauuucaguucugcaaaagugaaacauuaaacauugccaacgcaaauguaugua

SEQ ID NO: 191408 - RNA, 42472 nt, Homo sapiens
cagacugccauaagauggcguccguggcggcugcacgagcaguucccgugggcagugggcucaggggccugcaacggacccuaccucuuguagugauucucggggccacgggcaccggcaaauccacgcuggcguugcagcuaggccagcggcucggcggugagaucgucagcgcugacuccaugcagguauggcagugcggcuggcccgggcgccuggggaccccggaggccgcguggacacccuguggcaaaggucuuaaagggugaaccccgaggcuuguaggggcggaggggguagguaaagggagcccauacuuacuaagcacccgccgcaugccagacacagugccagauguuucccuuaucaucgucucaucaacuucucacgacguuacuauuugguagauacuauuaucuccuuuuauggagaaaggaauuggggcuuagggaggugaaacgauuuuuuccaugucacauagcgaauaaguggaagacaugguauuugaaccuacaaggucgacagauagguauccaguaaauaucuuuugaauaaaaauuauuccagagcuuuuguuguaacucuaacccuaacccagcgagaucaggauaaauuggauaccaccuauggugucugcugggggaguggaauaggguugacagucaggagaccuggauucuaguccugaaucugccauuggccaugugacuucggaucaacaaugucguuuauuuggacguuauuuuauauaucugugaagugaggaaaaugucaccuaccgcacaagguuauagugcuuaauaaaugggaucaugagcguuagaacgaagaacagagugcccuguccggaauaaggccagacuugugguaaaugcuuuuuuaaguagagguuuuaaaucauaauggcugauuuaaaguugaaggggcuuuguccucuucuucgaacugggaggcccagaagggguguacaucacaucugggagcauuuugcuccauuaagaguggguagugggugacauuuuggguaaaucucugauggaggaacuacagcagcuauuuguugaggagaauuuacaguuaugagucuucacagaguaaaugagauguugaacaugaaaugccuggcacugaacauagcaccugaugaguacucagcaaagaagggcaguuccuuuccccaacucacccagaagccagugggcauaguuucugcuuucauuaguuuauguggcaugacaagaccaucagcacacaugaaacgaucggauaauucaaaaaauaauuuguuugcagucuacuuugugccagcuucagaagacaauuuaccucaaaucccagcugucuuuuccaagauaugcagcuauagccuaaccucuucaugccuuuguuucuucuucuguaaaguaggaagaauaauaucaauaacacaacauuauugugaugauuaaaugagauaaaguaugugcaguacuuaauacaauauauggcacauaauaagagcuaaaaauacagcagcugcuaucuucugcgaggcccuacuggagagacaaaaucauaauuucugcccuugaguuuuaguccagcugaacauaaaacaaggcagagcuaauaaauguuuggacagagauauuaauggauuugcaagaugaugggaggagagagacuacagaugcuagauuuuaugacaaguauuauagaauuucugagacaggagaaauuaucgaaggcuggcuuaguauggaaagcucucugaaaaagggcuugaaaaauaggucaaguuuggauagguaagaaagaagaaaaagcuuauuaaaggaaagaacaugaagcugguccaaagguauugaguugucucaguugauuguucacagucaguuacagauggaacucccuuuucuacucuuuggcccuuucucacuacuguacaugacuagucuuaaaaaaaaaaaaggaacaugaaugaagaugaagauuuagaaggugaaauggccauaguguguagguaggauaguaaaaggagacuguucaauugcagauauggaaugugagaugagcaacaugaugaaggcaguguguaaggaacauucauuugugagcaguacguaugguacuuggauaaaaaauauccaagaaugguauaauaguagaucuguggucugauaccucagagacuuaaguaauaagaguuucaguaagauggaguuacacugaugacaccuaagguccaugccaauauuuauguucuaucauuucuuucuucuuuuuuuuuuuuuuuuuuggagacagaguuucgcucuuguugcccaggcuggagugcaguggcgcgaucuuggcucacugcaaccucugccuccuggguucaaggauucuccugccucagccucccaaguagcugggauuagggugagggacaggcaccugucccacacccagcuaaguuuuguauuuuuaguagagacggaguuucgccauguuggccagacuggucucgaacuccugaccucaggugauccacccgcuccagccucccaaagugcuaggauuacaggugugaggcacugcacccagccuuacaucuguuuuuaaguagguuacuggguucuggcagugaggguuggauauagcucuauaguagcuauuaugucucguuacucauagcuguguaccaaagaaauguuucuaucuuuuuucuuuucuuuuuuuuuuugaaacggagucuugcucugucgcccaggcuggagugcaguggcgcaaucucugcucacugcccccucugccucccagguucaagcaauucuccugccucagccucccgaguagcuggaauuacagacgcccgccaccaugcucggcuaauuuuuguauucuuaguagagauaggguuucaucauguuggccaggcuagucucaaacucuugaccucaugauccgcccgccuuggccucccaaagugcugggauuccaggcaugagccacugcgccuggcccaacuuguguuuucaaccagugaaaggagaugcugcuuuucagugacuugagguugacucacuaguauuugguaaacauguaaacaaaaugauauuguugauguugaaucaccagcuacuugaaauaacauuuucaauuucaaguaacuccacaggcaaagcaauaauaaauaucaacaacucaaauuuucaaagcauuguuuaccaaauguuuacaguuucuucuuuuuuuuuuuuuuuuuuuuuuuuuauuugaggucuugcucuguugccccggcuggaaugcaguggugugaucauagcucacugcuauaacuuuguuuuuguuguuguuguuguuguuuugagacggaguauugcucugucacuaggcuggaguacaguggcacugucucagcucacugcaaccuccgccuccaggauuccagugauuguccugccucagccucccgagcagcuaggacuacaggcacaugccaccaggcccagcuaauuuuuguauuuuuaguagagacaggguuucaccauguuggccacgauggucuugaucucuugaccucgugauccgcccaccucaaccucccaaaaugcugggauuacaggugugagccaccaugccugaccuuuuuuuuuuuuuuuuuuuuuugagauggaguuucgcuauuguggcccaggcuggagugcaaugacaccaucuuggcucacugcaaccuccacuucccagguuaagugauucuccugccucagccucccuaguagcugggacuacaggcauguaccacugcaccuggcuaauuuuguauuauuaguagagucgggguuucaccauguuggccaggcuggucuggaauuccugaccucaggugauccgccugccuuggccucccaaaaugcuggaauuacaggugugagacacugcgccuggcacugcuguaacuuugaacuccugaguucaagcaguccuccugucucaaguagcugggacuauaggcauggaacacugugcuggugauaaauauauauauauauauauuuaaaauccucacaauagucucauaaaauggauauuaucacuucacaguuaagaaaauaggccuaaggucuuagaauaaguagcagaccuggagucugaacaugaaagugucugcuuuccauccccaguggcauaucugcuacacaaagccauuuccuuuaagaugaccaggggcugugggguucaaucaguagggaguuuuuuguuuguuuguuuguuuguuuguuuuaagauggagucucgcucugucacccaggcucaugaucuuggcucacugcaaccucugccucccauguucaagcgauucuccugccucagccucccgaguagcugggacuauaagcgugugccaccacgccuggcuaauuuuuuguauuuuuaauagagacgggguuucacuguguuagcuaggauggucucgaucucuugaccucgggauccgccagccucggccucccaaaaugcugagauuacaggcaugagccacugcgccaggccaggaguuuuuaacuuguaugccaguuauccuucuuaggagugugcaacauuuugaucaggaaaaagauguauuuuaggauucauauuguaaaucacaguguuaauucauagugauaucugucaaguggaguguugagcugacuggaagccaccugauguacuuuggggauaaaauuugcugcagcuaagagauauuaauagaaucuaaugucaaguucguaucaaagacagauaguguuuauuggaacaaaggguaaacuuggacuuguggagagccuagacagaacaguaaacuucuuuguuguaacacaccaaagggugaccaaauagaaagugugaucauagaaaguuuuuucaaguuucuaaauuggguuuuuuaaaaccaauauuugcauuuuaauaauuccuuuuggugugcugcugaaaauuuucuauucagaaguguaccaguaacucagaaacuauuguacaacacuaucuuaaauguuaaauugucucguacuucauacugcuuuugucaucccuuuguccugcuuuaaaauguagggucauccaaggcaacaccuacccaaggucaacccuacagcaccuacagggcaguuccuauccagagaaaguauuuguuuuuguaaacauugaauaaguacuuuaagcuuugagguaaaacuacaaugggguuguuaaagguauugugucuauggugaucauuucuucauguagccugauaugcagugacuugcuucuguagccaucuagcaucugaagguacugccuguccucuuucuucccaguguucuuuuuucuuuuucuuuuuuuuucuaugacacagccccaggagguccugaaaacacaugcccuuccaugauucuuaugcaagguaguuguggauugggaagucagaacuacuuucugaggggauuaccuucuuugggauuucucuuggguuuugcugaggauuucuacauggccauucugacagaagugagaaacaacauuugugcuuuauuuucugagucuucugaaugcugguuguuucacaaauuauagaaauaaaaauauucucauucaguaguaagagucugaauucaaggagggacagguaauacaaucccuguuuuccaggauggaaaaacuggagcuacagaagauuaaagagcugucuagagaucacacugcaagacacugggaauuggaucugggucuucuaacucauuuguagagucugauguauuucaggaagaugauaccgaaggucuucuuuucagucugagucuuuuucuuggcuuguaaauucaagguacagugccgggccuucagugacuggaugaaacauuguacugagaaaauugaaggcccuugccaaacauguacaaugauggccuggaaauacaaacuaccaacuauaugcuaagagaaaagaaacaaaguguucuguucggguuuauagagaggaagugucucuaaugccucaguuuuucaaguccuguggagaagcaguagccguacauaggagcacaguuccuuuuguguuuguuuaaaccuacaagaggagaaacaaaugauuuuuggcagucugacuaguaagcaagcagaauaugugucaucucgucauccaauagauguggagcucuuuguucuuuuuuuuuuuuuuuuuuuuuuaauagaagcaccauguugcccaggcugaucuugaacacucuuggccccaagugauccuccugcauuggccucccaaagugcuaggauuacaggcaugagcuaccccaccuggccucuguauucuuuuuguuugcuuugggacauacuguaggagcaguguuuguaccaaaagacugucugaucaagggagauaugggaugcuugggggagggauaugaaaggagagaugggaugguggaucacaguggcuuaauaaaaugugaaauaaaaggcuugaagaccuguuuuuuuuuuuuuuuuuuuuuuuuugaagacccauuaaccaggagaaaaggggucuaucuggaagguauuugccacaacugacaaaggcaguccuuuuuuuuuuguuuuuuuuuuuugagauggagucuugcugugucacccaggcuggagugcagugacuccaucucggcccacugcaaccuaagccucccaaguucuagccauucuccugccucagccuccugaguagcugggacuacaggcgcccgccaccacgccuggcuaauuuuuuguauuuuuaguagagacaggguuucaccguguuagccaggauggucucaaucuccugaccucaggugauccgccagccucggccucucaaagugcugugauuacaagcgugagccacugcacccagccaaaggcagucuuuuagaaggacugagacuuacaagaggcuaaaaaggaaaucucaaaauuuucgacucaucauucauauauauauauagauagauagauagauagauagauagauacacauauaaauaaugaguuucuaggucccuugguucaccuccauuguaagugaauuuaguuuucuuuuggcugcaguauuaagcuguguauguuguacauauguggucauguuuuugcaccuacagggagaacuuuggagucaaaucuguguuauauaaggaaggagaagugacuacuggccaaacaggaaaccauaggagagcacagaugaggcuugcagauucagauucaugaggaugagugcuacccugauguuucagugccugaggcaggguguugaagcagcuccacuucaaaaagauauauuugaggaguaaaaguuacuugggguauauaggaauucacauaugugcuccauuaugauuuaauggaauugguuuuguuuuucuguguaguuuuggauuccucagaaacuugaaucagaccaggacccuguuggccucuugaucccuuuggggcucugcuugugaguagcagccucccuguaccucccucauuguggcagucagaguucaagcccucauuacaggaaugaucauaauaauuauacuacugaagauaauagcaagaauaauauauaugucaggcaguucuaaaaguuugacaaauauuaucuaauauccuuaccguagccuuuugccgugggugcuguuauugucuccucccuaccaaaaauuacuuuauuaaauccucaucuccaugcuguuuuauacuuuuuccucuaacucuuauuuauuuauucauucauccuccaucccauucuuuuccucuguaccacuguguacauuuuaucaagcagaaaagugggaagaauaauauuacugacaaaagaacaguaugggcaaaguuaagaaaaugcaugguauguuuucaaggaaugaccagcaacuaucuggcauagaggguacuugagggacagugguaggagguaaaacuaaaaauauagacccugggaacaaauuuuugaggcccucaaaagucaugccaugagguuugagguuuuaaagagggaagugguaguaagucuauuuuuuuuuuucaagacagagucucgcucugucacccaggcuggagugcaguggcgcaaucucagcucacugcaaccuccaccucccggguucaagcaagucuccugccuuagccuccugaguagcugggauuacagacgcaugccaccacgccuggcuaauuuuuguauuuuugguagagacaggguuucaccauguuggucaggcuggucucgaacuccugaccucgugaucugcccaccucgggcucccaaaggguuggaauuacaggcgugagccacugcaccuggccuguaaaucuauuuuaugaaguaacuggguggagaguggguuagagaaggaaaaacaguuuaggauucuguuacauuagucugggugagagaggcuggaguugggcuuuggcuggagagaauagguaaccauuuugauauuuuguaaacagaaccaacaggauuuugguuauugaauuggaagcacuaugaaaaaaaugagaacaaagcauuuuuguguucagaaaaaugagacaugcgggggccgggcacaguggcucacgccuauaauuccagcacuuugggaggcugaggcgggcagaucaccugaggucaggagcucgagaccagccugaccaacauggagaaacccuaucuccacuaaaaauacaaaaaaauuagucaagcaugguggugcaugccuguaaucucagcuacucaggagacuaaggcaggagaaucacuugaacccaggaggcggagguugcagugagccgagaucacgccauugcacuccagccugggcaacaagagcgaaacuccaucucaaaaaaaaaaagaaaagaaaaaugagacaugcuuauuaaaaaaauccaauaauacugaaaaguacagagacaauuuaaccauagucuuagcauccuggaguaaugauuuugguucacauccuuccagacauuuguauauauauuuaagcacaugugucauguguguauauguuauuacauaaauugacucagagguuagauacuauucuauuuucuuuuaacacuauguuauggauaucuuuauauguuaauguauauagcuauaucaguagucucaacuuggggugauuuggccuccuaggggacguuuggcaaucccuggagacauuuuugguucuaauaacuggggagguggguuccuggcaucuaauggguagaggccagagacauugcuaacauucuaguaggcacaggacaacuucccauaacagaauuauuuggccccaaauauuaauuguacuaaaguuaagaaacuguccuauauuauuguuuuuauaauuuuuuauugauugauugauugagacacggucuuacuguguuacccaggcugguuucaaacuccugggcucaagcagucgucccacuucaccuuccaaguagcugagauuacagguuuaauuuugauuuugaaauaguuguagauuuuuauuuuuauuuuuauuuuuuugagacagaguuucgcucuuguugcccaggcuggagugcaauggugugaucucggcucacugcagccuccaucccccggguucaagcaauucuccugccccagccuccugggacuacaggcauacgccaccauaaccagcuaauuuuguauuuuuaguagagaugggguuucuccaugugggucaggcuggucucgaacucccgaccucaggugauccauccgucucugccucccaaagugcugggauuacaggugugagacacugugccuggcccgaaauaguuguagauuuacacaagaguuucaaagauaguaccaagaguuccuguauacccuucaucuaccuuguccuaauauuaauaucuuacaucaucaugguacauuuauuaaaacuaagaaauugauauagguacaauacuauuaacuaaauuauagucuuggauuucaccaguuuuuucacuuaugucccuuuuccauuucaggauucaauuuaggauacuauacugcaguuagucaucauguaucuuuaguguccuccaaucuuugacaguuuucagucuuuccuugucuuuuacgaccuugauacuuuugaaggguacuggucagcucuuuuguagaugucucuccauuuggguuuugguuucucaugauuagacuuggcauuauggauuuugggaaaguauaccacagaagugaaguacccuucucauuggaucauaucaaaguaugauaucaacauaguauuagcauggcuuauuacuggugaugguaacuuugaucauuugguugagauuguauacacguuucuccacugaaaaagucacgauuuuucucuuuuuguguuauuuuucuuuuccauuuccauaaaaugacaguaccuagucuuauuuguuggaaaucauuugccaagucuggcccacacugaauagaaggagaauuaagcuucauuuccaggaugaaagcuuaucaaauaauuugcggacauauguuaaaagcaccacaguaauuaauaaauauuuuaggggagauacccucaggcuaugcagauguccuauuucuccuuaaaguuucacccucugauuuuagcauucaucagagucuuucuuuucuuucuuucuuuuuguuuucuuccuuucuuccuuuuccuuccuuuuccuuccccucccucacuucuucccuucuucccucccucccucccucccuuccuuccuuucucucucuuucucucucucucuguguguguguguguguguguguguguguuuaguacuuccugucugguauuacaagaugcuucuagucccuuucaguggaaagagcuaggaaauguauguauguauauuaaucuauauauacacacauuuauauuuauuucucuaucuguauguauauuaaaauaagcauggguuuauacugguaucucugacuaauccagcaccacaagauucauucuagucuuccccccuugcuuauuugugacuucuuucucagaguaagaaauuuagcucucauucccuauaguauauuuacuuauuuguguaaccuguaguuucagugauuacuccugugagaaacagauuuaccaacuagaguacaauguuugccuacaguuuguuuguuuguuuuuauccuuacaguaucgaguaguaacauuguuuuaugaaguuacuuagaucagcuccuuuuguuuuccucucugagguuauaucagacguuuguaaugcaguuagauuucauuuguuacagucuguagucuauccuggguucccagauauucugguuauuuuaaaaaauuugcauacaguggccagcugcagugguucacaccucuaauccaagcacuuugggaugccaaggagggaagauugcuugagccuagaaguuugagaucagcuuggguaacauagugagagcccaucucuacaaaaaaaaaaaaaaaaaaaaaaauuagucaggccugguagcacauaccuguagucccaauuucuccuggcucaagcaggaggauggcuugagccagggaggucaaggcugcagugagucaugauggugccacugcacucuagccuggacaacaaagcaagacucugucccaaaaaaacauuuuuaaaaauuuuuugcauacauauaguaaaguguacucuuuaugauguuuaguucuauggguuuugacagaugcauagagucagauauauaccccacaguaccauacugaacaguucuaucacccuaaaaaaucccuuauaguggccccuuuguagucaaccccucuaucuccuucaaucucuggcaacaacuuaccuguuuuccaucccuauuguuuugccuuuuccagaaugucuuaaaauguaaucauacaauauguagccuuugagguuuggcuuuuuucacuuagcaaaauacauuuuuuuaaaagguagauugauugauugauuggagacagggucucauucuguugcccaggguggggugcaguggcgccaucucggcucacugcagccucaacuuccugggcucaagcaauccuccuaccucagcaccccaaguagcugggacuauaggccugugccaccacaccuggcucauuuuuguauuuuuuguagagacgguuucaccacguugcccaggcuggucuggaacuccugagcucaagcaauccaccugccucaggcuccgauuauaggcgugagccacugcaccuggccagcaaaauacguuuaaaauucuuccauguuguugcaugcguccaaugcucuuuauugcugaguaguauuccacuguuuggauguaccauaguuugucuagucaccuuuuuuuuuuaugagacggaguuucucccuuguugcccaggcuggggugcaguggugcaaucuuggcuuacugcaaccuccgccucccggguucaaaugauucuccugccucagccucccgaauagcugagauuacaggcaugugcgaccacgcccagcuaauuuuguauuuuuaguagagacauaguuucuccauauuggucaggcuggucuugaacuccugaucucaggugauccgcccuccucagccuccuaaagugcugggauuacaggcgugagcuaccgcgccuggugucuauucaccuauuaaaggacaucuggguuucugguuuuuggugauuauaaagaaagcuauuguaaacauucauguacagguuuuagugugaaauuucauuugaguaaauaccuaagagugggauugcuaggcuguuugguaacuuuaugguuuaacuuuacaggagacuaccaaacuguuuucuaaaaugacuguaccauuuuguauuucucccaguagugaaugagaauucguguucuucuguaucucuauauuauuuccagcauuugguauugucaggcuuuuuuuuuuuucuuuuaauuuccgcaguucuauguacugguaucucauugucguuaauuuacauuucccuaaagaccaaugauguugagcuucuuuuuuuuuuuuuuuuuuuuuuaguauuuauugaucauucuuggguguugcucgcagagggggauuuggcagggucauaggacaauaguggagggaaggucagcagauaaacaugugaacaagggucucugguuuuccuaggcagaggacccugcggccuuccgcaguguuugugucccuggguacuugagauuagggaguggugaugacucuuuacgagcaugcugccuucaagcaucuguuuaacaaagcacaucuugcaccgcccuuaauccauuuaacccugaguggacacagcacauguuucagagagcacgggguuggggguaaggccauagauuaacagcaucccaaggcagaagaauuuuucuuaguacagaacaaaauggagucucccaugucuacuucuuucuacacagacacagcaacaaucugauuucucuuuccuuuccccacacuuuccccccuuccacuugacaaaaccgccaucgucaucauggcccguucucaaugagcugcuggguacaccucccagacgggguggcggccggagagaggggccccccaccucccagacggggcagccaggcagaggcgccccccgccucccggacggggcggcuggccgggcagaggcugucccccaccuccuggagggggcagcugccuggcagagacgcuccucacuucccagacggggcggcugccgggcggaggggcuccucacuucucagacggggcggccgggcagagacgcuccucaccucccagaugggguggcggucgggcagagacacuccucaguucccagauggggucguggcugggcagaggcgcuccucacaucucagacggugggcggcggggcagagacgcuccucacuuccuagaugggauggcggccgggaagaggcgcuccucacuucccagacugggcggccgggcagaggggcuccucacaucccagacgauggguggccaggcagagacacuccucgcuucccagacgggguggcggccgggcagaggcugcaaucucggcacuuugggaggccaaggcaggcggcugggagguggagguuguagcgagccaagaucacaacacugcacuccagccugugcaacauugagcacugagugagcaagacuccgucugcaaucccggcaccucgggaggccgaggcuagcagaucacucgcgguuaggagcuggagaccagcccggccaacacggcgaaacccugucuccaccaaaaaaauaugaaaaccagucaggcguggcggcgugcgccugcaaucccaggcacucggcaggcugaagcaggagaaucaggcagggagguugcagugagccgagauggcggcacuacaguccagccuccagucugcaucagagggagacccuggagagagagggagagggagaccauggggagagggagggggagggggagagggagagggagagcuuuuuuucagacagaguuuugcucuuguugcccaggcugaagugcaguggcacgaucucggcucacugcaaccucugccucaucgguucaagcgauucuccugccucagccucccgacuagcugggauuacacaugccugccaccacgcccagcuaauuuuuauauuuuuaguggagacgggguuucaccacguuggccaggauggucuagaacuccugaccucaggugauccacccgccucggccucccaaagugcugggauuacaggcgugagccaccacgcccagccaguguugagcuucuuuucauauccuuauuugccaucuguauauccuuggugaagugucucucagaucuuuugcccacgggagugggguuguuuucuuauugaugaauuuuaagaguuuuuuuuuuuuuuuuuugagaggaaguuuugcuuuugucgcccaggcuggagugcaauggcgcgaucuuggcucacugcaaccuccaccucccggguucaagugauucuccugccucagccuccugaguagcugggauuauaggugcuugccagcacgccuggcuaauuuuuuguauuuuuaguagagaugagguuucaccauguuaggcaggcuggucucgaaguccugcccucagaugauucaccugccucagccucccaaaguacagggauuacaggcgugagccacugugccuggccaagaguucuuuauauauauccuggguauaaauccuuuaucagauauguuauucgcaaauauuuucucccaaucuguggcuuauuuuuucauucucuucacaguaucuuucacagagcaaaaguucuacauuuuuauaaugccuaauuuaauuuaucuuuuuuuuucuuuuauggaucacgaggucaggagaucgagaccauccuggcuaacacggugaaaccccgucucuacuaaaaauacaaaaaaaaauagccaggcaugguggcgggcuucuguagucccagcuacuugggaggcugaggcaggagaauggcaugaacccgggaggcggagcuugcagugagccgagauggagucacugcacuccagccugggcgacagagcgagacuccaucucgaaaaaaaaaaaaagaaucuugaagggguucagugugugguagcugucuuuuccucaguuucuggaauuuaauuucaccucaguaggaauucauuacuugaagcaaacaaauauaccagagucaaauggggauaaaaauucuagugaguggcagcagaaauagcuuggguuauaggcagagcagccuggcauuaguccugucucugcuuccagccaguuauauggccaggggagccugaguauucucgaauauaaaauguuggguguuuggacuggaugcagagcuucuccaguguuuguuugcagguggacuccaagcagccacugcagaagcucugugucgcaguuucucauguuuuaacuuaaaaauaugugccaauuuugcauucucugcccuaauguuuguuuagauguaaaaauguuucaauuuuuuuuuucugcuaccuaguaagauugauacuucagaagaauguaucacauguauguuauacacaucucaguuugaaaacuauggccuuggccaggcgcaguggcucaccccuguaaucccagcacuuugggaagccaaggcgggcggaucaccugagguugggaguucgagacuagccugaccaacauggagaaaccccgucucuacuaaaaauacaaaauuagccaggcauggugguggaugccuauaaucccagccacucgggaggcugaggcaggagaaucacuugaacccaggagguggagguugcggugagccgagauugugccacugcacuucagcaagggcaacaagagcgaaacuccaucucaaaaaaacaaaagaagaaaacuauggccuuauaugauucuggucccuuuucccuuaaagagaagagccguaggaaagaauaaaagccauaaucugcacuauaaauuccaaaccaugagucucaucacacugacucaacagaucaggcacagauucuccugcuuuuuuauuuuauuuuuugagacagugucucacuucaggcuggagugcaguggugcaaucauggcucacagcagcccugaccuccuggcucaagcaguccucccaccucagucuccugagcagcuagaacuauaggcacgugccaccaugccuggcugauuaaaacuguuuuuuuguuuuuguuuuguuuuuuuuguagacauggggucuuuguguugccuaggcugguuucaaacuccugagcucaagcgauccuccuaucuuggccucccaagguguugggauuacaggugugagccacugugccuggccuucuccugcuuucugagcaucuuaauguguccaguuuauucagcauaucuacaguugaauuucugccagaguugaaaagaguaauugccuugauguuccugcagcaaacuuauuaguccuaaccuacugaaguuauguuuaaaaaaaguuuucuuuuaauuaaaaaaguaaagugagucaagaaaucagccuuucccguacucuucaacaucucuucaguugaauuugucuaaaggaaaaucaacuucccagugagugucaacaucuuuaagaaaauaauuuuuccuuucaucuaccuaugcuaaaacuaucuuuucucccgaagcuuggacuauuaaaacuagaagaaauuagcugggcguggugacaggugccuauaaucccagcuacuugggaggcucagauaggagaaucgcuugaaccugggagggggagguugcagugagccaaaaucaugccacugcacucuagccugggagacagagacucugucuaaaaaaaagaacuagaagagauguuagaugugagaaacuugagguuccagaagaaaaacuugaccuuccuccuuccuuccuuccuuccuuccuuccuuccuuucuucuuuccuucccucccucccucucucccucuucccuuucuuuucuuuuucuuuucuuuucuuuucuuucuuuucuuuuccuucccuuucuuuccucccuuucuuucuuuuccuuuuccuucuuucuuuccuuuucuucuuuucuuucuuuuuccuuucauuccuucccucccuuccuuccuuucuuuuucuuuucuuuccuuuaucacucucuucuuuccuuuaucacucucuucuuuccuuucuuucuugucucguugugcugcccaggcuggaguguaguggugcaauuauggcccacugcagcucacccucuugggcucaaaugacccucccaucuuagccuccugaguaguugggacuacaggugcacaccaccaugccugacuaauuuucuuuucuuuuuuuuuuuuuuuuuuuguagagacagagucucacaauguugcccagcuggucucaaacuuugggcuccagugaucugccugccucagccacccacggugcugggauuacaggcgugagccaccaugccugaugagaauccuuacuguuaaccacuuuucuauaugcuaugugccucucaaugauggaauguccacuagacaguugaauauacaggucuggcaccacaaaaagagaacuagauuguggauauggauuuugggaguuaucagcacaacagugguuguagaagccaugggugucacccagagaaaguucauaauacaaaaaggcagauggaugccauaaagacugccauuucucaauauuguuuccugacagauacugcuaauagaucaguggcuggccucaguaaaguagauggaggaaggccuagugggauaggaagaaaaaccuggaaagaauggugcccuugaagccccaaaggggagugauuaugaaggggagagagcucaauaguaucagauuguugcuuuuuccauuacuugcuuugagagcuuaguagaaaaguguuauauuuggcagucaguguucauuaaugaucucaguaagauauccauagggcaguggagggcagcaagcagugauuauauugagccauaauccaagguugugguuuucaaggcagguguaauccauugaggcaagaaagugauugaaggacuuuaggaucuaauuugaaaugggaaggacauaagugaaaagguggaagauaacuugcagggaaggaaccaaaccagggggcagcuuuuccuuuugcuuguagacagcuauguugggacaucacagccagcacucagagcucugggaucugcccacugccacggacacugcugcugauuagcacacucagggccacccuacagcaaggcagcccaaaaggauggagccuuaaaaggaugggaucuuuggcuguacacguaaaaaacuggggggaguaucugcaaggugaaauuucuuuagaucgggguuucucaauuucaggacuguugacauuuuggggccggauaauuuuuuuuuuuuuuuuuuuuugagacagagucucgcucugucagugcaguggcgcaaucuuggcucacugcaagcuccgccucccggguucacaccauucuccugccucagccucccgaguagcuaggacuacaggcgccugccaccacgcccggcuaauguuuuguauuuuuaguagagaugggguuucacuguguuagccaggauggucucgaucuccugaccucgugauccaccugccucagccucccaaagugcugggauuacagguaugagccaccgcgccuggccuggggauggauaauucuuuguguuuggggcugaaggcuagaccagagugcaucauuggauguguagcagcauccuuggccucuacccucuaaaugcuaguagcacccccagcccugcaguugugacaaucaaaaauguuucuggcugggugcaguggcucauaccuguaaucccagcacucugggagaccgaggcuggcagaucaccugaggucaggaguucgagaccagccuggccaacauagcaaaaccccgucucuacuacaagcacuagccaggcgugguggcagguaccuauaaucccagcuacuugggaggcugaggcaggagaauugcuugaaccugggagguggagguugccgugagcugagaucacaccacugcaccccagccuggacauugccagaugucucccagugaacaaaaucacuugaauugagaaccaugggucuggauucugcugguuuucuucuucuaguucucuguuauggauuucuuuuuuuguuuuuuguuuuuuccauaucuuuuguuguuguuguuguuuauaguuuuuuuuucauaucucuuuuuuuuuuucucuguuguagauuucuuuuaccuucauuaguuccuccaggcauuucagcucuguugauuuggagaguucagguuauuucagcguuguaccauuuuuacaaauuuuuuuuuucaguguggaaauaaaccaucaauagaggugcaacaaagugguauauuuuucuauaaugcccaauuuaaugccuagaacauuaaauguuuagugguuauacacucuuguaucauguaucuucuuuaauuacagcuauuugugucuaacuuggacucugaggacuaggacucuuuuuuuuuaagagacagggucuugcucuguugcccaggcuggagugcaggggcaccuuuuuagcucacuauagccuuggacuccugggccuaagcaguccuccugccucagccucccaaguagccgggaggcacgugccaccacacccaacuaauuuuuaaauuuuugguagagauggagucucacuauauuggccgggcuggucuugaacuccuggucucaagugauccuccuacucagccuucuaacgugcugggauuauaggugugagccaccaugcccguccaugggacuuucuuaaucuucuuuucauaacuaacauguugcaguauaccuaacacauaguagacgcuuaguaaauguuuguagagauaagucaauuauguuagauaauugaugaaguggauuaaaccuggaauuuuucagaauauuucagucaucaggccuuacaaagaagccaguugucccuuaguugucaaaauaugguuugugcagagaaaagcauuucauuccaaaucauuuccaugcacacagaucacaaguauccuuugggagaaggggaaauggagcagaguggcaugcugucuuugaaagauaacacagauccuuuuggcucuucccagcauucaggcugauuguagguagagugaugcugaaacuguaauugaagcugaaaaauaggguaaguguaagagauucagcuacaaaucucacaugugaauguuuucuaggcugguaauaaaauaauaagccugauuguggcauuuagagcauggaugugaccuaaaccucuggaccaaaugugauacuuacaaaauugauuaauuucuaaguuuguuuagauauuuaugccugguacaaaugugaaaaauguuguguuuuugcuucuuaacugugcaguaugauuuuauuugauaaauaaaggauacccauaaaaacacauaauuaauaacuguacagcucaauacaauaauaaaaaguuaaaauaucuguguaaccacaacucaacugaauuucaauucaagaaacggaauaucacaagaaauagaacauuaccagcucuuaauaauuuugaaaauuuuauuucauugcugcuauucacuaguuucuuauugugccuaaaagcuaucauccaagucuuuuuuuuuuuuuuuuuaaauugugauauaacauugaccauuaaccauuucgguggccauuuuagccauuucaguauuucaguggcauuaaguacaauagcauuguucugcaaccauuacuaccuuccaucucaauagguuuuuauuuucuuaaaaugaaacucuguaccaguuaaacaauaaaucccuauuuuccccucuccccagcuccucguaacuaauauucuacuuugugucucuaugaauuugacuacucuagguacuucauauacaugagaucguacaguguuuguccuuuugugauuggcuuauuuaacuuagcauaguauguucaagguuauccauguuguaggaugugugauaauuucaugccuuucuuuuuuucuuuuucuuuuuuuuuuuuuuuugagacagagccuugcucucuugcccaggcuggagcgcaguggugcgaucucagcucacugcaaccucugccuccuagguucaagcaauucuucugucucagccuccugaguagcugggauuacaggugccugcuaccacgccuggcuaauuuuuauauuuuuaguagagauaggguuucaccauauuggucaggcuggucucgaacuccugaccucaggugauccauccaccucagucucccaaagugcugggauuauaggcacgacccaccgcccggccaacuuccugccuuucuuaaggcugaauaauacucauuuguaugcguagaccacauuuuguuugucuguuuaucuguggauggauacuugaauuacuucaucuuuuggcuauugugaauaaugcugcugugaacauggauguguaaauaucuguuuaacacccugcuuucaauucuuuuggguauguaccugaaguggaauugcuaaguuguauguuaauucuguuuuauuuuuugaggaacugccauauuguuuuucuuccaguuuuuguuguuguuguuguuuuuaaguucuagagaucgggucucguuauguugccuagguugauuuugaacuccugggucugccucagucuuccaaaauguugggauuacaggcaugagccaccuugcccuucccgaaacugccauauuguuuuccguaauagcugcaucaucuuacaugccccucaucaaugcacaaggguuccaguuucucuacauccuugccaacauuugcuauuaucuguuucuuuuuucuuuuucuaauagccauuauaaugagugugaaguacauccaugucuuuuuugagacagagucuugcuccgucgcccaggcuagagugcaguggcaccaucucagcucacugcaacuucugccguccggguucaagcgauucuccugccucagccccugaguagcugagauuacaggcgugcgccaccacgccuggcugauuuuuguauuuuuaauagagacgggguuucaccauguuggucaggcuggucuugaacuccugaucucaugaucugccugccucggccucccagagugcuggaauuacagaugugagccacugcacgcggcuuuuuuaaaauaaacuuuuugucauggaaauuucccaacauauaaagaaagaagggcaaauaaugaaaugaacuacccauauauccaucaccuagagucgauaauuaugaacacuuggccaaucuuguuucacuuagaguuugucucuccuuucccuauuguugcaaugcaggucacagucauauacuuucauuuauuguacuuuaauguacugugguacagguugaguauccauuaugcaaaaugcuugggaccagaaguguuuugguuuccuaguuuuuucugauuuuguaauauuugcauuauauuuaccaauugagcaucccaaaucugaaaaucuaaaauccaaaauacuccagugagcguuuccuccgaguuguguguuuggugcucagaaguuuucaguuuuagauuuaguuaacgacuauaaaacauacccauaaaaccauauuauauguaaaucagaugucuagucuguaucacccacaucuuuaugacccauuucuuuuaaucugaauguguaagaggcaaagaguuaacagacuacccaaagaugacaauuuauauuaguaaccaagauuuaguacuuuuaugaguuacaguuuuuguuaacuaugaguaagagcucugcuuucuuuaaaccauuaauacucuuuucuucuuccugauauuugguggcauuuguauuaucuaucauaagcaguaccauaggccacuuccuuuaguaaauaaggugagcuagcucuggguuaccuucuguuugaauuauauuuauguguccguuuguuuaagcucaccauuuuaagggccucuagaagauacaccuaaaggcagauuacaggaagaaauuuuaucuagccuucuaggguuucugauagaaggugcugguagagauauuuacauuuuguccuuguuggagguguggguaauuguacauuugcagcuaugcauuugacacugauuaacauuaaucucaguguaaaaauuuagaauccuuuuuacuguaacauacuuaacaggauuuagaaauccucuacuagcaaaaucaaguuguugcuaugugagcucuuuaaaaugggaucauuuggaauucuaagcuacagcagagccaaccaagggcugugagaaaaagagagagagagaggaauaaacaguuauuauuaacucuuuuccucccuuuaguuuucuuuucuuucuuucuuucuuuuuuuuuuuugagacaaagucuggcucuauugcccaggcuggagugcagugguaugaucucggcucgcugcagccuccgccuuccaggcacaaggauccucccaccucagccuccccaguagcggaacuacaggugugugucaccacaccuggcuaauuuuucauuuuuuauagagccgcaguuuagccaugucucccaggcuggucuugaacucaugagcucaagugauccacccaccucagccucccaaagugcuaggauuacaggugugagucuccgcaccuggccucuuucguuuuuuuuuuuuuuuuuuuuuuuuuuuuuuuuuuuugagacggagucgagucucacucuguugcccaggcuggaacgcaauggcgugaucuuggcucacugcaaccucugccuccuggguucaagcgauucuccugccucagccuccugaguauagcuaggauuauaggcacacgccacgacacccagcuaauuuuuuguguauuuuuaguagagaugggguuucaucauguuggucaggcuggucucgaacuccugacaucgugauccgccugccuuggccuuucaaagugcugggauuaccggcaugaaccacugcguccggccuccccuuuaguuuucuuaaugugcauagaagacaccaguguauaauaaccauaugaccuuguauaacauuagaaggaagucuuguucaagauacacagaaaagaauacucuaugauuuaugauuccauuaauuuucagguaugagaaugugagucugcugucaggcacaaauuaaaugaguuaaaaaggcagaguugaugcuuuccuuauggcucuuauuuacauuauuuuuuauuuauaugcuguuuuacuguuuaccgauuuuauuucauugaagauagcuuauauccuugcuugguaaaugaccucagucacuaagagcauagagccuucugaguauuaaacaguaacacuaaaauuauuucccuuucuccuuuaguuauugugauaguaguagugauaaugauagcaauuagguaauagugacccucaauguggcccuuaaaaugugccaggcaaaaacuaagugcuuuuuaguaguaacucauuuaauccccacaacaacccuaugagguagauauuauuauuuucauuuuacugaugagagauugaggcccagagagguuaguaacugacuucuucaacuacgaauaacuaguaagugguagagcuaggaaaugagcugaggcagccuggcgccagggucuuuccuccuaaccauuacacuguacuguacuuauuugacacccguguaaguaaagggaaacgugagauaaaaaugcuuuuaacaucuuugugggcucuacggaacuuauuauuuguucauucagugcucccuguagaaucagugauuacagagaacauuuaaucucaaaguauucaucccuauuuucaaacugguauuuucagaucuguucuuggagaccuugcauuuagaaaaaguacacuugaacuuuuuagucgaauuggcagaucaagagcucacagacaggauauugccuuugaguauuuagauuguccuugcugaccccugaagcaguaauuuugauagaucacaauguuuccacuagaguacagcaguauuagggguucugacuucaaaguguguauguguauguuuuauauguauuuuuguagacuccuucuccacaaauggaaccaaucuuacacaaauucugaaaaccuuuuagagcuauuuaaauccaagaaauaccuaagcauuuugaaguagaacuaugagcaaugaaugcaaauguuaccuuucuggagucuugugauaaguaaaacaaccugcccaauuuucagugcuuuaaaguucuggccaugcagaauucguuuuuacuaauucugggcauguauuuacauauccuucuuaccuuuaaaucugagcuaauagcuacuauuugauaagaaaaccaaugcuguauuuucuucuuucuuuguuuuggguuucguggaucuggcugugcuguuuguuagaauacaucuacccuggugcuuugggucagugaaguguuuggcaggagggagaaauagaucaaaauuucuauucauuaaguaugcaucuuuuauggaggugguugacuuucucauguuaauuuucuuuccccuaggucuaugaaggccuagacaucaucaccaacaagguuucugcccaagagcagagaaucugccggcaccacaugaucagcuuuguggauccucuugugaccaauuacacagugguggacuucagaaauagagcaacugcucugauauccuuaggaaaggcagcagcuggguuuggugggugaaagcagcccaagccaagagagaaguuuucuuucuaguggcaauuucuucucagaaggggcacccaaggccuaaauacugauggaugccauccccaucagacuauggacugaaagauacagugucuuugucacccaaauucuuguccuuagacuguggcaucaucauucucugggaacuuguuagaaaugcugauucuugggccccacuccagaccuacugaauuagaaucugcauuauaacgggaguccccagugauuuauauacacauuaaaauuugagaagcacuguuuuagugauaagaacaccaauuuaagaaucagaaaauuuguguuacaguccuagaacugccuuuuuuaccaugugaauuuuacuggguaaagcauuuccuuaaccccacugagcuucgguuuucuauccuuuaaauggagauacgaaguuaaucuauaaauauaauggaguuauaguuagaauuucaaagggguuguuagaugggagaggacuggaaaauauaguucuggguaaaaccaagaaauuuuugcaaaaagaauaauauaagggggauugcccuuaugucuuaacaugcagacugccuuuaguaucuggauugcuauauauuaaaagauugaaaagucauaauaauuauaauagcauggaacuuauuuaguacuagauauauuuguggcacagaauagaaaacccagauauagauucaaauggagguacgugaauuuuuuuuuuuuuuuuuuuuucuccuagagacagucucacucuguugccuagguuggagugcaguggcaccgucauggcucauugccaccuugaccuccugggcucaggugauccucccaccucagcguccuaaauaucugggacuacaggugcuuaccaccacacccagcugauuauuuucauuuuauuauuauuauuuuuugagacggagucuugcucugucacccaggcuagagugcaauagcgcgaucuuggcucacugcaaucuccgccucccagguuuaagugauuccccugccucauccuccugaguagcugggacuacaggcacaugccaccacaccuggcuaauuuuuuguaucuuugguagagacgggguuucaccauguuggccaggcuggucucgaacuccugaccucgugauccaccugccucggccuuccaaagugcugggauaacaggcaugagccaccaugcccggcuauuuuauuuuuuguagagauggauuuugcuauguugacaagcuggucuugaaccccugggcucaagugguccuacugccucggccucccaaagugcuggaauuacaagugugagccaccacgccuggccccaaucagccuucuugauucgacaggugaagguacuagauacugaggcccaaagaguagaaggguguuugcucaauaucacagucauuucauggcuugcacaaauaaguuaaaccuuuucccgugaaguauguccuaucccaucuucuuuccucuuuccacucucuccucuucuggaaucuuaacauuuuucccuuccccuuuucauuucuuugcucacuuucccuuuguuaaucauacuacagguugaacaucugaaaaucuaaaauccaaaauacuccaaaaucugaaacuuuuggagugcugagaugaugcucaaaggaaaugcucauuggagcauuucaguuuucagauuuucagguuugggaugcucaaccaguaaguauaaugcaaauaauucaaaaucugaaacauuuccuuggucccaaguauuuuggauaagggauauuuaacuuguguauaauugacauuuuaucuuacuguggaaauuguaugcucccuauacuuaauuuaaagggggaaauagagaauuuguuuucucuuuuuaaagcaaacaguguuuuuucuuuaugauccuugauugguaacaucuuucuucccacccugccuuagccgcuuaaggguuagugggauucuaguagaaaagagguggucugucucuaugccugcagauuggcuggcaaggagaaauguguaaaugauuauuuaccuggauauugaaagucuuuuaaaaaaaguuauuuucggccaggcacgauggcuaucgccuguaaccucagcacuuugggaugcugcaguggauggauugcuugagcucaggaguucaagaucagccugggcaaguaacaucgugaaaccuuaccucuacaaaaaauacaaaaauuagccagaugugguggcaugugcuuguagucccagcuacuugguggcgggagcugaggugggaggaugacucgagcccugggagguugaggcugcagugaacuguuuucgcgccacuacacuccagucuuggugacagagugagacccugucucaaaaaaaaaaauuauucucaggagcaaaggccgccuuaaagcagauaauuaucuguucaacggagauucuaaagagaaaaauuuaaaguagcagagaugaaaaaacaauaguggcuauaguaaauugagugcuuacuauuuuuuaggcauugugauaggggauuucuaugaauugucacauuuaaggcucauggggauuuuuacaggugagaaaacugaaacucagacaggcugaguaauuguccaagagcugaaccuggaaauugaagucuauuuaucuucagaaccugugcaucucacuuaauuuggucaagccucaaguggcaaaaugugauagucucuccaugaugguagagacugacuaagucuaagaaccuuagagaaaccagcuuguguuuugccuuagaaggcaaagucaugcaauggaugucaccuugauggccuccugagcagcugacacuugguucugugagaguccuugggcuugugcuuauugaacugauuuggaauacuaauaaaacuuugacuuuuagcagcaagaccuagaaaguucuagaacuggaaggaauuaccacuaugcauuugucucugguuucugcaagucccuccagaacugauuggacaugauucuggaaauuuguuggaaacacugagggcugguaucaacgcauuuugguucccacccuuucuccucugcucugcagauaaaugaaugugguuucuugcuaaugguguccuuccaaagugagucaggauucucuugauaucgugauaucuuucuuaauguucacauugaagauauauuugcccgagacaaaauuccuauuguugugggaggaaccaauuauuacauugaaucucugcucuggaaaguucuugucaauaccaagguaaguuuaguucacucguaacucacugaggaaauggauugcucuuucuugcugucuaauuucagugggagaaagguugacucuugccuauuucuuauacccagcaacuauaauuuuccuacuuaauauucucaagcaaaugccaccuccaugugugaaguguguuccuccaggcuggucuaugggaaggggcucugugugggaaaaauguugcuguguggauuaauuagcaucuccauauaaauuaacaguucauuaggccaggcgugguggcucacaccuguaaucccagcacuuugggaggccaagguggguggcucaccugaggucaggaguucgagaccagccuggccaacauggugaaaccccaucucuacuaaaccccgucucuacuaaaaauacaaaaauuagccaggcaugguggcacgcaccuguaaucccagcuacuagggaggcugaggugggaggaucacuugaggcuugaggcggagguugcagugagcugagauugcgccacuguacuccagccugggcaacagagcgagacccugucucaaaaaaaaaaacagaugcgauucaagaaaaaaauauguauaauucuuuagaaaaauuauauuaaaaaaaacccaguacguuagccauuagccugauucaguauuuccuggcuggcagcacaguauguauauuagggagauguccaacacugaccuuauuuacguaggugcuacuauguaggguaagacuguguaaacuguaauucacuggcaauccuggucuccuuguucacccuugcugagaagacuagacuccuggauaugcuaaaauagacauauuagcccugguaccuguuugaacuucugacagggaagcaaauagccagguguuucccuaugcuguaagucuucugucuuuuuuguuugcuguggccucauagcacuuaccacagcauauuggaauuuucuguuuaugaucucucacuauauggcaagaucuucugauuauucuguauuccugacaguuagcaaagugccuggcacauacacugucucaguguugguugaauuaaauauacuucuaaaccaucauuuaauagccccaggagaugggcacugagaaagugauugaccgaaaaguggagcuugaaaaggaggauggucuuguacuucacaaacgccuaagccagguggacccagaaauggcugccaagcugcauccacaugacaaacgcaaaguggccagguaagaaagccuggcgcgcugaccccaaauuccuuuacaacuagagagcagucaguucuucaguuugcccagaugaugagagagauuugguaauagcaguuaguggagauugauguguuguucuagcucagcagguugggaggcccugaguuauugcuucaguucaacucccucaauaaauaauugcagccuacuuuguuacauuuuaaaugcauaguacaauaucguuuuccccuagggccuauauaauguugcuucauuuucuauuugaucuuugcuuguauaacaguuuucauauacauuuuuucuggcaugcaguuuguuuacauugugauuuggguuucauaacugauuaugcaaugccguguucugccccagcagcuuucccagugggagguggauuuuauuaacugucucacagaucagcucaccuuugcacauggaaacuaucugguagggaagagagguagugaaugaacucacaaggucauguuuuuuuagguuguuuuggaauugcagccucauguuagguuuauuuuucugcaguauuaggagugauaccacuuccagcauaguagaacaucuaaugaaggaccuguucuauugaugguuauacagauuaaauauuaaaguaacaucucauauucauagggguugugaaguauuccacucaaaugaauuugauauuuuuccuccuaauuuuaccccccucagugaaacuuaauguuagaauauaggauuuaaaacauucauuauuauuauuacuuuuuuuuuuuuuuuuuaagagauagagucuuacuuuguugcccaggcuggaguacaguggcacaaucauggcucacugcagccuugaccuccugggcucagauguccuccugccucggccuccugaguagcugggacuacgggugugcacuacuauaccuggcuaguuuuuuaaauuuuuaauuuuuuuuagagauguuuugcuguguugcccaggcugguuccaaacuccuaggcucaagcgauccuccugccucagccuaccgaagugcugggauuauagucaugagccacaguacucagccaagaaaaggauuucuucagguaggguuguccuuugcacggcagggggguggggcacaaauuguaauaucuaaguuuuuucacccccuuaaaggcaauguauaaccucauuaagaaugcauguuuuagauuaaugaaguuuauacuuuucaguauccaaacauuuuaaacacuuuaauagaaaacauucaauuuuuuuuaaaccuaggaacauuaugauaaacauucauuuuuauauuguuuuauuacaugauucuagagcuugguguuuauucucuccuuuuacuaaucaguucuuucuuaucacuucucauuuugcugcgucuaaacgaguaaugaguuugagaauuuuuucuuaguaagagucaauagguucuaagcaagagcucuagagucucauuuagagaaugaggacuuucuuuuuuuuuaaucuuucuuuuggcuugaggcuguauuuuaacuccagauaagugagauaucuauuacuacauuuuuucucauagaucuucuuugagaaaccagugauacugaaagacaagggggucuacacucuugcguuaggguuucaggaaguagaauugggucaggaagagaaagaucacuuucaggcugauaaguugcaaucacccagagugguagaguguagauuugggaguuaaauuaccuagugcugcauaacauaauagauacggacagaaguggaugguggcuuaagaauaaguaugugaguucuuuucucagugaucuuugugccaguagagcacuggauuagccaggagcauucuucauuaauuugacauauuuaaaaagaaagcugaugagcuggauguacaacaugcuuuuguacugugggaaaggcacgccagccagaccagacuuguuggcuuguuacaaagugucccaaacaagcucuuuuacuguuuaucugaaagugagugaguaccauucuguuuguguagaagaaaccuguuguuucugaaccuauuuaacugauuucagaauaauuuauauaucuuuagaaaaauaauauuauuucuuacuuuaccuaaaguuuucuuuaguacccuuuucugaguagcuguaggacuggaguaacccuagaccuucaugucuuuuggaacuuaaugcagugaaaaugagaauaagccuuucugcaugcccccuuuuugaagagacagggucuguugcugcuuagguuggucuugaacuccugagcucaagcaguccucccaguuuggccuccugaguagcugggacuacagaugugcacacugucgugacuggcuuucaagaaagaggcuuucuguaauaaacagccuuucuccuuguuuuacuugagaaugaauauuuucuauugguuuuuaugggugugcccccucccuccccuuuuaaauuacuuaggagcuugcaaguuuuugaagaaacaggaaucucucauagugaauuucuccaucgucaacauacggaagaagguggugguccccuuggagguccucugaaguucucuaacccuugcauccuuuggcuucaugcugaccaggcagguaacagcccuuugaugcccuagaguccaucugugauggaacuuggaguaauaaguuacuguauagaaaaugcugagaaccauggguggcucauaauaaacacuaaacaaguauuagcuauuaauuuuauuaucauuaucauuauuuguuggcuuaggcacagugccauuccccuagauaucuguuuggaaagggagaaaggauagcccuggcauuaggagaagacaucacagguagagugggaugggauggacggaaugggaaagagacugccauccagggaagguccaaaggagaaaaagaaggcagucucuuguggaagguuggcuggaggcuagaauguucuagaagcaguaugccuuauaauuagcuugcuagccugaugguauuuuguugcuaaaguauaauuauguccgugauaguaguaacuuauucauccagcaaacauucaguaagcauucaaugaagugcuggguauucugugugguacuucgguuucagaguugaagagacagugccuuuccuuaaggaauucccagucuagugggacaacagacaaggagauagauacuaucugucugucuauuauuuaugugauaaaugcugggcuagauauauuuucagagugcuguagggccacagagaagggaugacgaauauuaucuuggggggagucagagaccaguuugcaaagguagccuaugauaggccuggaaagaugacaucauuauguggacaaacaguagaguguagcacugaagagcacaggcucuugaggcagacugucuaauagcaaauuccugcuccacuagcuucuaguuaugugaauuguuaagacaaauuaguuuaccuuucuguuucccaauucuccuguaaaauagagauaauaguaauaacacauauuuccuagcuucaucaaggauuagaugaauuaauacauauauagugcucagaaugugccugacacaugacggguccucaauaaaugcaaacuuucuaggaagguuacuguugcuguaggccaauaaaucacaaugauagagauguagaagaacauaauuaaaauggugacaaucuguuguuaaauuaaucugccauaaauugauaaaaaagguaauuuuucaauaaugaaauuuuauaaacaaaaacuuuuacucuacaggcagcauaaaauaaugguaucugauucauaguaaagcuguuugucacaucugaacaauuacgaccucucacucuuugcuccuuugcuuggcucaguaguuuagaauguaucuaggaugucuuuuuuuuuuguuugagacagagucucgcccuguugcccaggcuggaaugcaguggugcgaucucggcucacugcaaccucugccucccggguucaagcgauucuccugccccagccucccaaguagcugggauuacaggcgcgcgccacuacgcccagcuaauuuuuguacuuuugguagagacagauuucacuguguuggucaggcuggucucgaacucuugaccucgugauccacccaccucggccucccaaagugcugggauuacaggcgugagccaccuugcccggccguaucuaggaugucuuuggauuaaaguuccauguucuuauccaaggugucaucuagggguucuuaaacauaaaguaacacuaaguugcaguauaaugacauauuaaauuaaaaauaagaaagguaaaccaggggauccucagccaccucuaaaacacauuccauaugagaauaaaauauuuguccuucacaguugcuguaauuguaugcuuucucuauauaaugaggaggcaugugcuucauucugacuaugcuucauuuuuauuuggaguugcaaagucuuaaaugugaguaacguaugaauuauuauaauaaucuuuggaaucugaauucuuucuuccguuuggacaaauucucuuuuuuugugaccaccuguucacucgucauguaaguauauaguagguaccuacaacuugcuugcugguugaugggcuaauuugauucaaguucuagaugagcgcuuggauaagaggguggaugacaugcuugcugcugggcucuuggaggaacuaagagauuuucacagacgcuauaaucagaagaauguuucggaaaauaggugaggauuuggcuguuauucugaccuacuguccauauuuugcagacaaucaaaagaccauaacgcuaauacuggcuuugggucuacuuguuuaucagccuucuuugcagaugcaguuuuuuaaucuuucagacagucccaggaguuaacuuuucaagaaaguaaccugguggguaggggaggggaaaauuucagagaaucaguaacugcucaggaucucaauuuccuuaucugacagaugaaauggcucaacuagguccaucuccaaagccccugcuagcuuuuaggagcaauggcuuaucugcugauacccuccuguucccagccaggacuaucaacaugguaucuuccaaucaauuggcuucaaggaauuucacgaguaccugaucacugagggaaaaugcacacuggagacuaguaaccagcuucuaaagaaaggugugaauucuuccaucuaaucuagucuuggacaucuuuggguggcaggguacucugcugguauggucugagaaagagccaaggcuuaaagcgucccaaauagccuucagcucagaacugagauuuuuguccaccaagucugacauugcacugccguggcugacuuuuuccugcugggcugggagggccugccucucugcaggguaaggagugcuuaccuagauguucuuaaaucuacuguaucuuucagguauugaggcucugaaacaaguaacuaagagauaugcccggaaacaaaaccgauggguuaaaaaccguuuuuugagcaguaagucucauguuuuucuuuauccuaugggucuguuuucaauagaauauagauguccucagcucacccagaaaaugaauuuuagauucugggccuguucuaagauuuuggaucugaccuaagggaaguucuauaacauaaaugauuauccagggauauuuucuugggaugucacaaaaaaaaaaaaaauuauuugcauugaggagucugccuucugccuugaacagauggauacuggcugcaaacagcuaagaagaacagcagcaucuuuuuuggagaguugguguucagggcugauuuuuagcuucaguuuuguaccugaagagcagucagauuucuguagggaagauuuccuaauuacaguguuuuuggggggccagaugaguuguauaaaaagacaccuucaccauuucucccagcgucuccacauggugcuucagauugcuucaaaugaaacuuuaguugaacagcauuuuugagggaaaagaaaggaaauucucauugauuuggcccuguacugugucuuuggcacuaaauuugguguuauacauauauuauugagucuucaagguagguguuauucuuuuauuuuuacagauaagaaaaugaaggccuagugaaguuaaauaacuugccaaaaaucacccagcuagucggcaguagauaacugaaugcaggccugacacagaguccacacuccuuuauacuacucuuacuuccuuuagcuguaacuuuagcaagacagcauuaguauuggaccauggguaaaaacuaugugguuaugagcuaaaggagauuaauuuaagcauaagugaaacuucaguuuuaucuuguggacauguuuuaaauaugcuucugaaucaucuuguguuuaccuuuugcugguagacuucugcucucaauuacagacagggccagcugaagccucugccccacucggugccucugaaaauacauaccuugaucccugcuguugaccacuaaacugcuaacauucuuucucccagcucccacucucugccugagcucuccaguggaguucuggugugaagaggcuuguugugcuuuccucuacuuauccuguuuucucugcauguccugguagauagaagucuuagugucaucugaaguugaagcucagugcuguauuacaaauuucuaaugcagcuucucuuauccccaugucugacaauaagccuuuaacagaagacuuuuggguaauaauuuagaacuucuuccuguaguaaaaccacaauaauuccuccaucucugugguaggaggaguugauggcacagugugucauaugccuguuccucauucguguguaugccggcaucguccuggugcuggagugaaaggcacagcugcccuguaaaucaggagcugugcgugauuggccagggcuggucugcugggauaugguucuggcaggaagccagggggacuuccccaccccagcauggccuuggacccaagccagaaauagcagcugggagccgagaacuuguugaaaggugcuuagacagggcacagaagcccaacaaagggcuuagaggagaaaggaaaauguagaguggccuggaaacaggugcagagcuuagccaaggccaggugugcuguggaugcugccugcacccuccuagucucaccuuuccugugguagcaggugcagcccaguccaguuuaugaagaaucuuauuugggguuggcacaaucaaaaggccagcaccugccagucguuggcauccgaaggccuuugauguuuuugcccaugggcgaugcuccuuugccuuuaggcaacugacuuaaccuaguuguggaaggcaguuuaguguguauauaggcagggaagcuaaccacagagacuaaacucuugcaacaugguuggcucaggugggugaaauaccuguagcugcacucuuugcuaccuucagucucaucuucauucaaaagugucugccagggaguguuucuugaauacccucuagaucagguuuuuaaaagaaguugcucaacuacaucaauucuaagacuucuuucugguucgcagauucugcggcuuauugguugauaugauucuguucccagcccaugcuuucagagcauuucaugagucccaggccgcugagggaauauaugcaaacccgagacuaguaucugcuccuaaagaaagcugugaauucucuugccacagaucgccaucauuguaagaugauauggaacuuagaauaggcacuuacuuaaagcuguuaguuuauuucuucuuacgaugugcugucuuuguguuguagcucacacaauggucacuugagcuguuaacucuauucugguuuucuggcugaucuggaagauccugcacccauguauccagauuauguagcuagucuuacuagcugcagagcaguuaaaccucuaggucuuucuuggauugugguucauguuuaguuagaauuaacagcauggucagaauguuuacuccuuuggcucuguguauuucccuggaggauuucagaguccuggcugcagaauagauuggguuugaggcugaccucucacaaccuuucuuugucaucauuaggaccuggucccauuguccccccugucuauggcuuagagguaucugaugucucgaagugggaagagucuguucuugaaccugcucuugaaaucgugcaaaguuucauccagguaauuaugaaucaugauacauucuauuuucugguuuucagagcacuuucauuagcugacaccuuuguugcuauauugaagaaccaggccuucuuuuccauagaauaaagcagaagggcuggcugcuuuuuaauaccuggagacugcuuuucuacuuuuacauucagaaagguuguugcuaaaaucuguauacagcccaucugcucucuggguugagaaaaaggaauuuuaggaaaaucccauuucccuuaauagagaauuauauccagaucucuuugaauugaauacucccuuccacccuuguucuuuuagggccacaagccuacagccacuccaauaaagaugccauacaaugaagcugagaacaagagaaguuaucaccugugugaccucugugaucgaaucaucauuggggaucgcgaaugggcagguagaguauggggaggggcaugaagaaaucuauaaggguggguucacauugacuucaugaaauuuagagucuuuggcagauugaaccuggagucuauuuauuuguaaagggacagcuagauuccucuaagagccugugcucaaauuccuuggaggcuucugggaauuugucucuguauucugagauucagaggaagaucagaugcucuccaucuucagcuggaauuaauauuuuauacuaagagaucugcaguuaacuuucuagagcuccuuugacuuugugguccuggcuuggaggaguuucuuggccuuucauguuuauaauucagugggggugggaucaggaaguaaggguguaagggaagccaggcagcucauccaggagacuggaagaagcagaagcauagcugggagggggcaggaaguagaguuacuacuccugagugugguuuuuaaaagugguaucucuucaguaacuuuugagguaauuguuggcauagugguaguugcuaaaacugugauaaaaagaaguuaagagaaacugugugaaaguaagccugucacacauguauaaagaagguuaguuccccaccaccucagggccagccccacccuaaggcucuaucccugcauuagagccuggaucugccucugccacagagucacacugcacacacaucauuggauuuucagauuucuguagucauccagucaaagcccaggacuucuuccccaagccuugaguuuacaugguauuuagaaauagguguaagguuugcugcuuucaggcacaguggggcuugucguuuacucagcagcugggauccuucuguucagaguacuguuuugcaugggauucucagagaaguagauuuuucuccccaaagcaaccaauaggaugauuaggucuauuaacugguaacuggcaaaaugaacuccauugucagagacuggggacggcugugauugcccaaccagcagaagaagccucgauugucauugguuuauaaugaugaaaggggaagagaaagagagugucugauuguuuuuuucuaaaggaaacuuagugguucgauuuguugaauguucuucagggauagccuuagagaagcaacaugugugagccuuugugagcuuagcuuguguaagcccuucuguagugccaucugucaaguccuuacucccaucuccugcugccauggagagccagcccagaagcccguuuuuugccuuaggcucuagcuggaaaacaaagcugacuucuuccccaaguaaacuuuucucuuaauucuaaccucuaccuuacuuauucuugcuucuaaacucuuaaaaaugauguuuuuaauauguauaaaagagaauuuaaacuaguuguccaucucuuucaguguucccagaugagauuuccuugaaaaaagaacaggauagugaaaauaaaucuguaugaguuagucagaaggugggaacugucuuaggggugacaggucagcaguugauagcaggcaacaguggcccuaaagcuugacuuccuucuuggacccucagaagagaucgucggugauaaaugcaccuuccugucucccuggagcagugugugccuagagaauaggaaucuugccagagagucguucacaugaccuuuuugacccaggcacagggaugccagaccaggaaggacaacaggcaaugcccugcaauacagaugaggauuugaauuucuaacuuuucaaccuuacaaguuaaaaaugcaucuauaacaggaagccccauacuacagagaccugauucuggaaagugggaucucuuuuuggagcuauaggucuaaguagaagaguuuaccugcugugugaccuuggacauuuuguaagaccucucugaacuucaguuucccuuguauaaaaugagcagaauaguaccaucuuacaagacugccaugaggauuggugauguaaaguaccuaacagggagcacuugauaugugguagcucacucuauuuugcuagcuggcuggccauauaauuuauucuucccuuaaaaaugcuaagcagcuauacuaguacauguguugaucuugcuguuuauuguugaagaaaagcauuguauaguuaauuuuacuugcuucuaggauuaauucuagaaaauuccuaaugaguuuuuuuguuuguuugguuugauuuugucuuaucagcgcacauaaaauccaaaucccacuugaaccaacugaagaaaagaagaagauuggacucagaugcugucaacaccauagaaagucagaguguuuccccagaccauaacaaagaaccuaaagagaagggauccccagggcagaaugaucaagagcugaaaugcagcguuuaagagacauguccaguggccuuuggaaaggugguggggauccaguucaggagggagggguauguuugucucccagucugggcaaaggagugcuaugcggaauucucugcauagcagaaaagcucccaccauuuucuuuugaugugguuuuaaagucucacguucucuauaauagaaacagcaggucuugucagcuccuuguguggcugaugugucuggaaaugauguaguucaggaaagcauuuuuuuuuucuuugaaccuuaaagguucuauuauuaaaagcagcacagauuccacauuuuuauacaugaggaucuucuuuguggugaauaccaggauugacugcaucccuuuaaagaaguuuuaugucccugacucuggcuaaaauuaucuaauuuccagaugcuuuuguagaugacugaaguauuugugagccacauauugggaguucuagauuugagugaauggcaggaaagggccaucuccauugagaugauuaagugaaccaaacuaguucucagaauucuacagagaaggagggaaucagacugaggaagcugugacauaggacuugaagaccaaagacuuugaaauuugcgagcugcucaugugugaguuauuaucacugcugucuuucuauugaguuacaaaucuauauuuuuauugaaguuuaaauaaagaaaaaauuuacaagagccucuuugauccuuaa

SEQ ID NO: 191409 - RNA, 8951 nt, Homo sapiens
gagacugugggcgcguggugcagucccuggaggguucucacgcuuuggcugucuggacuuuuaaguuuuuccgcuuuuucaggaaggcgaccggcagccucgggcaggggagacaggacuguaugucagagaagagacggcgcuuggacgccaggaauccucugaagcaggagacugcccuauccagguuacccuucccgaggggaaaccagggucuccuucagaaagcugaggcaggccgggcgcgguggcucacgccuguaaucccagcacuuuggaagaccgaggcgggcggaucaccugaggucaggaaccccgucuacuaaaaauacaaaaauuagccaggcguguuggcgggcaccuguauucccagcuacucgggaggcugaggcaggagaauugcuugaacccgggaugcggagguugcagugagccgagauagcgccacugcacuccagccugggcgacagugagacuccgucucgaaaaaaaaacaaaaaaaaaacccugcuucuggaggugagacaacuccugucugaacacgauaacagagaugacgcccacccucgacccagugccuccccgacugacuuggcaccccaacgugguuauuuucuguuuuuaucuuuuucagcagaagaugacucaagaccggccucugcuugccgugcaggaggcgcugaagaagugcuuccccgugguggaggagcagcagggccuguggcagagugcccugcgggacugccagccccuccuguccucccucagcaaccuggcggaacagcugcaggccgcacagaaccugcgguuugaggaugugccggcgcuucgggccuucccagauuuaaaagagcggcugaggcguaagcagcugguggcuggugacaucguccuggacaagcuaggggaaaggcuguaagcagcucccuagugcuguuucuugguggaaggauuuuaaaacgagguguuuuauauguagcuagugucaguccagaagguguuuuucuccuugaaagcguggcauguggagguaucucaaccuuccuuacuucaucuggggcagugggaccucggucagaaagccauuuucuggcauuuucuuugucagagacuaggcauggcaguggugggcuuaguagaagucacaaaagaagaagagaaaaggagcggagaaagccuauuagcucugcccuauaguuuucuuugguaaaaggcagugaggagcuguguaaacuuaguaggugcuagagcuaagggguuuauguauauuacguuauaaagucucuucaacauaucugugacuuaacugcacuuaauucuaugcagguaggaaacugaagcuuaagcagauugcccauggugacgcagcuagaaaaggguagagcugggauucuaacucaagugugccugacacaaaggcuagagcucuuaaucaccacuuuguucugcuguagauuggugucucugugcccaggaguagcacgucuccaaguucugauaugcuuguugucagacccagugccugcguuacagauuuuuuuuuuuuuuuuuuuuugagacagggucuugcucugucacucaggcuggagugcaguggcacaaucacagcucauuguagccucgauuucccugguucaagcgauccucccaccucagccccccaaguaccugggacaacaagcgugcacuuccaugcccagcuaauuuuaaaauuuuuuguagagauagggucucacuauguugcccaggcugagaguuacagguuauugaggacagaggggagacagggcauguguggccuuuccuugaacuggaacaaaagaaaguuccaguauauagagucugucauagacuaauaggaaacugucacagaugaggacuuuccuuuuauuuauuuguacaaaauacguucauuaggcaccuugugggaugccaagcacaaggugccaagaauauaaaaaugaaccagauuuaguuccuguucuuaguugaguagaagaaauaaacaaucagugaauuaaauugugggauguccuaagauauugauaaguacggcuuguguggaguggggaaguuucuggggaggaagugauauuaaaaaccuaaugguugaaaagauguaaacagagucaagacguggguaugaguagugugcauagagaauaguaugacuggcccggcacgguggcuuauggcuguaaucccagcacuuugggaggcagaucacuugaggucaggaguucgagaccagccuggccaacauggugaaacaccaucucuacuaaaaauaaaaaaaguuaacuggcugucguggcacacaccuguagucccagcuaaaggggaggcugaggcaggagaaucucuuggaccugggaggcagagguugcagugagccaagacugucccacugcacuccagccugggugacagagcaagacucugucucaaaaaaagagagaaaaguaugacaggagcagaggccugguaagagaugagaucagcuggguauggcagcucagccuguaaucccagcacuuagggaggcugaggcaggaggaucgcuugagccuagaaguuugagaccagccugggcaacauagugagaucccauucuccaugaaaaggaaagcaaaacaaaaaaaagaugaggccagguacggugccucacuccuguaaucccagcacuuugagaggcuaaggacaagaggaucauuugaacccaggagugcugugaguaccuaugagugcuuuacuuaauauuuugucuuuuauuuauuuuuauuuuauuuuuagagacagucucacccuguugcccaggcugaagugcagcgguaugaucauagcuuacuguagccucuaacuccuccugccagccuccugaguagcugggauuccaagagcaugccaccauaccuagcuaauuuuuaaaauuuuuuguggagauagucuugccauauugcccaggcuggucucaaauuccuggcuucaagcuguccucuggccuugcccucccaaacuacugggauuacaggcaugccacugcaccuguuuuuuuuuuuaaauguuuuaauuaaaaaaaaauauauauuagcugggcacgguggcucaugccuguaauccuaacacuuugggaggccgagguagguggaucaccugaggucgggaguucgagaccagccugaccaacauggagaaaccccgucucuacugaaaaaaaaauacaaaauuagccgggugugguggcgcaugccuguaaucccagcuacucaggaggcugaggcaggagaaucacuugaacccgggagccagagguuguggugagccaagaucgcaccauugcacuccagccugggcgacaagaacgaaacuccaucucaauaaaaaaacaaaaaacaaaaacaaaaacuauacacacacacacacacacacacacacacacacacacacacacacacacacacuuuugagacggagucucgcucugucacccagguugaagugcagugacgcgaacuuggcucacugcaaccucugccucuggguucaagugauucucgugccucccgaguagcugggucuacaggugugcaccaccacaccuggcuaauuuuuguauauuuaguagagacgggguuuugggacauuggcuggucucaaacuccugaccucaggugauccaccccgcucagccucccaaagcugggauuacaggcaacagccucugcacccagccccuuucuugauucuugagccacccguaccuccaagacacugucacuaaucuccuuagaccaguggucucaauuggagaugguuuuucuaugaggggacauuuggcaucaucuagaggcauuauugguuguuauggcuuauggaggguauagguauaguuuacaccugucauuuaguggguaggggccaggcaugcuccuacacguccuacaauguacagggcagcccuucacaacagagaaucauguaguccaaaauaucaguagugccaaaauugagaaaccuuccuuuauacaugucucaugauauugccuaaugucagacucuuucuugcagagccauccuccucaaggugcgagacauggucagcagccauguggagcgaguguuucagaucuaugagcaacacgcagacacaguuggcauugaugcuguccugcagccuucagcagugagccccucuguggcugacauguuggaaugguugcaggauauugagagacauuaucgaaagucguauccuuugcacacauuucaggucacagccagagcuguucuaagucuuucaaauuucaguuuucacaagauuggaaaacuaaguaguuugagucaguucucuuugguuccugaacuuggauucuuccugcauuccuuuguauaauccuuccucuaauaauuuaucgaguagcuacuaccugucaggcacuguucuuggugcaaagagacaggcauugaaaaaggcaaguagaaugcugaauggcgauaaguguuauggagaaaaauaaagcagggaaagugaggagugaggguggaguugugauuuaaaauaggguggucagagcaggcuucaugagaaagugauauuugagcagagaucugaagaggguaagggaaagagcuauguggcuauuuggggagagaaaguuacuaggcagaggaaacaucaaaugcaaaggccuugugguaagaacauuccuggucuauucaggaaauaguaaggaggcuagacuggagcaugaggaggagccuaacagcaggugaggguagaaagacagggggcucgacuuucuagggccuugaaggucuuugaaagaauuuggggucugggcgugguggcucacaccuguaaucccagcccuuugggaagcugaggugggaggacugcuugagcccgagaguuugagaccagccugggcaacauggugaaacgccgucucuacaaaaaauacaaaaauuagccaggcauggugguaugugccugaagucuguaaucccagcuacucgggagggugaagcuggaggauugcuugaacugggggaggucaaggcugcagugagcugagaucgugccacugcacuccagccugggugauaaagugaaacucugucuccaaaaaaaaaaaaaagaauuuugggccaggcaugauggugugcagcuauagucccagcuacucaggaggcugaggugggaggguugcuugagcgugggaggucaaggcugcagugagccuugauugccagccugggugugaucaccagccuaggugacagagcaagacccugucucaaaccaccccccgcccaccccccccccccaaaaaaaagcauucgagugacagaaaaaccucuuagaaacuugauuaaggaguaacaggauaagaccuauguuuuuaacaguaucauucuggcuucguucuaggguaagauuugggguagugggggcaaggguaaaagcagaaagaccaguuaguugaagcucuaacauuuuucucucaaaaaaauuuuuuuuuugccuaggagauggggucuugcuguguugaccaggcuggucuugaacuccuggccuugaugauccuaccuccuuggcuucccaaagugcuaagaguaccggugugagccaccaugccuggucuucucucaauucuugucugacaccugauuuuagccucuagcuuagguuucugccuucaugugaauaauucccaaaccccaacuuuucuugucucuggucuugacuuuugguuuccugcagaugccuccaacuggauuguucuuagaacugcaaacucaaguuuaaaauugaacuccucaaucuagcccucaaauucagcccccuuuuccuugagucguagaacccacccuguuuucucuuuuauuuauuuauuuuuugagacagaguuuugcucuuguugcccagacuggggugcaauggcacgaucuuggcucacugcaaccuccaccucccgaguucaagcaauucuccugccucagccucccaaguagcugagauuacagacaccugccaccacgccuggcuaauuuuuguacuuuuaguagagaggcgguuucaccauguuggcuaggcugaucugaaacuccugaccucaggccucccaaagugcugagauuacaggcucgagccaccgcgcccggcuuauuuucccuuuuaaaugcauugguagcaguaguaguaacagcaacaggagcaugggcagaaggagcaagagcugcggcugacauuacuaagcacuugcuaugugcuagaauguuuacacagucacuugucaaguccuuuccuucuguuucccuggugcuucuuugauuuucccucucuguccccauccccucuguugcuuacauggcuucuuagcucucacuuggacucuuaauugccucuugacaguuuucucugucuaguuucuuuccuucuaagcugacuccaaugaaugaccucuauaucugcaggaagucugguucugauccugauaguuaggaucagaauuguucuguacuguauaggaauagcuccuguugcuaaugggauaaaguucagagcccugcguugguacuugguguucuuucuguucuggcucagcccaccuuucagccuuucugacugcucuccauguggcguccaugcugagcagacuggaagauuugcuuucccugaauucauucuaugcaucuccaccucugugccuuuguucauguuuccuaccagcuggggugucccugcuuccucugaauuggauguauuuauccucugaaccuccgcuagcuuuaccucucaugucccuuuuguucuuucuuuucaggaucugauuuuguccucaccaugcugagaucccagauuucagggaugguuucauuccucuuucccuguagcacaaagccauguuaguaaacaguugcucaggaaauauuuguagcauaggugaaucaggcccaccugguaaaauguaaggauaucugcacuuucacuuuuauggcucccucugguucucaccaggguguuuuuuuucacuucagcauacugcauuuucuuuugagcaguccuuaacuuccagaaagguaccugaagagaaaguaucuucuuucgucuauccaguggggagacuuggcaaacauacaagcuuugcccaaggccugggaccgaauuucaaaagacgaacaccaagaucuuguacaagguacugguuuguguucuuccuuugugucuccucuccuccuuucucucccuguggcucgccucuuuggaagcauuaggaaggugcccuugcugugccucuguguguuuuauguucucgggagaggugauaaugccauuuuuucugucuuccuauuucagauauccuauugaauguuuccuucuuccuggaagaguaaggaagcuaugcguaucuggagaccacggguaccacaguugaagacugacauucugaacccugauguuucuaaagaaacgucaguauuucagucugacauauuugaaacaucagugccuugaaccuuaggacugggucuuggggaggauuagcgccuagaugucugauuuuggagcugcagcaugccaggccguggcugagaguaugugagccaugccuugcccuuuucugaggcucagggaaguggauggagcuagagagacaacaggaaagacggugcugaagaacauagugucuuuccucuauuguggaccuaaagagguggggaagcaaggacaagaggcaaagagccacacugcccuuggcaucauccaaagcauugucugguugacaccagguccugguuuugugucuuuugucaauaccugaauccuugacaaaagaaaaagugguuuugaugauuuaaagaaauaagggugauuuugacagaaaauauauuuuaaaaauuuugaccaauugcaauaguuauccucaagccaauuuccagaaccugccaccagggggagguggugcagcaugaaucauucugaaugcuuugucuuugaaguguuccccuauugcuguuaccaucucagaggaaguaacugggcauggugagacuccuaaaaugacaggaguuuuuuuggccaaagcuggcaucugacuugccacauuccucugagucuggaguagccgcaggggugggagaaugccagcccagagucaguccaucgggguuacauuuccaaggucugcugccuucaucuauguaauggccguguuacuuucagaucuuucagcuucccagaguguugugggaaucuuggucauugaauguaaagggacuuaguaaaggguauagauauuuuucaaaaaugaaaauaacuuuuuuucuuauaagugauaagcuuuuauaaagaucauaggaaaacuagaaaaaauguaaaauguagaaaauuguaaaacaaacuucauuagagauauuuugauagauaccuuuucagugucuauuuacaaauuuuuucuuuuaauauagauagggucucacuauauugcccagcucacuccugagcucaagggauccucccaccauagccucccaaaauauuggaaauacaggcaugagccacugcuccugaccaauucacaaauuuuuuuaaagaacaaacgugcuaucaucgauacauacuguuagguugucuuuuuuuaaaaaaccuaauguaauuuguucaucuuuuuauaucuguaaauauagcucaacacaguuauauucuuuuugugaauguauuauaucuacaauuuaccuuuuuucuuagauuuuacaugcauuuucccaaaucuuuguguuugccuaucuguaaagguaauacauucugauuacaaaaaaugaaaauguuacauagaaauguaccguuauccaucuaccagauaacuauuauuaauaauguguauuuauuuuuccaggaauuaaaaaacaucuaucauauaaguauugcaaauaaaacuuaaaaagca

SEQ ID NO: 191410 - RNA, 22189 nt, Homo sapiens
gcccgccucagcccaacauggcgaugcacaacaaggcggcgccgccgcagaucccggacacccggcgggagcuggcggagcucgugaagcggaagcaggagcuggcggugaggggcuaggacagggguugcacggcauggggcuccgcgcccgccccgccuccaggccccaagcccggccgcgcuaggccguuuguuacuccgggggcgcggcgcggcgggccgggugcucggcggccugaggccgggugcgcauucugcggcccgccggcgguucagcuucccggcugugcgaauccggagccgggagagagccgggagcgcgggagggggaggggaagcggcagccgcaggagggggcguggagggaggacggugccggggcccggggagagggcgcuaggaagggcgagcgucagugagccgcgggggugggcgaggcgggcuaguccgugaucuuugcggggaggggguggggaaggaggcuagugugggagggggacccagucaccccgucuggacuuuggaggcugguggggagcguguucuuuuugguacugggaguagauccguugaauggagguuuuugauagacaggguugugauguguuugggaacaucuagaaggugacaggcgagggagaagaacacauuccggagaauucagaauugugacaggcacccaaggcccaaugcacucugguggcuaagcucuuccugcccccgcgucucggcuugggcacccgggaggccccucucaccugaagcugcccuucuagguuuccauagcaacuggcagcccggugucggcggccucucuugagccugcggggaggggagcgaguugacgcugaaaggcugcucaccuuucccucuccugguagcgauaccuuuugugcgugggaguggacaucgcccaaguucugcguuagccugggcucuugacucaugguuuccgugaauccucuaaaguauaugcaaaauuucgcguguguguguauuuuucuggagacaugcuuuauacauucagggguccaucacccccaaaggucuagacugucuuaguccuaaacggcuccuccuccccguaucuuccaucucuccacagggugguuuagugugggcaagcuugcguuuacgagucuaauaucaggauuucauuuuggccagacuuaaguguuugcauuuaaaagguaucauucauguccuuguuuuucaucucucaggaaacauuggcaaauuuggagcgacagaucuaugcuuuugagggaagcuaccuggaagacacucagauguauggcaauauuauucguggcugggaucgguaucugaccaaccaaaagugagugucgaaagccuguaguguuccuauugugcccuaguaacguuuguuuuuaggacuguaugcucuuaguggcaacuuugcuggaggcaguaguaaaguaguggugugaucuggacuugaacucuuggacucuggcucaggcacugccucaccgaauaaucuuagacaaggcucacaucuguaaaauagcgaaaguugggccuauggcacaggguugugugaggcuuaaauacaguaucuuuauacaauagcauucuauuaaauuuuuuacacauuuuaaucagucaugaguucuacccucacaguauuuuucuuuucuuuuuuucuuuuuccuccugaguagcugggauuacaggugcgugccaccaugccuggcuaauuuuuuuauuuuuaguagagacgagguuucuccauguuggccuggcuggucucgaacuccugaccucaggugaucugcugccuuggccucccaaaguguugggauuacaggugugagccaccacgccuggccacuuuucuuuuuucuaagagacagggucucacgcuguuguccaggcuggagugcaguagcacgaacuuagcucacugcagccucagacuccugggcugaagugauccucccaccucagccucccaauuagcugggacuacaggcacaccauacuguaccugacuaauuaaaaacuuuuuuuuguagaagugggaucucacuuuguugcucaggcaggccuggaacuccugguuucaagcaguccuccugccucagcuucucaaaguguuggaauuaaaggggugagccaccacgcccaacugacccucacaauuuuugccauaccugugugccagcuguaccacugcuuacuuaguaauauuauuuuuaaaaaauuucuaaacuuuuagaaaaucuucaaauuauaggaaaaugggaagaauaguauaugaacacuugauacccuccuaccuauauucacaaauuguuaauguguugugacauuugcuuucucuuacuuucuauaauauauauuaauauaagcacacaucuauauuuacauuucacauuuuuaaauugugaaauaauuauagauucauagggaguuggcagaauggucucuuguacccuucaucugguuuuccccaaugguuguguuuuauguagcuauaauacaguaucaaagccagaaaauugacauugguacaauguauauauauaguucugugucacuuuaucuuguguguagauucauguaaccacaaugaaguuacugaacuauuccauuaccacaaagaucuuccucaugccacuccuuuguaguuauaucucccagucccccuaccuuuuuuucccacuuaacgguuugaaaguuagaugcagguaaaugacacuuugcaccuaaaugugucaguaauuaccuccugaguauagggccauuucuucuaccuaaccaguuauuauaccuagaaaaucaauacugcauuaauaguaucuaauacauagucuuuauuaaaauuuccucaauuguccccaaaaauucuuugcuaauuuguuuugauccaggauucaguaagcauucaugcaugcauuuggcuauuaugucuuaagauugaggagagucacccuuuugguggugguuguggugguauucaugacauugccuuguagaauguugcaguuuccugagauuuucugagggcaaaacucaugacugauuaaaaggguccugaaagauccuuuaaacauuuuugcaaaaaucuuacauaggcaauugguguauccuuuguuaucuaucucuaguuuaucaggaggcacauaaugucacauuguccuauuauuuguugcugcuaaguuugaucauaugauuuaucugcuauaaaaguucauuuuuucccauugugauuaacaaguaauuuuggauguuaugcuuugagacauuaugaauauacugcucccucuaaauuuguauucaguuguuuaguauacaccguugauucuuaucugaauccguuaguacacuggaaguuguaaaauagugauucucuaauuguauuauucccuuuauauuuauuacuggcauucugaaaaagagucuuccuuuuuugacuucuguuucuuucauucucccacauuugucccagcuguggucagagggagccuccucaagcuggcuuguuugucguuucaacaugacccuauuacuuuuggaguacuccauugcuuucuggccuaagagaugucccauacuuaccuuuugcauuuuuugucccagaccugguaucagccauuccucuaaggaacccugguucuuucuuuaaauuugagaauuaaguuuauuuaagagacacuucauaucacuaaucuguucuccacuuuuuaaauaauaagcauuaaaauaaauauauauuggccgggcauaguggcucacgccuguaaucucagcacuuugggaggccgaggcgaguggaucaccugagguugggaguucaagacuagccugaccaacauggagaaacugucucuacuaaaaguacaaaauuagccggacgugguggcacaugccuguaaucccagcuacuugggaggcugaggcaggagaaucgcuugaacucgggaggcagagguugcagugagccgagcucgcgccauugcaguccagccugggcaacaagagugaaacuccgucucaaaaaaauauauaaauaaguaaauaagguaaaauagauacguauuaaaaugaaaguguggccaggcacaguggcucacaccuguaaucccagcacuuuggaaggccaaggugaguguaucacuugaggucuggaguuugagaccagccuggccaauauggugaaacccugucucuacuaaaaauacaaaaauuagccgggcaugguggggugcgccuguagucccagcuacuucagaggcugaggcaggauaaucacuugaacgcagaagguggagauugcagugacccuggaucgcaccacugcacuccagucugggagacagagugagacucucaaaaaaaaaaaaaaaaaaaaaauggcuaggugcaguggcucaugccuguaaucccagcacuuugguaggcugaggugggcagaucaugaggucaggaguucgagaccagccaggccaauuuggugaaaucccgucucuacuaaagauacaaaaaaagaauuagcugggugugguggcacgugccuguaaucccaggcuacucuggaggcugaggcaggagaaucgucugaaccugggagguagagguugcagcgagcugagauuucccauuguacugcagccugggugacagggcgagacugcgucucaaaaaaaaaaaaaaaaaaugucugggcgcgguggcucaugccuguaaucccagcauuuuaggaggcugauguggguagaucaccugaggucaggaguucaagaccagccugaccaacauggcaaaaccccgucucuacuaaaaauacaaaaauuugccagguaugguggugggcaccuguaauccuggcuacuugggaggcugaggcaggagaaucgcuucaacccaaggggcagagguugcaaugagcugagauucugccauugcacuccagcguaggcgacagagcaagacuccgucucaauaaauaaauaaauaaguaaauaaauaaauaaauuuaaaaaaugaacaugugaagcaacuaaaucucaugucucacagugggacauguaccauauauuggaaaacguugcuuucuguguucagcauaaaggucguuugggccagucugagugacauggaagcuuccugcauggaacaugaguccuggggcauccccagcuugagccauagacauagcuuggugcucauaaugaguuucuucuguguuuuagaaacuccaauagcaaaaaugaucgaaggaaccggaaguuuaaggaagcugagcggcucuucaguaaauccucgguuaccucagcagcuguaaguagugguggugggggaaucuuucuuuggccuguuguuggggaauguguuuuuucuuuaccuuccucugggagugcucuucugaggucuguggucacuuuucuaguaacugguggcuuuucuuuuaggcaguaagugcauuggcaggaguucaggaccagcucauugaaaagaguaaguugauguuuuuauguuucucaucaguuuauuuuuaagcuaccaucacccuuacacuuaauucauccaauuguguaucugaggacugcauuucuuaugcucuucccuuuucccucuucuuccuggaaguuuugaaacuuuuaggguauccuuaaucauguuuuucuccacuccccgacccagacaaggucucacuauagcccaagcuggaguacaguggcaugaucauaguucgcugcagccucaaacuccuaggcucaagcaguccuccugccucggccucccaaguagcuaggaccacaggcaucugucaccacaccuggcuaauuuuuaaauuuuuuaaagagacagagucucacuauguugcccaggcuaguccauaauuccuggcaucaaauaauccucccacuugagccucccaaaguguugggaguagaggugugagccaccauuugugaacaaucguauuuuuuccuuuugaggaagaaauuacuguacucuucuugccucuucugucacaugaagauuggcuuuagcaucucaaagagacaaagauauauuucauuacugauaaaucuuauaaauucuuagggaauuaaaguuaaaacaauaacuuuuauggaaaauuucaaauauaucuuauaaauccccauguacccaauuuaauaauucuuagaaaauguucaucuuggcccagugcaguggcucacaccuguaaucccugcacuuuggaauggagaggugggaggauugcuugagcccacaaguucaaguucaagaccagccuagucaacaaagcaagacucugucucuacaaaaaauuaaaaaauuagccaggcuugguggcauaugccuguagucccagcuauuagagaggcugaggugagaggaucacuuuagcccaggaaguugaggcugcaaugagccaugaucgugucacugcuccagccugggugacaaagugagaccaugccaaaaaaaaaaaaaaaaaaaaaaaaaagaaaugcucauccuguaaauaggauguaccuguauguucuuaaguauaaaauggaaaauagugcuauuuacucuguaaacgaauuauaucuuauuuuuuauacauaagccauacagucuaauuuccagggauggguuauagauuugugcauuuaucuuucugagucagacucaguguaaccauauuggauguucucucuguguauuucaucaccuugaaauacgaccuguucucgguauuacuguguacuucuuucagaagguauaucuuguuguuggaucuaguucuuuuguuggcauugguacaaugauaugaggaaaagggauuuuaguaguuugggaauuagaaguauuuaauuauuaucucuauguacagauuucuaaauuuguuucucugcccuuaaccucuuuccuggcuuuacuucugcauuucgucuuuuuuuuuuuuuuuaagacggagucucgcucuguugccuaggcuggagugcaguggcacgauuuugacucacugcaaccuccgcuuucuaggggccucccaaagugcugggauuacaggcaugagccacugcgcccggccugaauccugcauuuccuucuagacauuuccacucauaaucacucaaauauuugaucuaaaacagaauuguucuguuuccuucagaauuugucuucacagauuuuuugugaugguacuucacuucucccuuauucagaacucuguagacgucuuugacuccuuucugccagccucaucaauuauaccaaguccuuuugauuuuucuuuuacuaugacucuccacuaaaucuuuuuuuuuuuuuuuuaaaucuuacuucuuuuuaauuaaugccacucuagaauguagagcuaaacugguuaaggaacacccuggaccucacuccugugaguugagauggaaugauaucugacuuaguuuucuuucuuuuuuuuuuuuuugaggcagaguuuugcuuuuguuacccaggcuggagugcaauggcgugaucucggcucacugccaccuccgccucccaaguucaagcaauucuccugccucagccucccaaguagcugggauuacaggugugcaucaccaugcccagcuaauuuuuguauuauuggcagagauggggucucacaauguuggccaggcugaucuugaacuccugaccucaggugauccaucugccuuugccucccaaauugcugggauuacaggcgugagccacagggcccggcccugacuuaguuuucacaugagccuguaaucuugcccuggcuuagcugaucauucaguauauggcuguuuaccugucuaccugcaagaauaagcugcacccagguacuugucagggaaagacucaaguuacugcuuucagaagcuuggcuaagacaaacacuuauguauuaaagauuuuuggcugagugcaguggcuggcucauacuuuugggaagccaauagucccagcuacucaggaggcugagaugggaggauugcuugagcccaggaguucaaggcuguagugagccaugacacuccagccugagugacagagugagaccuugucaaaacaaaacaaaacaaaaaccugaaaaggcuggcgagauggcucacacuuaaaauuccagcacuuugggaggccgaggugagaggaucucuugagcccuggaguucaagaccagacuagggaacauaguggacccuaucucuaccaaaaacaaaacaaaacaaaacaaaaguagcuggacgugguggcacacaccuguagccccagugauucaggaggcugagggagaaggaucacuugaacccaggaggucaaggcugcagugauugugccacugcucuguacucuagccugggcgacaguaagacccuaucucaaaaaaauaaaaauuaaaaaaauuauaguccaauuuauauauuuguuuuuguuagauuuucuuuuuuggucauaucugagaaaccauugccuaaccuaguggcaucuaaguuuuuuuuuuuuugagacggagucucgcuuuauugcccaggcuggagugcaguggcacuaucuuggcucaccacaaccuccaccuccuggguucaagagauucucuugccucagccucucgaguagcugggacgacaggcacgcgccaccaugcccagcuaauuuuuguauuuuuaguagagaauggguuucacucuguuagccaggcuggucuugaacuccugaccucgugauccgcccaccuuggccucccaaagugcugggauuacaggcuugagccacugcgcccggccaggcaucuaagauuuuuaguuuuagcucuuacauuuaugucugugauccauuuugaguuaauuuuuguguauguugugagauggggguacagcuucauuguuuugcaugugaauaucuaguuguuccagcaccauuuguugaaaagacuuucuuucuucauugaauugucuugucacccuuguugaaaaucaguugacuguaaauauaaggguucauccugggacucugaauucuaguccccugauuuauacguugauaccaguaccacacaguguugauuacugcagcuuuguguagcauguuguuuuuuuagugugaaaucaguuuucuugaacaucagaagggcaguauuggccaguauacuuuuuguauaauagcuucauagcucuaggcagggaguccaaucuuuugguuucucugggccacauuggaagaagaauuuucuagggccacacauaaaauauacuaacacuauagcugaugagcuaagaacaaaaaaucacaaaaaaaucucacaguguuuuaagaaaguuuacaaauuuguguugggccauauucaaagccguccugggcugcuugcggcccaugggccuugggugggacaugcuugcucuagaguuuccuuuucuguugcuuuccuaaaauguguucaaauuaggguuucauguuuucugagauuuggcuauuucucucuucugcuuuuuuggaacugucucuuuccuuuacuucuuguacccguaugcuacucaauuuaaauucucuuccuagcagauuauaauaugaagaccauagaaagaagaaaacugggccagauacgguggcucaugccuauaaucccagaacuuugggagcccaagguggguggaucaccugaggucaggaguuugagacuagccuggccaacauggcaaaaccccgucuuuacuaaaaauacaaaaaugagccgggcaugguggugggugccuguaaucccaguuacuugggaggcugaggcaggggaaccguuugaaccagggagguggagauggcagugagccaagaucgcgccacuguacuccagccugggcgugacacagcaagacucugucucaaaaaagaagaaaacuggucccuugguucugcuaccacaugaccuuuuuugacaaguuuuagaaauagauaauguguguguguguguguguguguguguauauaaauuuuuuuuuuuuuuuuuuuuugagauggagucuugcucuuguugcccaggcuggagugcaguggcgccaucuuggcucacugcaaccuccaccucccggguucaagugauucuucugucucagccucccaaguagcugggauuacaagugcucaccaccaugcccggcuaauuuuuuguauuuuuaguagagguggggucuuaccauguuggccaggcuggucuccgacuccugaccucagaugauccacuugugucggcuuuccagagugcugggauuacagacaugagccacugugcucggccagauaauguauauauuuaggauccuucaacaguugaguaaagugaaagucuucccucacucauccuuaccuauuaaaaguuuaaagaaauuccuuucaggaaaaauaaguauauauauaaaggaaauacaaauauaccuguauuaaucuguuuucacacugcuauaaagaaauaucugagacuggguaauuuauaaaggaaagauguuuaauugacucacaguucuacauggcuggggaggccucaggaaacuuacaaucauggaggaaggugaaggggaagcaagcaccuucuucacaaggcaguaggagagagaacacgcaugaaggaagaacuucuaaacacuucuaaaaccaucaguucuugugagaacucccucacuaucacaggaauagcauggggaaaaccacccccaugauccagucaccucccaccagcucucucccucaacaugugaggauuacaauucgaguugagauuuagguagggacacagagccaaaccauaccaauaacuauauucuuuuuuuugagauggagucucguucugucacccagagcgaucucggcuuaugcaaucuuggcucaugcaaucuccacuuccuggguucaagcaauucucccugccucagccuugaauagcugggauuacaggcgccugccgccacaccugguuaauuuuuguguuaguagagaugagguuuugccgugcugaccaggcuggucuugaacuccugaccucaggugauccacccaccucggccucccaaagugcugggauuacaggcaugagccacugugugcagccuuuuuuuuuuuuuuuuuuuuuuugagacagucuugcucuguugcccaggcuagagugcauugcagugguaagaucauagcucacugcagccucaaacuuaugggcugaagugauccucccaccucagcuuccugaacagcugagacuccaggcaugugccaccaugucuggcuaauuuuuaauuuuuguuuuuauagagaugagggucuggcuguguuguccaagcuggucuugaacauuuggccucaagccauccuccugccucagccucccagagcacugggauugcaggcaugagauacugugccuaaucuauagucuuaaaaauauauauguuuauacaaguuguuauugagcuugcuuuuauuaagguaaucuacagugauguuuuaaaauugagaauaugugucagcugaagauuauuacugcauuuuaaaaguauucuuagcagaaugcguggcucaugccuguaaucucagcaguuugggagguugaagcaggaggacugcuuaagcccaggaguuugagaccagccugggcaacauaguaagaccccaucuuuaaaaaaaaaaguauccaagugugguggcaugugccgguaguuccagcuacuggggaggcugagaugggaggauaauuugaacccaggaguuugaggcugccaugagcuaugaucacaccaguucacaccagugcacucuagccugggugacagagugagaucuugucucgaaauaaaaugaaauaaaauaaaacuuaccaggcugggugugguggcucaugccuguaaucucagcacuuuggaaggcugaggcagguggaucucuugagccuaggaguucaagaccagccugggcaacauggcaaaaccacaucucuacaaaaaauagaaaaauuagcagggcuuaugcuuaugggcaccugcagucccagcuacuugggaggcugagguguaaggaucaucugagcccaggaacugaaggcugcugugaacagagauuccaccacugcacuccagccuaggugacagagugagacccugucuuaaaaaaaaaaaaaaaaaaaagacuuacgagguucaaguucaacagagcuuaaagguuaaacaaacaaacaaaaaaaaaacaagaaaaaacaauggaaaacuuaucagaguaauucaggaaugggcugucuucucccucuuuggcccccccuuuuuuuuuguacagucacuguaguuuuuuuuguacaucacuguagauuacauuuaauaaaagcaaacucaauaacaacuuguguaaacauauauauuuuuaagacuauagaucaggcacaguaucucaugccugugaucccagugcucugggaggcugaggcaggaggaugguuugaggccaaguguucaagaccagcuuggacaacacagccagacucucaucucuauaaaaacaaaaacugcccuuagagcuguucucucugguuacauuguuucagauuacaugcuuuuucaggaccuuuggucacuuggauccuuuguauguaucuucucugucaacauguaucuucucugucaacauguaucuucucugucaauuagaggauagggaaugguuuuuuucuaccuauuaguguucauguugauggacagauugccugaggaguacugaugaugcauuuggaaacuuguguuuuauuuccuucaggggagccaggaagugggacggaaagugacacuucuccagacuuccacaaucaggaaaaugagcccagccaggaggacccugaggaucuggauggaucugugcagggagugaaaccucagaaggcugcuucuucuacuuccucagggagucaccacagcagccauaaaaagcgaaagaauaaaaaccggcacaggucaguggcagggaucccacccccgcagcucccaugaccauugcugugaagggaauugccuagaauaaaaacucuuuaggauugcugcagacucuuucuguugcugauggcaagaaagucauuagguccaagugaacgggcuaauuugcucaaagggaggaauuggugggcauuagaguaacccucaaggaagacuccaggacauucuucucacuguuucuaguguagaauaguuuuauuccauaaaaaccuuguuucauauggugaauauggaauacuuuuagaagaggaaaaggagaaauagaaauggaaucuguguaauaguauuugaaaaaugccacugguacuuauugggaagcuguaaagugggauaaagucuucugcugguaauucugaucuuugccuacucuuauuucuuuguggauggagagaacugauuugacaugccuuuuuuucucuuuaaauacaaguuuuuuuuauugcuugugauuuuucuguuucuguauuucucagcaauaugcugacuucagauacuggaggaacaguauaaagccuguaaaauaugagagugucuucauagguaacguguaacauuggugcaccauguuuuuuugcaguacauaaugagauaggaaugacgucaguggacagagaggccaggugucacccagagaggguuucagcauucacucugccugggguuuguaugaucaugcuggggauuguuaacucagauaauuggaaauuaugcagcuugaccuaaagaguauaauguccgguuucuagaguaaggaguuuugcuggccucaagccuuccaggagaaauggagacccuauacauaccuguuuccaugccuccuagaaguuccgaagccaggguaagaguucucauucuagaaacuguacauucguucuacuccuccuggaagacugcgugcugagcaggugaaagggggcaaugcaagggauggguggcauucccuguucuccaguuugcuucuggauuugguuuacaaaucuguaggguauuccuucaugcacccaagguauuaaacuuguuagcuucauggauaugacagugccuggggguaauguaggauuaacucuaccugauuugaaccuccuugauuggcgucagcugguucuucaauuauuuuaagaguuuuucuuguugaugguaaugguguuuucuagacugcagaaauaguauuuccuucaaauaaugacugaggacugcugcuuaacauuuuucugcaaaccagaagucaccauccuaaucgcauaacuguaguaagaauuagcaaaaauuguauaucuaccucuucauauauuuuugaaaggcuauagguuauuugaccaacuguaguaagacuggugcuagcuuaucacgaauaacagagaaauauauucuuaaaaauuuuuuuaauugucaagauaauuaaaugucaugcucuguauugcuuuuauuaaauuuacuccagugucauuuuuuuuuaauuuuuuauuuuuuucagacagucuugcucugucacccaggcuggagugcaguggcacgaucucagccccugcagccucugcuuccuggguucaaacgauucuccugccucagccuccugaguagcugggauuacaggcgugcaccacugugcccagcuaauuuuuguauuuuuaguagagacacguuucacuguguuggugugaacuacuggccucaggugauccaccugccucggccucccaaagugcugggauuacuggcaugagccacggugucuggccuagugucauuuuaaaguagugauuauuuucuuauuucauagugucuagaguagggaggaaacucuuugaaaguuucggggacuuuuucccauuacugauuaauagucuguagauagcuguuuauuucagguaguucuucauuuccacuaaugauguuauuagcuggugacugauaaaaaggaguuaaagaggagcuaaacuucauuuucuucuugcaaguuucuagcacauuuccauaggaacaauacuucuuccuauccuaggagcuaucuccuuccagaaaaauaguaguaguuguaaaaaucuucgauauuaguuacugcuucgcaaauaguguuuucuguuuggaaagcagaauccugcuuuuuauugcuguccuuuugucuucccucugauuuaauaucuggcugaucucccuuggccuuaggcacucaucugccccaagaaaggagagugaagcugauuuguuuccuuucuagggaagcaaaauucagugugccugaauggcacacgagcggucaguuaaggcucuuggacuccugccaucuuuagucaggaauugugucugcuccaagucccuuacuacugcugacugauaucucaguagggcuggcagauugggguggggacagagcauggugucuauguacauuguuaaguuuguacccaguauaguacauguuuauccuccagugugccauaccccauauagugagaugagucaauaauaaauuauuucagcaaauguuugaguacuuacugugugccagacacuguuuaguggugagcaaagguggaaauaaauauggcacuuaagcaaaaggaaauaacuugaauuugcccucuucaggaauaugaaauuuuuuuuuuucuugaaacaaggucuugcuggauugcccaggcuggagugcaguggugagaucaugggucauugcagcuuugaccuccugggcucaggcaauccucccaccucauccuccuaaguagcugggaguacaggcaugugccaccaugccuagcuaguuucuguauuguuuuguagagaugggguuuugccaugcugcacaggcuggucuugaacuccuaggcuugauccuccugccucggccucccaaagugcuggguuuacaggcaugaaccacaccacaccccgccagaauauaaaaauuuaucaaauaauuuuuagcauccauaagugaucacauuguucugaauucuuauauuuuacaugauaccugaacaguaugucauuccugguaucuuuaaagaaaaaguugaaauaauaccauauaguggccaggugcuguggcucauaccuguaauuccagcaauuugggaggcugagguggagggaucacuugagucuaggaguucgagaccagccgggggcaacauggcgagacucccgucucuacaaaaaaacacaguaauuaacuggacgugauggcaugccuguagucucagcuacuuggaaagaugagaugaggcuggaggauugcuugagcccaggagguugaagcuucagugagcuacugcacuucauccugggugacagaggaagacccugucucaguaauaguaauaauaauaauaauaauaauaauaauaauaauaaaaaauaacauagcuacucuuauaaguuucuguuacuauaaaaaauuacuuuagauagucuguaaaguuuugauuaacuagauacagucuauuuugauuugugaacaaagucaagucaggcugaaagugaaauauuugauaauuccuaguuucauacaccuacuguauacucucccaaaugucuaaagugaaacuauuuugugagagauauugacauuaagcuuucuuccagcuuuacucuugcaaacauugucuaggaggaaauguagccauuugcauauuguuuuagcaccuaaauguagccauuugcuuauuguuuuagucuggaagguguuggagccggugaaggagcaggugucaugcuccagguuaauguuugcuuuggaggccugcccagaucauggccugcuaguggugauggcacaaaauggucuccuucucuguacugcuccuuccagaucccugagacuugggugcuuguggauggcagcuuucccuuguuuuaauaggggugcugcaggcugggugcaguggcucaugccuguaaucccagcacuuuagggggccgaggcagauggaucaccugaggucaggaguucgagaccagcuuggccaacauggugaaacccugucucuacuaaaaauacaaaaauuagcuggaccuaguggcaggcgccuguaaucccagcugcuagggaggcugagacaggagaaucguuugaacccaggaggcggagguuacagugagccaagauugcgccauugcacuccagccugggugacaagagcaaaacucugucucaaaaaauaaauaaauaaauaaauaaauaaauacgggugcugcagacuuuuguguuucuuaauuauagcccugauauagacaguuaauugccaucaccuacuuagguggcagagcaauacuguucuucauuuucuggaacaagguuccaccacugaaguuuauucauucaacuuugggcuuuuaggaugaaugcuguagaaaaggagcaugguguucccuggacauguuuagaacauauaacuugagggaggcugaggcaggagaauggcgugaacccgggaggcagagcuugcagugagccaagaucgccgccccugcacuccagccugggugccagagcgagacuccguuucaaacaaacaaacaaacaaacaaacaaacccauauaacuugaguaaaaauuugugaaauguuuuccuuuuuuaaaguuuagacuguguuguaguuuuuuauuuuagugaaaguauauuaugcugaguuguuagcacucucuucaaagugccuuucauuauauaacuaaaccuuucuuucucuguuucuucuaaugcccuaauuauauuuuucaauacaauuaaauauuuuaaaaguucuaacuccgaauuuggcagcuaauaaaagggcuccaggugucugaguuuucuaaugaaauaacuuuuucuuucauagucuagucuucugauaugaaauccauugaaggaagggaaucuucugaccacaaaaucuuuggugcuuugauguuugauacuuuguugcuuaagauucuuaaagcugauuuuguuucuacaauucuugcuaggguggcuaaucgacuaauuuauucaauuaguauauuaauuucuauugcuuucuuccuuucaaaugcugccccucagcccgucuggcauguuugauuaugacuuugaguaaguuugauuugaauuaguauuugugcuguguuuaguguguagacaccaguaugccuuuuugagaccuuucuaacccauaguuuaucuguuuaauuguagguauguauauuagguuaggcugggaaguuuuuuuuaaaaacagaaaaacgugauggagguaacauuuuauuuaauaacuuaagcaaaauuaaguaaacuucacuuuuaugcauuuuaauuucuuuuaaaauagauaaccuuuacuuuaacucauauuuaaauugauuuucuggcuuugcuucauaaggagaauaauagcuuaagaucuugauauuuugcuuuggaaagauuuaaaaauugaaauuaauuuaauuuauuuuguguuucguguucagaaauacaaacuccuagucucuuuccuguuguuaaucaccaugugucucaguaauuuucagugauauaguuacagaacuaacacauuaacauagagcaugcccucuuacuucagucuuuuuaacauguaguuuuggaauuguuuuaaaauuauauggcuuuuguagcugcuguauacauuucuuuuuagagucagcuaaguuugccuuagggcaaaaaugugugcucauaauuuuuaauacuugcuugauaauaucuggguaaacaacuaaauaugacauagucuaaugaagaauguggauuuuucuuaaccaaauagucuuuguuauagcuuaugcccuaugcaguagcugauugugggacccauuuucuguaaauuaaaauggaaauaucuuuuaucuuuucugucacaggauugaucugaaguuaaacaaaaaaccacgagcuguaaguaucagccggaccacuucagagaggcuggcaauuuuguagaugauuagaaaaauguauuugucuucagagcuugaguguuccuaaccuggagucauaacucuugauuuaaagucugggguguccaucuggauauacuucaacuuuuaggugguuuuuuuguuuuuuuuuuuuuuuguuuuuuguuuuuuuuuuuugagagacaguuucuugcucuuucaccuaggcuagagugcaguaucaucacagucacaguucacuguggccuugaccuccugugcuuggccucccgaguagcugggaauacagguacaugccaccuugccuggcuaauuuuuguauuuuuuguagauaugggguuucaccaugauguccagucuggaacuccuggacuuaagcaauccuccuaccccagccucccaaaguguugggauuacaggugugagccaacgugccuggccuaugguuuuuguauuuuaaggagagaaagaggucacauacuuuauuuauuuauuuauuuauuuauuuauuuauuuauuuauuuauuuuuugagacggagucuugcucuguugcccaggcuggagugcaguggugcaaucuuggcucacugcaaccuccgccucccagguucaagugauucuccugcuucagccuccugaguagcugggauuacagugcgugccaccaugcccagcuaguuuuuguauuuuaguagagacaggguuucaccauguuggucaugcuggucucaaacuccugaccucgugauccacccgccucagccucccaaagugcugggauuacaggcgugagccaccgcacccggccggucacauacauuuuuaaugaugaaaaauucccuuuaauuaaauaauaaauuguuaauacuagcucuuuuuuuuuuuggacuggugaauucaggugcucuaauaagagcaaaauugauguuucaaucccuuuauggacucagaaggcagaccauuuucagaugugaaauauuguacauuauauuuggaauagaaucuuuuuuuaaauuuuuuuuuugugugugugacagggucuggcucugucacccaggcuagagugcaauggugugaucuuggcucacugcaaccucugccucccaggcucaagccguccucccaccucagacuccuggguagcugagaccacaggcaugagccaccacaccuggcuaauuuuuguguuuuuuguagagacauggucuuaauuuguuacccaggcuggucucgagcuccugaccucaagugaucugcccgccugggccucccuaagugcugggauuauaggccugagccaccacgccuggccugaaauacaaucuuuuuuuuuuuuuuuuuuuuugaaacagaguuucacucuugucacccaggcuggagugcaauggcgcgaucuuggcucacugcaaccuccgccuuccagguucaagcgauucucccaccucagccuccugaguagcuggaauuacaggugcccaccaccaugucuggccaauguuuuguauuuuuaguagagacgggguuucacuaugcuggccaggcuggucucgaacuccugaccucgugaucucccugccucggcuucccaaagugcugggauuacaggugugagccacugugccuggccugaaauauaaucuuuagcuauagagcaguccccuaguagaguuguuuaugagauuuuuuuuuuccuuuagggucaaacaacuguucugccgagaguaaguugggacuuuuguuuuucuuucuuuaggacuauuagaagacacauuagugcagaagcuuccaggcuguagagcccugcuucccuucucugaccucacaaagauaaacauccuucaccugaguucguggccauccaccucugcucucccagacccagugccugugacuuugaguaguuuguucuaaauguggugacaaacaagucauuucuguaagacauugggucuuacuuuaugucauuuuuaguaacagaacugcaggaagaugaagacaauguuguaaucccagcaaguugcuaacugugcguuucucccuucuuagaaugaaugucucccccaaaacuggcuggcaccagcuucaucugugauacccuucaagaaauguucucugguuuuguuuuaugcugaaaguagaacacaagucacauuucagauggaggcuguaaauaucuggcauuuucuuauauuguuuuauguuuucuuguuuuucucuuguuguuuuuaucuuauuuucuuugggguuuuuuuguaaugccuuuguacagcucauacuuuccugcugacauaucugaucaucucuuucaugcaguugccaauauucauaacugaaaauaaucugguuuaucauaaguaaaaugggaaacuugccucuguuuuuugcaaggggagguaaagaguguuuaguaauuaccuaucuuaaaucuuucugaguugguaguagauucauguucaaggaacaggaaaaauggaaaaacauaaguuuaaaucaguucuuuuuaaauaacuuuuuauucuuuuguauaaauaaaauuucacaggcuucaaauucucaugcuuuacuuuuaaacccgagauuguuuuuucacuuauuuauucauaucaugccuuauggaaauuucuuuuucuguauuuucucucuuugcugguauucaccugauuaaauauugcucuaaaaaucaccauggcauauggaaagucucaaaauuauaccaaaagugauaacuuaugucguucuuaaguggagugaaaggauagcaucagugagagccaguguugcccaccaggucucccuuucuuggagggcuuguuggggcugaggaaucugcuaguaaucguuaccugccucuagugcuguggugaacuugcgacagggucuggcugcacauuggaaucaccugagaagcuuuaaaauacucaugccuggaucccaucccuagagacugggguacagccuaguuauugggaauuucuuuaaaagaguuccugggauucugauaagaagccagguugagaaccacuacauuagaagacugaaugguuuaauuuacauccuauguuaugauuggucuaagggauaagauuuggggucuaaccuuuccuuucacucuaguuagucauaguccuugacuuaugccuauaucuuuguaagaaauaguauguuucauuugugauaguauugguagggcugaauauggauggcaucuacuguaaaacaagucuaccuugucagaugugcaaaagcuuucacucuuguucucaaauaaacuuuuguggguuuuuuu

SEQ ID NO: 191411 - RNA, 12895 nt, Homo sapiens
gcugaggggcagcggcuuaggcuccggcgucugcaggggucgccgagcuaacccguggcuaggcgaguggggcggggcggccggcaccaugucgaggcaggcgaaccguggcaccgagagcaagaaaaugguaacuuggagcgcgugaccucggcgggcggggcgaaauugaggcguacagggaaggggcccggcgccgagcgcgaggugcguuuggaaaagggccuuccugugagcucuggcaaggggaagccucuugcugggucacuccgggggcguuccaggcaggugaggggaccgucggagaaguuccccggaggagaccccgcccccaaggccugagugcagcucugugcuaagccaacaacaacgacgguaauaaauaccaauaacugccacuuaacuucucucuuacuauguguugggcaccgggccacgcacguuacagcaucucaguuaaucugcagaguagccccuaucagauggauaacauugccguuuuacagcuuggagagcuuacguaauuugcccauauuuacaccugggaaguuaggauuuggacccguguuuaacuccaaagcuaaugcuaggagcugacuguuaggcuuuacucuuaggcuacagugucucguacuguggcguggguauugugagagauguucagauacuggucgugccagaaaggaacguuuuauucaauggaauaagagaugggccagaguaagcagugaguggugccccucuaauggaguggguggcucccuucuuucccagggaauaguuuggacaccauaugguccuauaaaguuggacuaggggcuggggcugcagacuuaggucauuuuucuuucguucuucccucccuccccccgcccccagacgaaaucucugucacccgggguggagugcaguggcacuaacuuggcucacugcaaccucugccucccagguucaagcaguucuucugccucagccucccgaguagcugggauuacagguguccaccaccacgccuggcugauuuuuguauuuuuaguagagaugggguuucaccauguuggccaggcuggucucgaacuccugaccucaggugauccgccugucucggccucccaaagugcugggauuacaggcgugagccacugcgccugaccaauuuuuguauuuuuaguagagacgggguuucaccauguuggccagccuggucucgaacucguggccuuaagugaucugccuguucaggcucccaaagugcugggauuacaggggugagccaccacacccggccaaaagacgagaauauuuuguuaggaaacaaugucagguaaggggaaacacauggaccuugguuggaauucugacuuacuugauugaucuucaauuucuuuaucuauaaaauggggauaguaaugucuaccuaauauuaaaugggaugguguaaaaugugaggggcaugguaaauguuucuuucuccuuuuccuaugagaugaguagaggucuuccugguuaguuuuuguacuuugcucucauuuuauccauuuuuuaagccugaaaucaauauugaaaucuuuaacaaaaaucugcagacucuacccccagcccccaguauucuucguuucagugaaguaagguaauuagggaggggcagcagcauacuccugcccucaaggcucuuggaacucccuucuucuagauagucacuuagcccacuccugccuucauucauaguuacucaaaugucaccuccuuugagaggccuucccuccugauuaccugccuaauucucuaaccucuaacucuaugcugguugucuucauagcacugucuauuuaauuuuaaaugauauacccaggcuggaguguaguggcaugauugaggcucauccagccugaccucccgaguucaagcaguccucccgccucagccucccaaguagcugguacuauaggugugcaccaccaugccuggcuaauuuuuuuuuuuuuuuguagagcuaggggucucccuguguugcccagguuggucucgaggucucgaacuccugggcucaagcagucccuccaacucugcuucacaaauuacugggauugcaucuguguuccauuuaagcuugccaagaccuaaauuguuuuguuuuguguuuugagacagagucucgcucugucaccuaggcuggagugcaguggcccgaucucagcucacugcagccuccaccucccagguucaaaagauucuccugccucagccucccgaguagcuaggauuacaggcacccaaccacuacggcuggcuaauuuuuguauucccagguuggucucaaacuccugaccucaagugaucuccccaccucagccucucaaagugcugggauuacagguaugagccacugcacccagccuucauuuuuuguuucuugaagcaccaaaagcacagauuuauugaaaugaaaguacacuccacauagcaggagcaggcucaagcaaacggcucaagagccaucuaaauuguuaguaugcccaaguaacuagauuuuagucugugcaaacagaaacagcccuuuuguccaauaaacuuuucuuuagccccaacuauaugcagagcucugugcuagaugcugugggagaugcaaggaugaaguccuagucccuaacuuugagaagcacauacucugugagggagacagaaauguauaccauauauacuguguaucuucuagcaguggaaaaauaaaaagaaauguuugccauacagagguguaguaccgccugcaccugaguucuaguuucaccacuuacuugcuguguuaccuugggcaaguuuguucauuguucuagcaucagcuuaaucaucuuuuuuuuuuuuuuuuuuuuuuuuaaugaaguaggcugggugcgguggcucaugccuguaaucccagcacuuugggaggccaaggcgggcagaucacgaggucaggagauggagaccagggugaaaccccgucucuacuaaaaauacaaaaaauuagccggucgcgguggcgggcgucuguagucccagcuacucaggaggcugaggcaggagaauggccugaacccgggaggcggagcuugcagugagcugagauugcaccacugcacuccagccugggugacagagugagacuccaucucaaaaaaaaaaaaaagagagaccauccuggccaacauggugaaaccccaucucuacuaaaaauacaaaaauuagcugggugugguggugcacaccuguagucccagcuacucaggaggcugaggcaggagaaucgcuugaacccgggagguggagguugcagugagcugaaauggcaccacggcacucccgccuggcgauagcaacacuccaucucaaaauaauaaauaaaauaaaaaggccgggugcuguggcucacgccuguaaucccagcacuuugggaggccagggcggguggaucacgaggucaggagaucgagaccauccuggcuaacacggugaaacccugucucuacuaaaaauacaaaaaaaaaaguuagccgggcgugguggcggccgccuguagucccagcuacucgggaggcugaggcaggagaauagcgugaacccgagaggcggagcuugcagugagccgagaucgcgcuacugcacuccagccugggcgacagugcgagacucugucucaaaacaaaaauaaaaaaaugaaguaauaauaguaccuauauuauaggguuguucugaggauuaauugagagaaugcauguaaagcuagcaguguaacggugcacuuagaacacaguugacacccaguaaguguccucuagauguguuauuaguaaagcuaguagccuucaugugccuguacggggguuggcucuggaaucccauggacaaugagaccugcccuucucuugcguuggcuuacugugacccaacccagugucuauuccccugagcucaggugagccauuacuuacguaguagcacuuggagucuccaugacaaaaggcuggaggguaagagaguuggcuggauuuagucuugcuauugauccuccuccagcugcuagaggggauucacacuggauuaccuauuuugacaaaaauaguaugagucuuggagcauuggcucuaaagaucagccuccuggccaggcaugguggcucacaccuguaaucccugcacuuugggagguggaggcggguggaucacagggucgggagauggagaccauccuggcuaacacggugaaaccccgucucuacuaaaagaaaaaaaauacaaaaaauuagccgggugugguggcgggcgccuguagucccagcuacucgggaggccaaggcaggagaauggcaggaacccgggaggcagagcuugcagugagccaagauugcgcuacugcacuucauccugggcgacagagcgagacuccgucucaaaaaaaaaagaaaaaaaagaucagccuccuuaaggagauuugacauuuuguuuggggcacuaacgggaagaaaggccuccugaaaacugucaaguggugucucaccugaguguagagcugguuucauuuacuuuguucagguugugccugaaguacuuggagaucauguuagcauagcugcuauaaauccugugguuucuugucugcaaagcacauucaaguccauuaucuuacuagauccuaccaacaacccugugaauggcaugacagauuuuacuguuuuacuguuacuuuuuuugaguuagaagauugaggcuuagcccagugaauugauuuaccuaaguacucacagcuguuaagcagcaaguccagacucagaaucaggcuuucaggaucuugcuguguuguccaggcuggaaugcagugguguaaucacaauucacugcagccuugacuucucaggcucgagccauccucucaccuuagccuccugaguagcugggacuacaggcauguaccaccaugcccagcuaauuuguucuauuuuuuauaaagauggggucucaauguguuuccuaggcuagucucaaacuccugggcucaggugaccacuuccgaccccugccuccgccucccaaagugcugggauuauaggcaugagccaccaugcccagccagaaaguuguuuauauugauucaaaaucuucuuucuuuaugacuugcccucccuuuuuuuuuuuuuuuuuuuuggagacaggguuucgcucuugucucccagccuggagugcgguggcaugaucuuggcuuaccgcaaccuccgccuccuggguucaagcaauucuccugccacagccucccaaguagcugggauuacaggcaccuaguaccacgcccagcuaauuuuuguauuuuuaguagagacgggguuucaccauguuggccaggcucgucuugaacuccugaccucaggugauccgcccgccucggccucccaaagugcuguacuugcccuccuugaaccuaguucagggugugaucuagcaccacaccacauggaaccaguuuaagaauaaaaauaaguauguauuucuugaguaccugcugugcagcaggugcuccacaaacauuaucugauuggaauuucauuggaauuacacaguaacucugaaaggcagguaacauugucaccauuuuacagaugggaaaaacuaauguucaggaagauuaagcaguggcuuaggauaacaaagcuuuuuacaggauaaugcucaacuauaaguaggcuguugagucucaguuacuuaaccugucaucuguaaaauggggaugaauaauauuuguucugcuaaccucucgugguuguuaugagaaacuguuacaaaaauagauguguugcagaagcgauucauguuucuggugguagcggagauguggugcuuauguucagugaagagauugggcugguugaccuuuaugaccuuuaugaucccaugagaacuuuuguuuuaaaagucacaagggcugaaaacccaggucuucagacucugcaaccucccgucacuuaucugauuuccuuuucuguucucucuugcuuacuccucucuaaggccaagagucucccgcuguuucucaaacacaccaggcauacuuguaccucaggaucuuuagaauuagugccuagaauuuuuucuagaccagcuaucuauccagauaucuucauggcuuaccaaauaucaccuuagugaggccuucccugauuauucgauuaaaauuaaccacccccccaacacacacacguaaaugcccccaaucuguuuuugugcuuuauuuuucuccauagcaccuaucaccaucuggcaaaucauguauuucauuuggcuguauugucucucccccuccuguuagauagccuggcacacaguaaauguugaaucagugauuuguuuucauuauacuauagcccauuccuauuuuauuuguuuauauuuauauuuauuuguauuuuuugagacagagucucacucuucuaccuaggcgggaguacagugguacaauuacaguucacugcaggcuugacaucccaggcucaagccauccucccgccucagccucccaaguagcugggacuauaggcauccaccaccaugccuggcugauuuuuaaaauuuuuuuguaaaguugggggucucaguguuugcccaggcuggucucaaauuccugggcucgagugauccuucugccucagccucccaaagugccgggauuaccaguaugagccacugcaccuggccaucccuucuauuuuuaaagcauaaaggccuuuaaguuauacauuuaugucacucacaguuccacagaggcuugguucguaauugaagaugaagauagacuugcaaaucaagagaggguauggagagccuaacucagggaucccauuccgagaucccagguauauggauuccaugaccaccaacagaucuguccaggaccuugauuguucuuauugguaaauaggagguagcugcauguauaaggugcuugauaacaucaugauuugcuuguuacuuggcaucaugguggccugaggcucuuggagucuccauccaagggcucauuaauaauggaaugaaagcucuccugauuuaaugcaguggugccaauucucuggacugguaacugcuggauuguuuccauccauucaugcucaaaccauucuagugccaagcccuugacuuuacuaaaaaaaucguuccccuccuuaacagcuuccccuuaauugccauauuugguaaauagucucuuggagacacugaucugacuguuuauuugaguucaaagggccuccugauccugaaacugacuuucuuugacucuagugcagcuaaguuuuuuggguauuuuuuuucuucuguuuuuguuuuuauugaggagggcuuauuaauacuacaguuguggggaagaguggauagguugaccauuggcuuggaaaccuuugauuuuuuuucuccccaaauuacuuuugucaauaauuagcuguuuguccuugggcacguucuuuuuuuuuuuuuuuuuuuuuuuuuggagacggaaucuugcucuguugcccaggcuggagugcaguggcgugaucuuggcucacugcaaccuccuccucccggguucuagcgauucuccugccuuagccuccugaguagcugggauuacaggcacgcgccaccacacccagcuaauuuuuguauuuuuaguagagacgggguuucaccguguuagccaggauggucucaaucucuugaccuugugauccgcccgccucggacuuccaaagugcugggauuacaggcgugagccaccgcgcccagccuccuugggcacauucuuuaaccauucugggucucaguuuccucaucucuaaagugggguuaauuccugccuuuccuggauuacuguguuaucaugggauagauaaugagauacaaguagaacgcaguauuuaagcaaaaggcauucaaauuauuauucuuguagugcccccaucaucaggccauggggauggcgugaggagcauuggguccucagagccugggcuuuuacauuucuuagacuuucuuccccagaaaacuugaagagaggaagguucuuugcuucaaaucugacaaaucuccauucagaaggaagagugugggugguuauccugauuuuucagccuuauuucugaguuaauucauugguccagaugugcuguuaauauguuucucacuuuaacccugauaaugccuuucccccugccugcugcuuucauucuucagucuugguauuugucacucauuucaccuuuuacaucaauuucuugguagauaagugacagaauucuucuuuuuuuuuugacagagucuugcucugucgcccaggcuggagugcaguggcacgaucucggcucacugcaagcuccgccucccggguucaugccauucuccugccucagccuccugaguagcugggacuacaggcacccgccaccaugcccagcaaauuuuuuguauuuuuaguagagacaggguuuugccauguuggccagguuggucucaaaccccugaccucaggugauccacccgccuugcccucccaaagugcugggauuacaggcaugagucacugcuccuggccccagaauucuuuaugugagaaggaguuucugugauuuuaacugcuauuguaauagaaaccaguugauucugaagagucaccucuuuuccuggaaauauuuuggcugugaguuaagaggaacauuauuuucucccaugcuggugacuuuggaaagggguugucaucagugcaaugaacuuggucugggacuuccuuccuuccccauggacugggccccuggguccucuguugcuucugggaggggccuugggaguacaguuuacucuaggccaggacauucuaagacauguggaaaccauuggucacaccugccagcaacagagauuaguuuguaaaugucuguuucagguguuucacagcaucuagugaaugaccguugcucccauaccagauucuggugaccugaucuuaggcuugacagcugugguggagacuuggguuggcagaagccuaccuugguguguuggaagagugauugcuuagugcaugaggugccuuuuacagcccauuuugcaguaguucuggcugcagcccugcugcuuugaccuugcaggccaaauuuccuggcuccuccaaaggggaugauguucuuucccuccagacacaguuagagggaauccugacaguugcaucaaggcugguccagacucucaccacgcuuucucuuuugugcugcuugguccugacugccuuuugaaucucuuuuagagcucugagcucuucacccugaccuauggugcccuggucacccagcuauguaaggacuaugaaaaugaugaagaugugaauaaacagcuggacaaaaugugagugagcuccuucauaggagagacagaaauggggccucccagcacacugagucuacauuguccuuuagagcuuaaaacaggguucucucucuuucuuagccaacauuuuggguacauuucucacuaaacucauuuacugggauguuuuugagauuauccccauuuucccuuuaccaccaacaaccuuauguucaaacauaagacauuuagacuccaucauagucucuucucuaacuuccuucccaggggcuuuaacauuggaguccggcugauugaagauuucuuggcucggucaaauguugggaggugccaugacuuucgggaaacugcggaugucauugccaaggucauuauucugggccaccuguccaugcugaagaauugcugcugagaggcacugcuuaccacucuuucuaucucccuuagagaggccuuuaaucucccaaaagacuggcuaggcagcucuuugggucaaaaaaacauuccaggucguuagggaauagcauagauuauuuaaucccuguggauuaaagccccacugaaaucaaagccugagcuuuuccacugugaagguguagcagaguagcauggggguaaagaauacagacucggucgggcgugguggcucacaucuguaauccuagcacuuugggaggcccaggcggguggaacacaagaucaggaguucaagaccagccuggccaagauggugaaaccccaucucuacuaaaaauacaaaaguuugcugggcgugguggcgggcaccuguaaucccagguacucaggaggcugaggcagagaauugcuugaacccaggaggcggagguugcagugagccgagaucacaucacugcauuccauccuggguaacagagcaagacuccaucucaaaaaaaaaaaaaaaaaaaauacagacucacaaaccuggcuccaguacuuacuaguuuuguguuuuuagauaaguuacuuuaaauuucuuuaauuaccagugaccucaucuuuuuuuuuuuuucuuuuuuucuuuuuuuugagauggagucucacucuuguugcccaggcuagaaugcaauggugugaucucggcucaccacaaccuccgccccccggguucaaaugauucuucugccucagccucccgaguagcugcgauuacaggcaugcaccaccaugcccggcuaauuuuaauuuuguauuuuuaguagagaugggguuucuccauguuggucaggcuggucuugaacuccccaccucaggugaucugcccaccucggccucccaaagugcugggauuacaagcgugagccacugugcccggcaccaguuaccucaucuuuaacaugaagaaaauaagagcuacccccagggcuguuuuaaggaguaaaugaauaauggacaugaacauuuagguaaaaugcuaguguuuagcauaguguugugcauauaguaaauguuuacuauuacuaguauuagugcuaucuguuauaguauuaauaaaugacauagcacccauaacuuuguggugucaguuacuuaaaaguuggucuuucuguuguaagcuugcuggucauacccaaauccuaaagaggauugacaguggagggagcuuugugagaguuuggaauuaggaggguggauaggguaggacuuuuucucugcccaguaauguguauucacuuucaagaaggugcauucagguagcacagacagaggacagagaaguggguuagggccucugcacucaggcagccaccgugucgaaagacuagugcucccuuccacugagaaguacaagcacacagugagugaguuguugcuuacuuguaugaugccuaggaaagaaaaauguuucugggaaaacaaaacaaaacaaagcgacaggcaaaacuguaugaugccgugaaggagaggggugcagcaucauguacagaugcuucuccuuuguuguccugaguaucugaagugucaucuugcagaggccacagguuuguuccugagccacuuaauuccccuuugccaguucugucaccuucccugugguacaguuccugcugcucuuccccaaagugcuguuguguguccccugacagguggcguucaagauguacuugggcaucacuccaagcauuacuaauuggagcccagcuggugaugaauucucccucauuuuggaaaauaaccccuugguggacuuuguggaacuuccugauaaccacucaucccuuauuuauuccaaucucuugugugggguguugcggggagcuuuggagauggugagugcaacucuuuaucuucugggacacccgaaaugcaauagggacuugauaaguguuuaaaugaaugaaagagagaaaagaaagggcuuuggcucaccccagcgcuuuacugccugagauggugaugcugcugagguaggauccaagucggacaucuuuacauggugauacuccuccauaccaggcugguggaagguggugcugucaguccccaaagcccaggaacauccauucucagauaggcuuauuuggugacagucucauucuuggguauucuuugcuaaguuucuccuuaaggguuggagccauugucuuaugcaacagaauguuggcgcugucaaucuuguccuugugggaaaccagccccccuuuuuuggaugcuguggaugagucaguuaugccccauccccacugguucccuagaggcuguggccaggcagcuaccccuucguuuucccacugucccccagguccagauggcuguggaggccaaguuuguccaggacacccugaaaggagacggugugacagaaauccggaugagauucaucaggcggauugaggacaaucuuccagcuggagaggaauaaccaucccuacaacucgaggauagccaucaggagcacuguuggaaucagcaggccucugugcucccucugcccuccagaacucagugacucuugaacauggauguuauauauucuuauaaccuguuuccauucuccauucaaauaaagagcagacugcgauauaguccauuuaccccaugugugcacauucaggagcgacagucucugcccccauucccuugagaggggcuggauguaaucaccuuugguuggacuagaaagagcucaaaccauuuuacauuccuguuugaauuuuuccaaagcaaaacucacuuugaccccauuaagaggcaagccuggcacaucuaucccugggccuuuagaaagccauuugccucaaauggcuauaggguugugggguggagggaggaagggcugggagggaguggggaggaauugcuagcuguagugugacacauuguaguguuugccaggaaaggagccagucaugccggaaacacugacuucugggaagccacccaggucucauuccucccugcuguuggaggcaacaucuccucuuuuuacagaggguacauccuuuuuucuuacaaauucuucaauaaagacacauucuugagugaaaucccaa

SEQ ID NO: 191412 - RNA, 36484 nt, Homo sapiens
ggggucggcggggccguuucgcuucgaagauuguuucagaagcguugggcggggcgucccugagagaaauuaguaagccuccucaugcggcucugguuucggucuuuacuccugcgccuuacucgaaaggggcaggguuucugcugucggucggagggaggaugacgcgccgggucgggguuuuagagacggagcuuugagugcggauuccgccagaugggggucgggaacuccgggccaggcccugacguggauuguguuugccgccuccuuuaaccuugcccucauagacuggggggguuagugcuccccgcuuccagcgauucucgccgccuccugcuccuguguaguaacugggccuucagacuuuagucucgcuccgcagccuccguuucagaagccccaucacaccuguaucucuccuucauugagcagugauuuuucaaaaguuugacuccuggccgggcguggugccucaagccuguaaucccgacacuuugggaggcccaggcgggcggaucucuugaggucagaaguucgagaccagccuggccaacauggcaaaaccccgucucuacuaaaaguacaaaaauuagcugggcuugguggcaggcgccuguaaucucagcuacucaggaggcugaggcaggagaaucgcuugaaccgggaggcagagguugcauuuagucgagaucgugccacugcacuccagagcgagaccccgucucaaaaaaaaaaaugaaauguuugcugaaccccaaaagcacaguuugaacgcugcugauuuacaagauuaauuuuaagguauuugguaucagggaccuuccugacaugacccaugucuacuuuucaaacuuuccaguuccuucuacuagcacucuugcacuuguacuuuaucugcaacaacagucccacuccuucuaguucccauauauuugugcuucuuuuuuuuuuuuuuuuuuuggagacugggucucgcucuuuggcccaggcugagugcagugacacgaucacggcucacaagcagccucagccuuccgagcuuaagcgauccucccaccucagguuccagaguagcuggaacaacaggugcuccccacuacgcccagcuaauuuuuguauuuuuuguagagacagguuaucuucauguugccuaggcuggucucgaacuccugaaucgaagcaauccaccugcuugggccucucaaagugcugggauuacaggcuugagccacugugcccggcuauuugugguuuuguacaugcugucucuauaccaggaauauccgccaucauugguugguagacacuuuaaaacccagcucaaauuucaccucccagaagacugaccgucuucuuuuuucauuucuucucaguaccuuguauauacuuacugguugggacauccuacucaucaguguaacccgguaccaaggcacuucggaaaugauggcucuucauugccugcagaauuaaccauggacauuuuaguuugguuugaaaaacauauagccuucugccuccagccuucccaucaggcuaguaaaagaccuugcagaacucaguugaauaaaauaauuuuuuuuuuuugagacagcauuucacucuugucucccagacuggagugcaguagcgcgaucucagcucacugcaaccuccaccuccaguucaagugauucuccugccucagccucccaaguagcugggauuacaccacaccuggcuaauuuuuguuuaguagagacaggguuucaccauguuggccaggcuggucuagaacuccgaccucagcugauccacccucucaaagugcugggauugcagacaggagccaccgugcccggccgaauaaaauaaaucuuagcaaaguguaauguauaaagaagugguauaaugcgaagaaauaagggauaggaguauaucugcuuccagacucuguuuuguuuuugcuuguguccauaccacacuaucuuaauuuacuguagcuuuauaagcccuuccaacauuuuuuuuuuuugauauugucuugguuaugcuaggcucuguaugcacauuguauauacauuagaauuaccuuacaaauuccacaaaaaccccugcugggauuuucaucuacagcuuaauuaggagaaaaauuaauauugacucuuuccaucaaugagcauuuauuuagaucuuccuuaauuucucucagcaauguuuuguuuucacuguagaguucuuuaauagcuuucauuagauuuauuccuauauuugauauuuaugaugcugcagaaaaugguuauuuuuauauuuuucuguucuaguauaaagaaauaaaauugauuuuuuguuuguuuguuugagacggagucgcacugugucacccaggcuggaaugcaguggcacaaucucggcucacuguagccucugacacccagguucaagugauucuccuguuucagccuccugaguagcugggauuacaggugcccaccaccaugcccagcuaauucuuuuguauuuuuaguagauacggguuucaccauguuaggcuggucuugaacuccugaccucagguaauucacccaucucugccucccaaauugcuaggaugacaggcgugagccacugcaccuggccaaaauuuauuuucgaaugucuugcuaagcuuaauaacuuggagauucuuuugaauuuucuuuguauagaaucaugucauccaugaauaauaacaauuuuaacugccuuuucaaaguuugucuuuuauuuuuucuugcuuuauugaucuaacuagaacuucuacuacaauguugaagauaagugauaagaaaaauucuaaaaugcggaucuuguauuauccuauaauucugcugaauucacuuauucuaauaguuucuuuugcggggggugaguugggggagguuccuuagaguuuucuauaugcagucaugucuacaaauaaaaaguuuucuuccuuuccaacuuuuuuuuuuuuuuaaauggagucaugcgcugucacccaggcuggagugcaguggcaugaucugggcucacugcaaccuccaccuccuggguucaugcaguucuccugccucagcuucccgaguagcugggauuacaggcgugcaccaccauacccagcuaauuuuuguauuuuugguagagaugggguuucaccauguuggccaggcuggucacgaacuccugaccucaagugauccgccugccucagccuccuaaaguguugggauuacaggcgugagccaccacgccuggccugcuuuccaacuuuuaugcuaaauucccaucuacuauuuuacuuuagcuuaaagaauuuccuuuaguggccgggcgugguggcucaccccuguaaucccagcacuuuggaaggcugaggcggguggaucaccuggggucaggaguuccagaccagccuggccaacauggugaaaccccgucucuacuaauaauacaaaaaauuagccaggagugguagugcaugccuguaauccuagcuacucaggaggcugaggcaggagaaucacuugaacccgggagguggagguugcagugaccugagauugugccauugcacuccagccugggcagcaagaguaaaacucugucuccaaaaauaaaaaaagaauuuccuguagcauuucuacaguguuuucauuugucugaaaaugucuuuauuuugcucuuaaucuugaaggauauuuuuacugaauauagaauuuuaaguagauuuuuccccagcacuuuaaagauauuacauuggcuucugggguuuuauuguuucuuuucuuuuuuuuuuuuaagacagggucucacugucccccagacuggugugcaguggcuugaucacagcucacuguagccucacccucccggcuuaagcagucuuaccaccucggccucccgaguagcugggacuccagaugcauaccaucauacccagcuaaucuuuuaauuguuuuuagagaugggggucucacuaugcugccaggggguggccucgaacuccugggcuaagcaguccucuguccucuaccucccgacauguucaaauugcaagugugaaucaccacacccaaccuuagugcuuuuaagauuuucuuuuugguuuucaccaguguaacuaugacaugccuacucgcguuuuucuuuauaucuuauuugugauucacagagcuugaauucaugugguuugauguuuuucuucaguuuuaggaaauuguccuaaaaaauuguagguauuuuuuguuuuuguuuuuuuucgagacagugucucagucugucaccuagguuggugugcaguggugcgaucauagcucacuguaaccuggaacucuuuccugggcucaggugauccuccagccucagccucccacauagccuguacuacaggcauccaccaccaugcccagcuaauuuuucuaauuucuuuguagagaugagggucucacuaugucacccaggcuggucucgaacuccugggcucaaacuccugccuuggcuucccagaguucugggauuauaggcgugagccaccuugccugguauuuucuuucaaauacugcuucuuuugcauugucuauuuucucuuauccuagaacugaauaagagaucccacguggcacauuauucuagauucuuauucuagaacugaauaggaaucccacauggcacauuauuucaauuuuccauccuuuuaucucugugcaucaguguaccuucuagcuugucuucuucacuaauuugauauucaucgauugaauucuuaacuuccucacuguguuuuccaauucuagauuuuccauuuaacuuuuuuuuuuuuuuuugauggaugccaggucacuacagaacuucuccaucuuuccucuguuuucucaaacauaaccaaguccuugccugacaagaacaauaucugagucaccuguggguuuguuucuauugccauuuuuuuccagucaguuuugggauuuuaaaaauuccucuuaguccauaaauuauuacuggauucuggaaauuuuggaugaacauuauuagcauccggauguacuuccuucaaagcagacuaagguugccauuaggcacguggauaguaguagcagaugacauugauccuguugaggguugauuauaggucuuguuaagacuggucuauuucaguuuguccuuucuucuuggaaguggucucuuuuccuccuggggcauagccauuacuccuagggcaaggcccuccuugagucucaacccgaaauccaggucuuuaccaaaaccccucuaucuugcuggucuuaaauuucaacucucaacucagcauagcugcuauaaucuuauuagcucuuugacguuuaacugcuguguucuguuaaguuuuugaagucucacucuguaaaugugcaguuuaggaguccgccaaugacuuggaggaggggagauuucuaugcauauuauuuuucuguaguucccuccucucccagauugugccucuugaguuccagcuacuuuagaauccaguacuucuaacugucuccugcuguuuucugcuuggguuuccacuauuuugucauggaaaguccccuuaccaguaaagucuguuaaauuuuguaauuaauuccagugaaaggauuuaguaugcuaaaggcuacucuguuaugccuggauuuauccguuuuuuguuuuguuuugguuugguuuuuuuuuggagacagagucucgcucugucgcccaggcuggagugcaguggcacugucucagcucacugcaagcuccgccuccuggguucacgcccuucuccugccucagccuccgaaguagcugggacuacaggugcccacuaccacgccuggcuaauuuuuuguauuuuuaguagagacaggguuucaccguguuagccaggaugaucucgaucuccugaccuugugauccacccgccucggccuccuaaagugcugggauuacaggcgugagccaccgcgcccggcccccauauuauuuuuacuucaugcuagucuguuaaaaucuggagcucaguugguuuccaaacugcauaggaucugauuaggcagaaaugacuuuggcaggaaggaaagcaguaugaggacaaguaaagugaggagguuaaggugcagcugauucuuugccuugacaucugucucccuuucccucuggcccaaagaggaggauaguguuuucuccugugguuguuguagaucucccuuuggcugcagcuguccuuuccugacccugaaaccaccuccaugacuacauuccagcuucagggacaauagccuccuuccuugaacagucauuccuagagcucucuugggccugcccuuucuugccuuugguguggcacaugccagccaccuagcucuaauagggaauuauuguuguuaaaucaguauucuguaccccucauucccagccuaguuuugaaauguacuugugguuggagugcuagguucacacuggccccuagcauuugugggguccuugcuaagaguaugaauggaagcccacauacucugugucuaaauauuuaaaaguuauaaauuaagcuaacacaucguggaauaaaaugaguuccauccuccugccgugacaaauacaccuuuguaaugaccaaauagaaaaacacguguaaagcugugguuuucaggacugaaaguaagcaaauuuucaaugaugacagaauucaauuuuauguauuacguuuaaacauuguauuuggguuacucaugguaaauuguuaucacagaaaauauugaagauuugaauuucauuauauaaaucacugucauucauaauguggcuuuuuaaaaucauuucuucaagucauauuuauauucauacagaauuuuaagguuuuuucccaaaauuuucaauauauacagaauuuuaagguuuuuucccaaaauuuucaauauuggguuauuaguuuauuuuauuuauuuauucugagauggaaucuuacucugucacacaggcuggagugugguggcgcaaucauaucucacugcaaccucugccucccagguucaggugauccuccugccucagccuccugaguagcugggacuacagucugggcuauuuauaaaaagcagaaaaugacuguuuguugcuaaauuuguucaacucugucuccaaucaagauuguaacuuaaucuguagcaguaaaaaaaauagucucuauauaaauuaguuuugagauuauaugucugugaaucuuauucaucgucaugcaguuuccuuucauuauuguaacugccuuauauuucauugaaaucucaugcaauuuuuuuuucaauuaaaaaauucuuuuuuuuucuuuugagaugcaguuucgcacugucacccaggcuugagcgacagugagcuugaucucagcucacuacauccuccaccuccuggguuuaagcaauucucugccucagccucccgaguagcagggauuacaggcgcccaccaccacgcuuggcuaauuuuuuuuguauuuuuaguagaaacaggguuucaccaucuuggccaggcugauuuugaacuccugacccugugauccacccaccucagccucccaaagugcugggauuacaggcaugagccaccgcacccagccuuuuuuuuuuuuuuuuuuuuuuuuuugagauggagucuugcucugucguacccaggcuggagugcaguggcacgaucuccacucacagcagccuccaucucccaggucaagagauucuccugucucagccucccaagagcuggaacuacaggugugugccaccacaccugacuaauuuuuugaauuuugaguagagaugggguuuuaccauguuggccaggcuagucucgaacuccugacuucagguaaucugccugccucaggcucccaaagugcugggauuacagaggugagccacugugcccgcccaaaaauucauuuuuuaacaguaguuugaaccaucaggguuauauaaauacuauuguacuaauuuuccaggaggaaucuggaugauauccccuggaggucuauauguguaucuggaaauaacucuugaaacuugcauuuucuuuuuuuuuuuugagauggaguuucgcucuucuugcccaggcuggagugcaauggcgcagucucaguucacugcaaccucugccuccugggugcaagugauucucuugccucagccucccaaauaacugggauuacaggcaugccccaccacgcucggcuaauuuuuuguauuuuuaguagagacaggguuucuccauguuggucaggcuggucucgaacucccaaccucaggugaucagcccgcguuggccucccaaaguucugggauuacaggcgugagccaccacgccuggccucgaaacuugcaguuucuuugugaucucguguuuuacuuuaagaaugaauaugggccgagggcaguggcucaugccuguaaucccagcacuuugggaggcugaggccgguggaucaugaggucaguaguucaagaccagccuggccaagauggugaaacccgaucucuacuaaaaauacaaaacuuagccaggcaugcuggcuggugccuauaaucccagcuacucaggaggcugaggcagauaauugguugaaccugggaggcggagguugcagugagcugagauuaugucacugcacuccagccugggugacagagagagauuccaucucaagaaaaaaaaaugaaugugaauuuuguugucugcucuuaucauauuucucucuuugguuuaaauuaaaauauuuuauggcugggcgcgguggcucacaccuguaaucccaacacuuuggguggccgaggcaggcggaucacaaggucaggugaucgagaccauccuggccaacauggugaaaacccgucucuacuaaaaauacaaaaauuagcugagcuugguagcacgugccuguaaucccagcuacacaggaugcucaggcaggagaaucgcuugaacccgggagguggagguugcagugagccgugaucguaccgcugcacuccagcaugggcaacagagugagacuccaucucaaaaauguguuuauguguauauauauauauauauauauguguguguguguguguguguguguguguguguguguguguguguguauguacauauauguauauauauuuuauauuacuaccaaguaguauugcccagcaggaagaugugcaacauucauccuuugacuauuaauaccuguacucuuucauacuaugauuuagcccuaguuuggaaagaugaguagggcuauauuaaaagaaagucuguaggacuuauuuuacucuaaugugcaucuuguuggaaaaggaaguaauggaucugucacuaauacauguuuugcucuucuuauagccaaacaaauguugcauagcauuuucccuugccucagaaauuuucaggaugcuuuccuuuuuuuuuuuuuuuuuuguuuuugagacagagucucacacucuugccugagcuggagugcaauggcaugaucucggcucacugcaaccucugccucccagauucaagcaauucuacugucucagccuuccgaguagcugggauuacaggcgcccaccaccacgcccggcuaauuuuuuguauuuuuuaguggagaugggguuucacuguguuggccaggcuggucuugaacucccgaccuccucauccacccaccucagccucccagagcgcagggauuucaggcaugagccacugcgcccagccuccacuauuuuuauguuuguauggugacacauuugaaggaguugcaagaugccaaagcucauagguacuuuguuuuguuuuaucuuacgaauaacaauaauuguaccucacguaaaccucauuggcugugauaccgccacugcacaaaacucggugcuuuguuuuuaauugauguuuaagacuugcauggcauguguacuuucaggugaagggaaucuaccuaaugacaaauaguuaauuuuuagugaguuuugcuuuacuguuuguguauaaugcucaaaugggcuggacagaggcuguaugagcuauuuauugcacuugacucucaggccuuauuuaacuuucugcauugggauaggaacuuucaacaaaagcugagcuaaagauggaaaugagggaaggugguugagccccaaucacagaaauaaaaaauaauggcagaauuacuugggucuuucauguacuaacccagaauaaaaccauaguccuggaauuacuccuguaagagguuuuuuguuauuuuuuucuuuuuuugagcccauuauucuaagugauccuguaacaacuucaacuucuccacauuuguguuaguuaucaucugcccuccauaaugauuaguuguaaggcuuuuuuuuuuuuuuuuuuuuuuuuugagauggagucuuguucugucacccagacuggagugcaguggcaugaucuugguucacugcaaggucugccucccagguucacgccauucuccugccucagccucccgaguagcugggacuacaggugcccgauauaaggcucuuuuuuuuuuuuuuuugagacagagucucgcucugucgcccaggcuggaguguaguggcgcgaucucggcucacugcaagcuccgccucccgggcucaugccauucuccugccucagccucccagaguagcugggacuacagacaccugccaccacgcccggcuaauuuuuuuguauuuuuaguagagaugggguuucaccauguuagccaggauggccucgaucuccugaccucgugauccacccaccucggccuccccaagugcugggauuacaggcgugagccaccgagccuggccuauaaggcucuuuuuuaaggaucuaggagacaggaagacuugcacucugaagccaagcuaggguggcaggaagggaaaggguuccaaaggauuuagaaucagagguaacagcuaccagauaaguggaaaguaggccucagucaaggaaaaaggagaaaagaaggaaccaaucugucuuugaaaaagagaccuugcugggagggauagcauuagaagcuauaccuaauauaggugacagguugaugggugcagcaaaccaccauggcauguguauaccuauauaacaaaacugcacguucugcacauacaccccagaacuuuaaugaaaaaagaaaaagagaccuugcuuucguaguuccucaaaaguuguaagauugaccaaaaaggaaucuauugauuuggauagugaggagaagcaggcaggcaugugugaugggaaaauagacuuaagacuuauuugacugggugugguggcucacaccuguaaucccagcacuuugggaggccgaggugggcggaucaccugagguugggaguucgagaccagccugaccaacauggagaaacccugucucuacuaaaaauacaaaauuagccaggcgugauggcacaugccuguaaucccagcuacucgggaggcugaggcaggagaaucacuugaacuugggaggcugugguugcagugagcugagaucgcgccauugcacuccauccugggcaacgagagcaaaacucuugucucaaaaaaaaaaagacuuaauuaaaagguagauugaucuaauuucauaauuagauuuagggagaagaagaauaauuccagguuaauccuagauuucuggcaugggaaauuagguauaugacacugcuauuuaccaaaaaaaaggaauaucuguaaaacagguuuguggggguaauaaaagaauauaguuuuacugaggcaagaggauugcuugagaccagaguucaaaucccuugaguuugagggaccuguggaacauucaaguggagauauuuauuuauuuauuuauuuauuuugagacggagucucccaggcuggagugcaguggcgcgaucucggcucacugcaagcuccgucucccggguucacaccauucuccugccucagccucccaguagcugggucuacaggugccugccaccacgccuggcuaaucuuuuuuguauuuuuaguagagacgggguuucaccguguuagccaggaugaucuugaucuccugaccucaugauccacccgccucagccucccaaagugcugggauuacaggcgugagccacugccccggccaaguggagauauuuaauaggcaauuagguauaugggccacagcucaggaauguuggggaaaaacagcccauaggugauaguugaaucugagguugugaucauaggcugggagcagauggacaccugucguugaagcacuuugggaggcugaggugagaggaucacuugagcccaggaguucgagaucagucugggcaacauagggaaacaccuucucuacaaaaaaaaaaaaaaauuaccugggcacuguggcacaugccuguggucccagcuacgugggagacuaaggugggagaauugcuugaucccaggagggugaggcugcagugaacugagauagugccacugccugagugacagagcgagaucuugucucaaaaaaaaaaaaaaaaaaaaaagagaaaaagacuugguuuuuguuuguuuuguuuugagauggagucucgcucugucucccaggcuggagugcaauggcacaaucuuggcugacugcaaccucugccucccguuuucaagugauucuccugccucagccuccagaguagcugggauuacaggcaccugccaccaugcccagcuaauuuuuguauuuuuaguagagacaggguuuugccauguuggccaggcuggucucgaacuccucaccucaggugaucuaccugccucggccucccaaagugcugggauuacaggcaugagccacugcgcccggccaaagacuucguuuuuuuguuuguuugagacagaaucucgcucuguuucccaggcuggagugcaguggugcgaucucaguucacugcagccuccgccuccuggguugaagugauucuccugccuuagcuuccugaguagcugagaucacaggcacacaccaccacacucgguugauuuuuuuuuuuuuguauuuuuaguagagacgggguuucgccuuguuugccaggcuagucucaaacuccugaccucaggugauccacccgucuuggccucccaaagugcugggauuacaggcaugaaccacugugcccggccaacaggucuuuucuuuucuuuucuuuuccuuuucuuucuuucuuuucuuucuuuccuaccuuccuuucuuucuuucuuuccuuucuuuuccuuuucuuuucuuucuugacagagucucgcucugucacccaggcuggagugcaauggcgcgaucuuggcccacugcaaccucugccucccggguucaagcuauucuccugccucagccuaccgaguagcugggauuaccagcgcaugccaccaagccuaauuuuuuguauuuuuaguagagaugggauuucagcauguugaccagacuggucucaaacuccugaucucacgugcuccacccaccucagccucccagaguguugggauuacaggcgugagccacugugcccagccaacuucguuauuuuuuuaaagccaggaguucaagaucauagagcaggcaaggagaguacuggggaauuguguuuuuguggaacacaaacauuuuagaagcagguaaaauaaguauuugugagaaauacuggcaaagagguaaaagaccucggaguaagaaaaaugaaagaaauuucaagaauggggaaagggguggucagagagagggcggauagcuuuagauucuagaauguauuuaaaugcuuauauccuggaaucaauaggaggggaagaggaacugaagaagcaaaugagaaggauaacuggagggcagagagggguagugaguacagauuggguuaaccucagauagaaagcuuuacauuucuuuuuuguuuguuuguuuguuuguugagacacagucucacucugucacccaggcuggagugcaguggcucaauguccauucacugcgaccuccaccucccagguucaagcgauucucgugccucagccucccgaguagcugggauuacagguaugugccaccacaacccggcuaauuuuuguauuaguagagaugggguuucaccauguuggccaggcuggucucaaacuccugaccucaagugaucugcccgccuuggccucccaaagugcuggguuuacaggcgugagccaccgacccuggccgaaagcuuuacauuuucuccuauugaaaaguuaaaaauaaacuuguaaguuuuggugguuuuaugcugcauucagucuugggggaacagaaacggagacuauuuccagaagaaggcacagaguugguaguagcuaccagagaaguauagagcaaaacuauauugaagaauaauggaugaaaggaaagaagccaguguucuuucaaugaaggaaccuugaugccaagcugucuaaagacccuuuugugguucuagaaaauuaccauauuuaaaaggacuaauuuuaaaaucaaacucuuuaucaauauuuuauuuuaggaaucuggaaacuguucuucaggaagaaacccauuaguuuggaacuggagaauuccuuugcaucagauacuaaaaugaaagaaccacuuuuagguggugagugugacaaggcaguggcaucacagcuggggcugcuagaugaaauuaagacagaacccgacaaugcucaaguaaauauuuucccuuauuuccauuauuucuagagcagcauuuaacuauaaauuuuaguuacaaaggugcugaaaugauucauugaaaaacucaaauccuuaucuccuccaaagcaguuaauuaaauaauacaagguauaugguguuaagugccacuacaaguauauguaagaaaauuauuugaggaaagauuagacuguuuggaauuggguuuuugcauagguaaaaggauuguuuaggguguugugggccuagcuaagguuaacacuuuuuuucuuuugccagauucuacuuccagagaagguuaacacauuuuguuuuuguuuuucuuaacuuaauacaaauuacauuuuuuaaucuaaauuaauuuauguaaauuaaaaaaaauuuuuuuagacauaucacuaaagaaccuauaaaggaugaacugacuugaacugugaguauuguuuaaguagggaaaacauuccuuagaauguuuguauauauggccaggcacaguggcucacaccuguaaucccagaacuuugggaggccaaggugggaggaucaccugagcccaagaguuugagaccaacuggaugacaagaccuugucucuauaaaaaauacaaaaauuagccaggcauaguggugcacgccuguagucucagcuacuucagaggcuacaacaggaggaucgcuugagcccaggaauucaaggaagcaaugagcuaugauugugccauugcacuccagccuggguaacgaagcgagacccugucucuuaaaacaaaaaaaaggaauguuuguauaugaacugugaaccagcugaaaguucuaaugaaagaaaaaaaucacuaaaaaggguaauuuauuuguaguauucuauuuagaaauagccuaaaguagauuaauauuaaauaaggguaugcuuaccauugaguuguuaacacuggggaauguuacucaucuaggaacuaucuauugcuucuucaugccauggacauucaggcauagaucaaguuuagauaugguggcuaugaaauugccuccugcucugaaaaaauuguccuuuguaagaaucauucugcccaauuaacaauuucuuggguuaaggucuuuaugaagacaauuagcuguuaaugauuagagcaagcagggaaggcugggugugguggcucauuccuguaaucccagcauuuugggagggugagacaggcagaucacuugaggccaggaguucaagaccaugggcaacaucuccacuaaaaauuaaaaaauuagccgggcauggaggcaugugccuguagucucagcuacuugggaggcugaggcagaagaaucacuugaacccagaaguagguuauagugagacgagaucgcgucacuguacuccagccugggugacagagugagaucuugucucaaaaaaaaaagaaaaaaaaaaaaaaacaaguagggaaaauaguuguaauucaauaugucugcucccuauugauagugaauggagggauuuuguugacaaagauuuugaugucacaccuggauaccauagaaaauaauguauugggugauuaguguugucagccaaagagcaccaaaaggguagugcauaccuguguauuuugguucaauucaguuauacaauucauugaccagacuugaccacaauuuaucauuuucuguugaaugacugguugucuuaaauucauuguauucacuauuuuuaauuauuauuuuuuuuuucuuuuuaggaguauugucauaggcaacaguccagaacucaggagaaugaacugaaaauaaaugcuguguuuucagagagugguaauagaauuauuuaaguuaguuauguuuauucagaccaauacgacagcugauucauucuuuuuuaaugccuuugaauauugcuuuguuuguguuggguuuuaaguccaggagaaguaaccuguaagaaaaugaaagagaggccgugcacaguggcucacaccuguaaucccagcacuuugggaggccgaggcaggcggaucaugaggucaggaauucgagaccaguuuggccaacauagugaaacccugucucuacuacaaauacaaaauuagccaggcgugguggcgcaugccuguaaucccagcuacucaggaggcugaggcaggagauuugcuugaaccugggaggcagagguuguggugagccaagauugcaccacugcacuccagccugggcaacagagcgagacucugucuaaaaaaaaaaaaaaagagaagaaaaucaaagaggcugggcauggugccucaugccuguaaucccaacauuuugggaggccaagguggaaggaucagcuugagggcaggaguuugagaccagccugggcaacauagcgagauccugucucuacagaaaauuuaaaaaccaggugugguggugcaugccuauagucccagcuacuugggaggcugaggcgggagguuuuuuuuuuuuuucugagauggaguuuccgcucuuguugcccaggcuggagugcaauggcacgaucuuggcucacugcaaccucugccacccagguucaagcagugcuccugccucagccucccaaguaacuaggaucacaggcccgugccaccacacccagauaauuuuguuuguuuugagacggagucucgcucucgcucuguugccaggcuggagggcagugcaugaucucgccucacugcagccuccaccucucagguucaagcgauucuccugccucagccucccgaguagcugggacuacaggcaugugucaccaugcccagcuaauuuuuauaguagagacgggguuucaccauauugcccgggauggucucaaucucuuaaacucgugauccacccaccuugccucccaaaaugcugggauuacaggcguuagccaccacaccuggcuaauuuuguauuuuuaauugagaugggguuucaccauguuggccaagcuggucuugaacucugaccucaggugauccaccugccuuggccucccaaagugcugggauuacaggcgugagccaccgcaccagguggugagagggucacuugaguacagggugucaaggcugcagugagccaugaucguaucacuacacugccuagagugcaaaagagggcaacagaacaagacccugucucuaaaaaaagaaagaaagaaaauaaaggaaugccuacuuaauuuuguguaaauaacaauuuuuuuuucucccucuuguguuuuuauagcuucacaguugacugcaggcauucagcuuucucuggcaucaucuggcgugaauaaaaugcuuccuucaguuucaaccacagcuauucagguuuccugugcugguuguaaaaaaauucuccagaaggggcaaacugcuuaucagaggaaaggaucugcucaacuuuucugcuccauaccaugcaucacugaauacauuucaucugccaguucaccaguuccuucuaagagaacuuguucaaacugcucaaaguauauaauucuaaauuaugcccccuuuuauuucccuaccuuguucuugaucauagucuuaguuguaauuucuacauuuucuuuuuuuauuuuuugagacugaguuugacucuuguugcccaggcuggagugcaguggcacgaucucggcucacugcaacuuccaccuccuggguucaagcgauucuccugccucagccucccaaguagcugggauuacagccaugcaccaccacgcccggcuaauuuuguauuuuuuaguagagaugggguuucguucgccauguuggccacgcuggucuugaacuccugaccucaggugauccgcuugccuuggccucccaaagugcugggauuacaggugugagucacugcgcccggccauuuucauuucuuuugaagacgugucgucuugguuuaguaaaaagaaguuuuuucuacuuuuaguuccucugauggauucuguagaaauauuuuuuuuugcagaaauuaaugugaaaaguacuguuucucuucaccuuuacucuuuucauuugaaauucucuguaaaugggauuauuguuuauccauucuguucuauuuaacuguauagggagcaaccuacuaaaaaauuaauccuaugacaguuaguuuggauuuuccaagauguggaauaauauuauauuucuuuuauaaugguaaaugaagugauucuuuugaaaaauugauggccauagauaaaccuacaugucucuauguaaucuuuuaaaaauuuaugugagaaugugugaagaaucagugucauuuuggcuuugagaguccuaaggcuguauaauuaugguuguuagcacuuaggauaugcuaauuuuuaaauguucuuguucagaacaagaaaauccauaggcaaccacagugcuucuaaauauaacaaauuucuuucaaauaauacuuguuuuggacucagguugccauaauuugaauuuugcuucuucuguuuaguuauauuuuacuacucaaaguuucaucccugaguugcuagaucagcaucacccaagaguuuguuagaaaugcacuuucucaggcugggagcaguggcucacgccuguuauccuagcacuuagggaggccgaggugggcagaaugccugagcucaggaguuugagaccagccuggcaacacagugaaacccugucucuacuaaaauacaaaaaaauuagcugagcacuguggcaugcaccuguaaucccagcuacuugggaggcugaagcaggacaauugcuugaacccgggaggcuaaaguugcaguaagcugagaucaggccacugcacugacugucucaaaaagaaaaaaaaagaaaugcacuuucucaggucuuacccagaccugcugauucagaacugcauuuaucgccaugugauuccuauacaugcuaaaguuggagcaguauugagaacuucuuuguuacuuaguauucguaucuguuuuugauaaauguacaaaagaauuaugagcauuaaauaguauauuuaaguggucagaacaauaccagcauguaguaagaacucaauaaauguuaacuauuauuauucucuuaacaaacucacaaacccuuuugauggguuugcuucagcuccucuggcugcugcuucaguuauuaucuguugcuucaggucuuauuccauggcacguuacuuaccauucucuuuugcuuuucaacccuucaauacuauacuagucuuuugucuuuuuacuuuuuugcuaugggccauauaguacucucuucagccugcuuucucucccugcagagucauaaaacuggaagggaccuuagagacucacuacacaucuucagcagaugucccagacagauugaaaaaggcugaagcaggaaagauuuaguguguaaguucuccuaggcauggaaauccaauaugaguaaaaaucugagauaaguuuuacuuccucuagaauaaaauuuuuuuauaaaaaauauuauauuguaguggguagaaagaugguaguaaauuuuaggcuggaaaaggccauccaugauucagaguaggcugcuuuuuucaaaacuuaaaaauuccacauuaauuagccuuuuacauaaauuuuagcuauucuucugggguuuuuuuaucuuccagugaaacuauccugaacugaaaauaauuuucaguuacuuauuuauuuauuuuugcagagacagagucacuauguuucccaggcugaucuuaaacuccugaguucaagugauccuccugccuuggucucccaaagugccgggauuacaggugugagccaccgugcugauuuucaguuuuguuuguuuguuuguuuuguuuuguuuugucugagacggagucucgucucaaucugucacccaggccagagugcaauggugcaaucuuggcuuacugcaaccuccaccuccuggguucaagcaauucuccugccucagccucccaaguagcugggauuacaggcgugugccacugugcccagcuaguuuuuuuauuuucaguagagaugcaguuucgccauguuggccaggcuggucucgaacuccggaccucaggugaucugcuuuccucggccucccaaagugcugggauuauagguaugagccaccacgcccugccugauuuuuaguuacuuuuuaagauuucuuuuauaggaaugauuuaauaucuguuuugagucaaugcacuuuuuauucuauuucauggaccaaauggaagaucccuuugaagaugacauuuuaaaucuuauuagaaagaugcgauuugugggccaagcgaggugguucacaccuguaaucccagcacuuugggaggccaaggcaggagaaucacuggaggucaggaguucgagaccagucuagccaacaccacaaaucccugucucuacuaaaaauauaaaaauuagccaggcgugguggugugugccuguaaacccagcuacaccagugacugaggcaggagaauugcuugaacccaggagacggagguugcagugagcugagauuguacgacugcacuccagccugggcaacggagugagacccugucucaaaaaaaaaaaaaaagaugugacuuguucuugggaacuuuguauuuaagaagugucauuucuucacuuuaguaucucaguuggaaccaaccgcaaauccugaaugcaaucaauaaaguccaaaauaggccccugcacuaagguuugauuuauuuaucggaaaguuguuccuaauuuguuggcguuucuuuuuuuuuuuugagacaaggucccugucugucacccagguuggagugcaguggcaccaucuuggcucacugcagccucgaccaccugggcuuaagcaauacucccaccuuuacccucccaaguagcugggauugcaggcacaugccacccugccuguccaguuuuuguauuuuuuuguagagaugauuucaccauguuguccagacuggucuugaacuccugggcucaagugauccuccuggcuugcccucccaaagugcuggcauuaugggcgugagccaccguacccagccaacauucuuuuuuuuuuuuuuuuugaggcggagucucaccguuuugcccaggcuggaguucaauagcgggaucucagcucacugcaaccuccgccucccagguucaagcgauucuucugccucagccucccuaguaacugggauuacaggugccuaucaccaugccccguuaauuuuuguauuuuuaguagagaugggguuucaccguguuggccaggcuggucucccaacuccugaccucagguaucugccugccccagccucccaggauuacacaugugagccaccgugccuggccaacauucauuuuucaauuuuuuauaaagcuuuaguagauucuuagaagccagcaaucuaguaugcugauagcaauaaaaacuaagaagcauuuucagacuuccaugcgucgcugauguaguuucuucuuccucccuucccaucuggcugguaucuuuauucugucugaaagguaugccucaaauaucuuuaccuuuugucuauucccacaccauuccucacucuccucuuacaaccgcccaccccccaaauuaauucuucuguggucugugauuuuacagugucguguucauaacucccaaaacauugaucacaaaauacuaauguuuuuaaauauuuuuaguagagacgggguuggccaggcuagucucgaacuccugaccucaagugaucugcccaccuuggccucccaagauuaaaggugugagccaccgcgccugcuauuagguguauugauauuuucuauaguggcuguucucaaacuuucuggucucaggacuucuuguacccuuaaaaauuauugaacacccaaagagcuuuaguuauguagauuaugaauauuaacuguaucaaaaauuaaaugacauuuuaaaugaaaaauacccauauuuuuaaaaauugauaaguauuguuuuaucaguuuugcaaaucacuuuacaucuagcuggauuuuuguaucuguuucugccuucacuuuauugcaaaguguuguuuugguugaagucugaagaaaaccuggccucauaaauaggugauuggaaaaggggggaguguuuuaguagccuuuuagaucguuguggguguucuuugauacuacaaccaaaaaucaagugguaguuucuuaaaggcuaguugcaaugugggaucaaacuuuuuguaccauguggaucagugaacuuuuugcacucuguuauguuagaauucguuaaucuaucuuguacuuugaauggaucuuuuacccgugaaugauuuuuguaauaugcuauuguaguuuggaaaauacugguucacugaguucugcagaucuucuagauguucucauuuuauuaugcaguauuuuaaaaaucaccacuaaucucagaaaaguuuuuaaguuuuggguaucgaucaaguugaaguuggaagauacaaguuuuccaaaauucuaauuaucacuugaaagacaaaauuuuauuguuggcgauaaauacugucguuuuacuugaagugacagucucauuuuuuucauuuucaagaaaauaucugcagauacccacuucuggauaauaguuugucuuuauuuacaguaaacuguuuacaguacuuucaaguaaaaauguuuuccaugaaaaaaguggcuaauucauuuauaacucaacauuuccauaugggcuuuuccuugagacaaccaucauccuuugguguacagaaguacuuuaugcuuauguccuguguugucacacggaauuuuuuuuucucacccuaccacuuggccaagacagaauauuuuuuaaauguacuuaaggaugaaguuuaaauaauuuaaaauauuuugcuguuucauugaguacuuccuuaagugaaacugauacuuuaaaaagaauuuuuuuuggcagugaauguauagcagggaauaacaugaauauuagcacauuuuggugccacugccuugauuucugcuaaggcucugacgguuuuacccaccauugccuuuuuucuuuuccaaauucauugaagugaaauuuguauaccaagaaauuaaccauuucauuggcauuuaguauauucauaauguugugugaccauccccucuaucuuguuccaaaacauuuccaucacuucaaaguaaaacaccuuaaacacuaagcaguuucuccuaauuucccucuccccccagugccugucaaccaccaguaugcauuauaucuauagauuuuaucuauccugaauaucucauguaaauggaaucauauaugaccuuuuugugacaggguauuauuacucuguugcucaggcuagagugcagugacuuuuugugucugguucuuucccuuagcauaauauuuucaagguuuguccauguuguaacauguaucaguacuuuauucuuuuuguuaauaggcgaauaauauuccacuguauguauguaacacaaugugcuuauucauucauucacuuacugaugaacauuugggcuguuuucaucuuuugaccauugugaauagugcuguuaugaauaugcacguacaugugcuuguuugaguaccuguuuucaguuuuuuuggguguuuaccaaggagugggauugcaggguccuaccauuagcuuugcaacaucaguugcaaagugauguugcaaacaucaacacggugaaaaagcaaauaacaucuuacuaugaaaauaguuuugaucuuggggacucccccagggauuugaagaccauauuuuaagauucucuguccuauagauucuagaguugcucaugugaauaugugaucucucaucaucccucgguuuucacuagcaccaccuaauaauacaggcuggcuagucuccaaaacuacaucuucaaagucaggcauggugggauuaugugccuguaauccuagcuaugugggagauugaggugggagaaucucuugagcccaggaauuugaggccagcuugggcaacacagcaagacccuaucucuuaaaaaacaaaacugcacuauuagaugugcuuuauaaucuguaauguauagaugagaaaauuaaaauuuagggaguauaaaugugacagaacuggguaccaaauucagguuuucuuauuucaaggcuaauguucuuacucuaauuugagaggucauuucauuuauaaagagaaguuauaauuguguuuaaacuguuuaaugauguccuuguuauuuauucuuagagacauuuuaaauccaaaggaugugauuaguguccagcuggaagacacuaccucuugcaaaacuuuuugcagccuaucuugucuuucaucauaugaagaaaaaagaaaaccauuuguuaccauauguacuaauagcauuuugaccaagugcagcaugugccagaagacugcuauuguaaguuccaauuauaaccuuuacagggauucugaugauucugcuuaaauaucagaguuuuuacugaaucuuuuuauuaaauccuagauucaguaugaaguaaaauaccaaaaugugaaacauaaucuuugcaguaaugccugccuuucaaaguuucacucugcuaacaacuucaucaugaacugcugugagaacuguggcacuuacuguuacaccagcucuagucugucccacauacuucagauggaaggacagucucauuacuuuaauaguucaaagaguauuacagcauauaagcagguaugaauaaagaccuauuguuucuucuauuaacuggccuaugaaugguuucacucuaggaaaaugugggaaguaguuuuugguacccuuuggaauaaugucgauaaguugaugaagaugaaauagaaggcuuuuaacgguuucuucuugcauaagaauucaugauaaaugcuauauggagauuuuccuaaauaaucucagaucgauuaucucaccuuaaagaaaaggcaggcaggcuggagccgguuuauaaacuagaaauaaguauagcaaaaauaacaauagucugcuggucaauaaaacccaaacacaaaaguauuuuuguuuuuauuuuuauguauuuauuuuauuucuuucuuuuuuuuuuuuuuuuuuuuuuuggugagauggagucuuccucugucacccaggcuggagugcgguggcgcgaucucggcucacugcaaguucugccucgcggguucaugccauucuccugccucggccucccaaguagcugggacuacaagcacccgccaccaccacgccuggcuaauuuuuuguauuuuaaguagagaugggguuucacuguguuagccaggauggucucaaucuccugaccucgugauccaccugccuuggccucccaaagugcugggauuacaggcaugaaccaccacaccugaccuuauuuauuuuuuuugagacggagucucgcugucuugcccaggcuggagugcaguggcacaaucuuggcucacugcaaccuccgccucccagguucaagcaauucuccugccucagccucccaaggaacugggauuacaggcguaagccacugugcccagcuauuuauuuuuuuuauuuauuuugauuuuuuugagacgaggucuuugucagccagcuuggagugcaguggcaaucauggcucacuguagccuugaccuccuuagcucaagugauccucccaccucagcgucccgaguagcuggaacuacaggcacacaccaccacaccuggcuaauuuuuaauuuuuuuguagagacaagcucuuacuauguugcccaagcuugucuuacaacuccugaacucagcugauccuccugccuuggucuccuaaggugcugggauuacagaugugagccuagccauguuuuuguuuuuaauuccacguguuuaacucuuacaccaaacaaugcaaagaugaaucaagaaugucacauguggacagucaugguggcuuacaccuguuaucucagcacuuugggagaccaaggcgggagguucaguugagccaggaguucagaaccagccugagcaacauagcaagaaccugucuuuaaaaaaacaaacaaaaaauaucacaugcuuucucugagucagucauaggaggaaauaauccagugagauuaguauuauuugucccuauuucugauagacaagcucugggugggugcuucugagagcagagaaagagcaaaugagaugaggugggacuucuuagauauguugcuuguucauaucauauuuugagacccaacucuaucccuauacagacuuccuuaaaaacaagcaguuggccgggugcaguggcugaugccuauaaucccagcacuuugggaggccgaggcuggccgaucaccugaggucaggaguuggagaccagccuggccaacauggcgaaaacccgccucuacuaagaauaccaaaauuagcugggcaugguggcaggcgccuauaaucccaacuacuugggaggcugaggcaggaaaaucucuugaacccgggagguggagguugcagugagccgagauggcaccauugcacuccagccuaggcgacagagugagacuccgucucaaaaaaaaaaaaaaaaaaaaaaagcaguugaagaugggagucaaaacaagccauaauucaaauagaucauuugugacucacaucuuuucuauggcccccaucuugagaguauccugccuugggaccagaacggaaagcacagaagacuucucccaaaggcaggaaauaauauuccuuuuuuuuucuuucuuucuuuuugacacucaauaggccuuguucuggguuguuuuuuguuguuguuguuguuguuguuuguuuuuugagacggagucucgcucugucgcccaggcuggagugcaguggcgcaaucucagcucacugcaagcuccgccucgcggguucacgccauucucguaucucagccucgcgagcagcugggacuacaggugcccaccaccacgucuggcuaauuuuuuguauuuuuaguagagacaggguuucaccguguuagccaggauggucucaaucuccugaccucgugauccgcccgccucggccucccaaagugcugggauuacaggugugagccaccgcgccuggccggccuuguucuguuuuuaaaagccuauaugccgggcacggugggucacgccuguaaucccagcacuuugggaggcugaggcggguggaucacgaggucaggagaucgagaccauccuggcuaacauggugaaaccccaucguuacuaaaaauacaaaaaaaaaaaaaaauuagcggggugugguggcgggcgccuguagucccagcuacucuggaggcugaggcaggagaauggcaugaacccgggaggcggagcuugcagugagccgagaucgugccacugcacuccagccugggcgacagagcgagacucugucucagaaaaaaaaaaaaaaaccuguauugaguacccaguuguucagcuuaugugauggggcaagacugauuuggguaaacgaguuaguuaacaagcacagccuaacacuuuccccuugcaucugaauguaagacaucaugugacagugauaauggaguaaaucuacaauguuagugaacuauaauccagaauuagaaaaauguccaaauaugugaaucuaaaaaugggguagcuuuuuauuuuuaaaaaguggauuauuagauguaauuguaauuauuuuggccauauguuaauagaauauauuaaguuagccuucccuuaugaauauuaaacuaacuuaauuauaaaugauaccacuauugggccaggugcgguggcucacgccuguaaucccagcacuuugggaggccaaacgggaggaucacuugaggucaggaguucaagaccagccuggccaacauggugaaacuccaucucuacuaaaaauacaaaaauuagccgggcauaguggcacacaccuaauaaucccagcuacccgggaggcugaggcaggagaauugcuugaaccuggggaagguaaagguuguagugagccgagaucauaccacugcacuccagccuggacaacagagcaagacucugucucaaaaauaaauaaauaaauaaaaauaaauuaugccacuauuguugcuuaacguuaaagauuagugaauuguuaagauuucucaaaauauaaaaguuguucauacuaauaaaggauaaaaauagaaauuuucgaaauuauccuuuuuguuuuguugugccuuugccaauauccuguucucucacagaaaaauaaaacguauauguauuuuuuugucuuuguacuuugguggguuuuguuuuguuuuguuuuuguuuuuuugagacacagucuugcucuguugcccaggcuggcgugcaauggcacgaucucagcucacugcaaccuccgccucccagguucaagcaauucuuccaucucagccucccaaguagcugggguuacuugggcgcacaccaccacacccagcuaauuuuuguauuuuuguagagacgggguuccaccauguuggccaggcuggucuugaacuccugaccucagaugaucugcccgccucggccugccaaagugcugggauuacaggugugagucaccgugcccagccugucuguguacuuugcaucuccaaaagcaguuuuguuccaucggugauuuuuuuuuuuuuuuuuuuuuuuuagacugagucuugcuuuuccacccaggauggaggcuggagugcauggugugagcaaagcucacuggaggcccaaccucagguguucaagcaauccuccugccucagccucccauguagcugggaccacaggcaugcgccaccacaccugguuaauguuuguguuuuuuguagagaugggucucacuuugcugccuaggcuggucucgaacuccugggcucaagugaucuuccugccuuagccucccaaagugcugggauuacgggcaagagccaccacacugagccugauguauuauuuuuucuuucuuuuuuugagacagagucuuacucugucacccaggcuggagugcaauggcaugaucucggcucacugcaaccucugucuuccugggcucaagugauccuucccaccucagccucacaaguaaaugggacuacaggcgcacgccaccacacuaggcuaauuuuuuauuuuuauuuauuuauuuauuagagaugagguaucacuauuuuaccagucuggucucaaacuccuggguucaagugauccccccgccucaaccucugaaaguugagauuacaggcgugagccacugugccuaggcucugacauauucugaaauccaggaauauugguuccuguuugacuagaaagaauagguggugagcauaaucuuuacaguaaugccugccuuucaaaguuuauauccuuucuuuugcaugguuacuacuuacugaacucacaguacucuauacuuucuauugcuuguaugcugcuuucuuacaauaugcuuguaauuuuuaccaugaaguuagccuagaaaaacagugauucccacaguaucuuguaagguauuuaaguuaagcacuccuuccuggcuccuccucagcaucgguagacaucuucccaaguuaauucccaagcuaccauugaggacagaucuauaacuauauaaggccuuuguuuauccaguaggcuuugacugccugaaaugaacuucugugaccacuuucuucauugcuuuuuuuuuuuucccuugaaaaggaguuucacucuuguugcccaggcuggagugcagugucacaaucucagcucacugcaaccucugccacccagguucaagugauucuccugccucagccuccugaguaacugugauuacaggcgcucgccacuacaccuagcuaauuuuuuguauuuuuaguagagacgggauuucacuauguuggccaggcuggucucgaacuccugaccucaggugaucugccugcuuuggccucccaaagugcugggauuacaugcaugagccacugcaccuggccuuacugcuuucauagguauuauuauuauugcuguuaaauauaucugauaaauaauaaaaaucauuuucagauuugccaauauucuuuuaguuauugcaaucuguagugucuuuuuaagaaaauguaaaaacugucuuaauuguuauucuuuuuaauauuccaacuaaaagcagugguaauagguucuucuucauuaacaacauaucauauaccaggaauaugaauauuauuuuaaucucuaaacagaaaccugccaaaccacuuauaucuguuccuugcaaaccauugaagcccucagaugaaaugauugagacuacgagugauuuggggaagacagagcuuuucugcucuauuaauuguuucucugcauacaguaaagcuaagauggaaucuucuucagguaauguuuguuuagcaauuguagggguuuaguaauuauuaauaaauaauauuauuugacuuuaauuuauaaccuugauucauuuucaaauuaaaccgacuuuuaaaagucaaaacaaucuaaacuuguugcaaagaacuguuuuucaguauuuuuguauaaaaggaaggcuacuuuaccaccagagauuuaauauuuguaggccaagcacgguggcucaugccuguauucccagcacuuugggaggccaaagugggcagaucgccugaggucaggaguuugagaccagccugggcaacauguugaaaccccgucucuacuaaaaauacaaaaaaaauuagcugggcguguuggugggucccuguagucccagcuacuuaggaggcugagacaggagaaucauuugaaccugggugguggagguugcagugagccgagaucgcaccauugcacuccagucugggugacagagugagacuccaucucaaaaauaauaauaauaaaaauuaaaagauacaugucuuuuuuuagauuauuuaguaaaugaauauauguauguuuacaucaauauauauugagcaccuacugcaaaacaugguacauaggaggcacuuggucaauauagaguuuaauacauuuacaagacugcuuuuauuagaauauagaauguuuuacuuagcccuguuuuguaaaaacaaguuuucauuacauuuuucacaugaaauagaagugauuguaaaugcuuuaagacucaauaauaaaaaagcacaaauaaucugagccaacuaaguauuccaucaaaaagccucauguaggaccaguggugcuauuuacauagaccauagagugacuaaugccucugggauuuguaagucauacaaacuggcuuguuacagaaauuucugcaauaguggcuugggcaccaaccuagcgcuccauugauguuaagguuuaugaauccuggaagaguuugaaauagaugcccauuaggagauucaaucagaaucucuuuucuucaugaguaauuucacagaaaaauuugcucauaauuuuaaacaaauucuuuaaaaggacugggaaauuguguacaaagguaaaagacauaaaauguuggagaaguguaaauuuucaguguaauguuguaauuauaaauacgauacuaaagaaccuggcuauuccuaagcccuaauaaaaauuacuucaguaccuaccaauuccuuaagcuauuagaugcuugcauuauuucuuuaaacaguauuacuaaacaguacuuucugaugauugauuuugccuuguuuauaagaaaucuuuuuauuguugucaguaaguguuguuucuguggugcaugauacuucaacagagcuucuuucuccaaagaaagauacgacuccaguuauaagcaauauagugucauuggcagacaccgauguugccuugcccaucaugaacacugaugucuuacaagguaaaaguugauguuaagauauuugacauaaauauuguuuugucauacuugauaaaucugucuauaugcuaaauuuucuuuuuguuucuuauaugaaauaagcaaauauaguuuaugaugcuauuuuauagguuauaguauauaagaucuugaauuuaugcucuauuuuaacagauacaguuucuucaguaacagcaacagcagaugucauuguggauguaaguuuuaacuuuuuuuaccacugucuuuuuuuaauaagcagauuuuuguuguuguuguuguugagacagagucucgcucugccacccaagcuggagugcaguggcgugaucucagcucacugcaaccuuugccuccuggguucaagcgauucuccugccucagccuccugaguagcugggauuaccagcgccugcuaccaugcccaguuaauuuuuguauuuuuaguagagaagggguuucaccauguuggccaaccuggucucgaacugcuggccucaggugauccgcccaccuuggccucccaaagugcugggauuacaggcaugagccaccacaccuggcccagauuuuuuauauauauauauaauauauacuauaauauauaaaaauauaaauauauaauauaaauauauuauaauauauuguauauaauauaaauauauuauaauguauauuuauuauauauuauauuuauauauuuaauauauauuuuauguauuauguauucauauaugggguguguguguauguuuguagauuguuuaaacagaaguauuuuuuuccucuggguucuucuuuuaaaaaaauacuacacaauuugagucaucugagcaauaaaaauuauuuuuaugacaauuacauaccaaaagguccuucaaacauuuaaugcugaaucuagauugcaaauaaauaaguuauacguaauuguuaacguuucccccuaguggagcucauacuguaacucagccauuuauuuuacuauguuauuagaguagauauauuugauauuuuaauuaauuuuugaaaacuguuaaauguucuuuucucauuuucucccaaagcuuucuaagaguucaccuagugaacccaguaaugcuguugcuaguaguaguacggaacagccaagcguuucaccaucuucaucaguauucagucagcaugcaauugguuccaguacagaaguacaaaaagacaauaugaaaucuaugaaaauaagugaugaacuaugucacccaaaauguacauccaaaguacaaaaaguuaaagguaaaucacgaaguauuaaaaaaucuuguugugcagauuuugaguguuuggaaaacaguaaaaaagauguggcauucuguuauucaugccaguuguucugccaaaaauauuuuagcuguggaagagagucauuugcaacccacggaacuucuaauuggaaaaaaacccuggaaaaauucagaaagcaugaaaaaagugaaaugcauuugaagucauuggaauuuuggagagaauaccaauuuugugauggagcugucagugacgauuuaucuauucauucgaaacagauugagggaaauaaaaaguaccuaaagcuuauaauugaaaauauuuuauuucuuggaaagcaguguuuacccuuaagaggaaacgaccagucaguuucaucugugaauaaaggcaauuuuuuagaauuguuagaaaugagagcaaaagauaaaggagaagaaacauuucgacuuaugaauucacaaguugacuucuauaacaguacacaaauucaaagugauauuaucgaaauaauaaagacugaaauguugcaggauauugugaaugagaucaaugacuccucagcauuuucaaucauaugugaugagacaaucaauagugccaugaaagaacagcuuucaauuuguguaagauacccacaaaaaucaucaaaggcuaucuuaauuaaggaaagauucuuggguuuuguugauacugaggagaugacugggacccacuuacauaggacuaucaaaacuuaucugcagcaaauuggaguugauauggauaaaauacauggccaggccuaugauagcaccacuaauuugaagauaaaauuuaauaaaauagcagcagaauucaagaaagaagaaccaagagcuuuauacauacauuguuaugcacacuuuuuggauuuaucaauaauuagguuuuguaaagaaguaaaagaacuccgaagugcucuaaaaacucucaguucuuuguucaacacuauuuguaugucuggggaaauguuggcaaauuuucgaaacauuuauaggcuaagucaaaacaaaacaugcaagaaacauauaucacaaucauguuggacaguccaugaucguacauuacuaucugugauugacagucuuccagagauuauugaaacauuggaaguuauagcaagccauucuucaaauacaaguuucgccgaugaauugagucauuugcugacauugguuuccaaauuugaauuugucuuuuguuugaaauuccuguaucgagugcugaguguuacaggaauucuuuccaaagagcuucaaaauaaaaccauagacauuuuuucuuugucuucaaaaauagaagcaauuuuggaauguuuaucaucugaaagaaaugacguauacuuuaaaacaaucugggauggaacagaggaaauaugucaaaaaauaaccuguaaagguuuuaaaguugaaaaaccuucucuucagaaaagaagaaaaauucagaaaucaguagaucuuggcaauucagauaauauguuuuuuccuacuucaacagaagaacaauauaaaauuaauaucuauuaccaaggauuagauacuauauuacaaaauuuaaaguuauguuuuucggaguuugauuauugcaaaauaaagcaaauuucagaacuguuauuuaaauggaaugaaccauuaaaugaaacaacagcaaaacauguucaggaauuuuauaaacuugaugaggacauuaucccagaacuuagauuuuaucgacauuaugcaaagcuuaacuuugucauagaugauaguugcauaaacuucgucagucucggcuguuuguuuauucagcauggucuucacaguaauauuccuugucucucaaagcuauuauauauugcuuugucuuggccaauuacuucagcaaguacugagaacucauuuucuacccugccucgucuuaagacauauuuauguaauaccaugggacaagagaagcuuacuggcccagcccuaauggcuguugagcaggaguugguaaauaaacuaauggagccugaaagacucaaugaaauuguggaaaaguuuaucagucagaugaaagaaauauaauacaugcucauuugaacuuaccuaaaagacuuguauuuccauugggauguuuucauuucaaaauuguucaaaauucaaaagacacagaacgauaaacagugaagucuccuucccuccuuuagaacucauuuucucuucccaaaaaguguuaucuuuuccuuaaauaucccucuagagguauuuuuccuaagugguauuguacgguguauacuguucuucagcuugucuucucuguguaacauauuuuugagauugucccaugucguuacaugaagaguuucuugauucuuggucuauaauugcagauguuauuguaugaauguaccauaauauauuugagcagucccugcugacauuuuuuuccuaaccuuuugcuauuauaaauaaugauucauuuuauaaccuuuuauauaggucacauugcacaugagugaguuuacuguaagcuggaaaucuaaaguuagaauuacuagguuaagauaugugcauuuuuacuuuugauagauauuggcaaguugccaucuauaaggauugugccaguuuacagucccacccacaaugcaugagagugccuauuaaaucuuuguaaguguua

SEQ ID NO: 191413 - RNA, 36484 nt, Homo sapiens
uaacacuuacaaagauuuaauaggcacucucaugcauugugggugggacuguaaacuggcacaauccuuauagauggcaacuugccaauaucuaucaaaaguaaaaaugcacauaucuuaaccuaguaauucuaacuuuagauuuccagcuuacaguaaacucacucaugugcaaugugaccuauauaaaagguuauaaaaugaaucauuauuuauaauagcaaaagguuaggaaaaaaaugucagcagggacugcucaaauauauuaugguacauucauacaauaacaucugcaauuauagaccaagaaucaagaaacucuucauguaacgacaugggacaaucucaaaaauauguuacacagagaagacaagcugaagaacaguauacaccguacaauaccacuuaggaaaaauaccucuagagggauauuuaaggaaaagauaacacuuuuugggaagagaaaaugaguucuaaaggagggaaggagacuucacuguuuaucguucugugucuuuugaauuuugaacaauuuugaaaugaaaacaucccaauggaaauacaagucuuuuagguaaguucaaaugagcauguauuauauuucuuucaucugacugauaaacuuuuccacaauuucauugagucuuucaggcuccauuaguuuauuuaccaacuccugcucaacagccauuagggcugggccaguaagcuucucuugucccaugguauuacauaaauaugucuuaagacgaggcaggguagaaaaugaguucucaguacuugcugaaguaauuggccaagacaaagcaauauauaauagcuuugagagacaaggaauauuacugugaagaccaugcugaauaaacaaacagccgagacugacgaaguuuaugcaacuaucaucuaugacaaaguuaagcuuugcauaaugucgauaaaaucuaaguucugggauaauguccucaucaaguuuauaaaauuccugaacauguuuugcuguuguuucauuuaaugguucauuccauuuaaauaacaguucugaaauuugcuuuauuuugcaauaaucaaacuccgaaaaacauaacuuuaaauuuuguaauauaguaucuaauccuugguaauagauauuaauuuuauauuguucuucuguugaaguaggaaaaaacauauuaucugaauugccaagaucuacugauuucugaauuuuucuucuuuucugaagagaagguuuuucaacuuuaaaaccuuuacagguuauuuuuugacauauuuccucuguuccaucccagauuguuuuaaaguauacgucauuucuuucagaugauaaacauuccaaaauugcuucuauuuuugaagacaaagaaaaaaugucuaugguuuuauuuugaagcucuuuggaaagaauuccuguaacacucagcacucgauacaggaauuucaaacaaaagacaaauucaaauuuggaaaccaaugucagcaaaugacucaauucaucggcgaaacuuguauuugaagaauggcuugcuauaacuuccaauguuucaauaaucucuggaagacugucaaucacagauaguaauguacgaucauggacuguccaacaugauugugauauauguuucuugcauguuuuguuuugacuuagccuauaaauguuucgaaaauuugccaacauuuccccagacauacaaauaguguugaacaaagaacugagaguuuuuagagcacuucggaguucuuuuacuucuuuacaaaaccuaauuauugauaaauccaaaaagugugcauaacaauguauguauaaagcucuugguucuucuuucuugaauucugcugcuauuuuauuaaauuuuaucuucaaauuaguggugcuaucauaggccuggccauguauuuuauccauaucaacuccaauuugcugcagauaaguuuugauaguccuauguaagugggucccagucaucuccucaguaucaacaaaacccaagaaucuuuccuuaauuaagauagccuuugaugauuuuuguggguaucuuacacaaauugaaagcuguucuuucauggcacuauugauugucucaucacauaugauugaaaaugcugaggagucauugaucucauucacaauauccugcaacauuucagucuuuauuauuucgauaauaucacuuugaauuuguguacuguuauagaagucaacuugugaauucauaagucgaaauguuucuucuccuuuaucuuuugcucucauuucuaacaauucuaaaaaauugccuuuauucacagaugaaacugacuggucguuuccucuuaaggguaaacacugcuuuccaagaaauaaaauauuuucaauuauaagcuuuagguacuuuuuauuucccucaaucuguuucgaaugaauagauaaaucgucacugacagcuccaucacaaaauugguauucucuccaaaauuccaaugacuucaaaugcauuucacuuuuuucaugcuuucugaauuuuuccaggguuuuuuuccaauuagaaguuccguggguugcaaaugacucucuuccacagcuaaaauauuuuuggcagaacaacuggcaugaauaacagaaugccacaucuuuuuuacuguuuuccaaacacucaaaaucugcacaacaagauuuuuuaauacuucgugauuuaccuuuaacuuuuuguacuuuggauguacauuuugggugacauaguucaucacuuauuuucauagauuucauauugucuuuuuguacuucuguacuggaaccaauugcaugcugacugaauacugaugaagauggugaaacgcuuggcuguuccguacuacuacuagcaacagcauuacuggguucacuaggugaacucuuagaaagcuuugggagaaaaugagaaaagaacauuuaacaguuuucaaaaauuaauuaaaauaucaaauauaucuacucuaauaacauaguaaaauaaauggcugaguuacaguaugagcuccacuagggggaaacguuaacaauuacguauaacuuauuuauuugcaaucuagauucagcauuaaauguuugaaggaccuuuugguauguaauugucauaaaaauaauuuuuauugcucagaugacucaaauuguguaguauuuuuuuaaaagaagaacccagaggaaaaaaauacuucuguuuaaacaaucuacaaacauacacacacaccccauauaugaauacauaauacauaaaauauauauuaaauauauaaauauaauauauaauaaauauacauuauaauauauuuauauuauauacaauauauuauaauauauuuauauuauauauuuauauuuuuauauauuauaguauauauuauauauauauauaaaaaaucugggccaggugugguggcucaugccuguaaucccagcacuuugggaggccaaggugggcggaucaccugaggccagcaguucgagaccagguuggccaacauggugaaaccccuucucuacuaaaaauacaaaaauuaacugggcaugguagcaggcgcugguaaucccagcuacucaggaggcugaggcaggagaaucgcuugaacccaggaggcaaagguugcagugagcugagaucacgccacugcacuccagcuuggguggcagagcgagacucugucucaacaacaacaacaacaaaaaucugcuuauuaaaaaaagacagugguaaaaaaaguuaaaacuuacauccacaaugacaucugcuguugcuguuacugaagaaacuguaucuguuaaaauagagcauaaauucaagaucuuauauacuauaaccuauaaaauagcaucauaaacuauauuugcuuauuucauauaagaaacaaaaagaaaauuuagcauauagacagauuuaucaaguaugacaaaacaauauuuaugucaaauaucuuaacaucaacuuuuaccuuguaagacaucaguguucaugaugggcaaggcaacaucggugucugccaaugacacuauauugcuuauaacuggagucguaucuuucuuuggagaaagaagcucuguugaaguaucaugcaccacagaaacaacacuuacugacaacaauaaaaagauuucuuauaaacaaggcaaaaucaaucaucagaaaguacuguuuaguaauacuguuuaaagaaauaaugcaagcaucuaauagcuuaaggaauugguagguacugaaguaauuuuuauuagggcuuaggaauagccagguucuuuaguaucguauuuauaauuacaacauuacacugaaaauuuacacuucuccaacauuuuaugucuuuuaccuuuguacacaauuucccaguccuuuuaaagaauuuguuuaaaauuaugagcaaauuuuucugugaaauuacucaugaagaaaagagauucugauugaaucuccuaaugggcaucuauuucaaacucuuccaggauucauaaaccuuaacaucaauggagcgcuagguuggugcccaagccacuauugcagaaauuucuguaacaagccaguuuguaugacuuacaaaucccagaggcauuagucacucuauggucuauguaaauagcaccacugguccuacaugaggcuuuuugauggaauacuuaguuggcucagauuauuugugcuuuuuuauuauugagucuuaaagcauuuacaaucacuucuauuucaugugaaaaauguaaugaaaacuuguuuuuacaaaacagggcuaaguaaaacauucuauauucuaauaaaagcagucuuguaaauguauuaaacucuauauugaccaagugccuccuauguaccauguuuugcaguaggugcucaauauauauugauguaaacauacauauauucauuuacuaaauaaucuaaaaaaagacauguaucuuuuaauuuuuauuauuauuauuuuugagauggagucucacucugucacccagacuggagugcaauggugcgaucucggcucacugcaaccuccaccacccagguucaaaugauucuccugucucagccuccuaaguagcugggacuacagggacccaccaacacgcccagcuaauuuuuuuuguauuuuuaguagagacgggguuucaacauguugcccaggcuggucucaaacuccugaccucaggcgaucugcccacuuuggccucccaaagugcugggaauacaggcaugagccaccgugcuuggccuacaaauauuaaaucucuggugguaaaguagccuuccuuuuauacaaaaauacugaaaaacaguucuuugcaacaaguuuagauuguuuugacuuuuaaaagucgguuuaauuugaaaaugaaucaagguuauaaauuaaagucaaauaauauuauuuauuaauaauuacuaaaccccuacaauugcuaaacaaacauuaccugaagaagauuccaucuuagcuuuacuguaugcagagaaacaauuaauagagcagaaaagcucugucuuccccaaaucacucguagucucaaucauuucaucugagggcuucaaugguuugcaaggaacagauauaagugguuuggcagguuucuguuuagagauuaaaauaauauucauauuccugguauaugauauguuguuaaugaagaagaaccuauuaccacugcuuuuaguuggaauauuaaaaagaauaacaauuaagacaguuuuuacauuuucuuaaaaagacacuacagauugcaauaacuaaaagaauauuggcaaaucugaaaaugauuuuuauuauuuaucagauauauuuaacagcaauaauaauaauaccuaugaaagcaguaaggccaggugcaguggcucaugcauguaaucccagcacuuugggaggccaaagcaggcagaucaccugaggucaggaguucgagaccagccuggccaacauagugaaaucccgucucuacuaaaaauacaaaaaauuagcuagguguaguggcgagcgccuguaaucacaguuacucaggaggcugaggcaggagaaucacuugaaccuggguggcagagguugcagugagcugagauugugacacugcacuccagccugggcaacaagagugaaacuccuuuucaagggaaaaaaaaaaaagcaaugaagaaaguggucacagaaguucauuucaggcagucaaagccuacuggauaaacaaaggccuuauauaguuauagaucuguccucaaugguagcuugggaauuaacuugggaagaugucuaccgaugcugaggaggagccaggaaggagugcuuaacuuaaauaccuuacaagauacugugggaaucacuguuuuucuaggcuaacuucaugguaaaaauuacaagcauauuguaagaaagcagcauacaagcaauagaaaguauagaguacugugaguucaguaaguaguaaccaugcaaaagaaaggauauaaacuuugaaaggcaggcauuacuguaaagauuaugcucaccaccuauucuuucuagucaaacaggaaccaauauuccuggauuucagaauaugucagagccuaggcacaguggcucacgccuguaaucucaacuuucagagguugaggcggggggaucacuugaacccaggaguuugagaccagacugguaaaauagugauaccucaucucuaauaaauaaauaaauaaaaauaaaaaauuagccuagugugguggcgugcgccuguagucccauuuacuugugaggcugaggugggaaggaucacuugagcccaggaagacagagguugcagugagccgagaucaugccauugcacuccagccugggugacagaguaagacucugucucaaaaaaagaaagaaaaaauaauacaucaggcucagugugguggcucuugcccguaaucccagcacuuugggaggcuaaggcaggaagaucacuugagcccaggaguucgagaccagccuaggcagcaaagugagacccaucucuacaaaaaacacaaacauuaaccaggugugguggcgcaugccuguggucccagcuacaugggaggcugaggcaggaggauugcuugaacaccugagguugggccuccagugagcuuugcucacaccaugcacuccagccuccauccuggguggaaaagcaagacucagucuaaaaaaaaaaaaaaaaaaaaaaaaucaccgauggaacaaaacugcuuuuggagaugcaaaguacacagacaggcugggcacggugacucacaccuguaaucccagcacuuuggcaggccgaggcgggcagaucaucugaggucaggaguucaagaccagccuggccaacaugguggaaccccgucucuacaaaaauacaaaaauuagcugggugugguggugugcgcccaaguaaccccagcuacuugggaggcugagauggaagaauugcuugaaccugggaggcggagguugcagugagcugagaucgugccauugcacgccagccugggcaacagagcaagacugugucucaaaaaaacaaaaacaaaacaaaacaaaacccaccaaaguacaaagacaaaaaaauacauauacguuuuauuuuucugugagagaacaggauauuggcaaaggcacaacaaaacaaaaaggauaauuucgaaaauuucuauuuuuauccuuuauuaguaugaacaacuuuuauauuuugagaaaucuuaacaauucacuaaucuuuaacguuaagcaacaauaguggcauaauuuauuuuuauuuauuuauuuauuuuugagacagagucuugcucuguuguccaggcuggagugcagugguaugaucucggcucacuacaaccuuuaccuuccccagguucaagcaauucuccugccucagccucccggguagcugggauuauuaggugugugccacuaugcccggcuaauuuuuguauuuuuaguagagauggaguuucaccauguuggccaggcuggucuugaacuccugaccucaagugauccucccguuuggccucccaaagugcugggauuacaggcgugagccaccgcaccuggcccaauagugguaucauuuauaauuaaguuaguuuaauauucauaagggaaggcuaacuuaauauauucuauuaacauauggccaaaauaauuacaauuacaucuaauaauccacuuuuuaaaaauaaaaagcuaccccauuuuuagauucacauauuuggacauuuuucuaauucuggauuauaguucacuaacauuguagauuuacuccauuaucacugucacaugaugucuuacauucagaugcaaggggaaaguguuaggcugugcuuguuaacuaacucguuuacccaaaucagucuugccccaucacauaagcugaacaacuggguacucaauacagguuuuuuuuuuuuuuucugagacagagucucgcucugucgcccaggcuggagugcaguggcacgaucucggcucacugcaagcuccgccucccggguucaugccauucuccugccucagccuccagaguagcugggacuacaggcgcccgccaccacaccccgcuaauuuuuuuuuuuuuuuguauuuuuaguaacgaugggguuucaccauguuagccaggauggucucgaucuccugaccucgugauccacccgccucagccucccaaagugcugggauuacaggcgugacccaccgugcccggcauauaggcuuuuaaaaacagaacaaggccggccaggcgcgguggcucacaccuguaaucccagcacuuugggaggccgaggcgggcggaucacgaggucaggagauugagaccauccuggcuaacacggugaaacccugucucuacuaaaaauacaaaaaauuagccagacgugguggugggcaccuguagucccagcugcucgcgaggcugagauacgagaauggcgugaacccgcgaggcggagcuugcagugagcugagauugcgccacugcacuccagccugggcgacagagcgagacuccgucucaaaaaacaaacaacaacaacaacaacaacaaaaaacaacccagaacaaggccuauugagugucaaaaagaaagaaagaaaaaaaaaggaauauuauuuccugccuuugggagaagucuucugugcuuuccguucuggucccaaggcaggauacucucaagaugggggccauagaaaagaugugagucacaaaugaucuauuugaauuauggcuuguuuugacucccaucuucaacugcuuuuuuuuuuuuuuuuuuuuuuugagacggagucucacucugucgccuaggcuggagugcaauggugccaucucggcucacugcaaccuccaccucccggguucaagagauuuuccugccucagccucccaaguaguugggauuauaggcgccugccaccaugcccagcuaauuuugguauucuuaguagaggcggguuuucgccauguuggccaggcuggucuccaacuccugaccucaggugaucggccagccucggccucccaaagugcugggauuauaggcaucagccacugcacccggccaacugcuuguuuuuaaggaagucuguauagggauagaguugggucucaaaauaugauaugaacaagcaacauaucuaagaagucccaccucaucucauuugcucuuucucugcucucagaagcacccacccagagcuugucuaucagaaauagggacaaauaauacuaaucucacuggauuauuuccuccuaugacugacucagagaaagcaugugauauuuuuuguuuguuuuuuuaaagacagguucuugcuauguugcucaggcugguucugaacuccuggcucaacugaaccucccgccuuggucucccaaagugcugagauaacagguguaagccaccaugacuguccacaugugacauucuugauucaucuuugcauuguuugguguaagaguuaaacacguggaauuaaaaacaaaaacauggcuaggcucacaucuguaaucccagcaccuuaggagaccaaggcaggaggaucagcugaguucaggaguuguaagacaagcuugggcaacauaguaagagcuugucucuacaaaaaaauuaaaaauuagccaggugugguggugugugccuguaguuccagcuacucgggacgcugaggugggaggaucacuugagcuaaggaggucaaggcuacagugagccaugauugccacugcacuccaagcuggcugacaaagaccucgucucaaaaaaaucaaaauaaauaaaaaaaauaaauagcugggcacaguggcuuacgccuguaaucccaguuccuugggaggcugaggcaggagaauugcuugaaccugggaggcggagguugcagugagccaagauugugccacugcacuccagccugggcaagacagcgagacuccgucucaaaaaaaauaaauaaggucagguguggugguucaugccuguaaucccagcacuuugggaggccaaggcagguggaucacgaggucaggagauugagaccauccuggcuaacacagugaaaccccaucucuacuuaaaauacaaaaaauuagccaggcguggugguggcgggugcuuguagucccagcuacuugggaggccgaggcaggagaauggcaugaacccgcgaggcagaacuugcagugagccgagaucgcgccaccgcacuccagccugggugacagaggaagacuccaucucaccaaaaaaaaaaaaaaaaaaaaaaagaaagaaauaaaauaaauacauaaaaauaaaaacaaaaauacuuuuguguuuggguuuuauugaccagcagacuauuguuauuuuugcuauacuuauuucuaguuuauaaaccggcuccagccugccugccuuuucuuuaaggugagauaaucgaucugagauuauuuaggaaaaucuccauauagcauuuaucaugaauucuuaugcaagaagaaaccguuaaaagccuucuauuucaucuucaucaacuuaucgacauuauuccaaaggguaccaaaaacuacuucccacauuuuccuagagugaaaccauucauaggccaguuaauagaagaaacaauaggucuuuauucauaccugcuuauaugcuguaauacucuuugaacuauuaaaguaaugagacuguccuuccaucugaaguaugugggacagacuagagcugguguaacaguaagugccacaguucucacagcaguucaugaugaaguuguuagcagagugaaacuuugaaaggcaggcauuacugcaaagauuauguuucacauuuugguauuuuacuucauacugaaucuaggauuuaauaaaaagauucaguaaaaacucugauauuuaagcagaaucaucagaaucccuguaaagguuauaauuggaacuuacaauagcagucuucuggcacaugcugcacuuggucaaaaugcuauuaguacauaugguaacaaaugguuuucuuuuuucuucauaugaugaaagacaagauaggcugcaaaaaguuuugcaagagguagugucuuccagcuggacacuaaucacauccuuuggauuuaaaaugucucuaagaauaaauaacaaggacaucauuaaacaguuuaaacacaauuauaacuucucuuuauaaaugaaaugaccucucaaauuagaguaagaacauuagccuugaaauaagaaaaccugaauuugguacccaguucugucacauuuauacucccuaaauuuuaauuuucucaucuauacauuacagauuauaaagcacaucuaauagugcaguuuuguuuuuuaagagauagggucuugcuguguugcccaagcuggccucaaauuccugggcucaagagauucucccaccucaaucucccacauagcuaggauuacaggcacauaaucccaccaugccugacuuugaagauguaguuuuggagacuagccagccuguauuauuagguggugcuagugaaaaccgagggaugaugagagaucacauauucacaugagcaacucuagaaucuauaggacagagaaucuuaaaauauggucuucaaaucccugggggaguccccaagaucaaaacuauuuucauaguaagauguuauuugcuuuuucaccguguugauguuugcaacaucacuuugcaacugauguugcaaagcuaaugguaggacccugcaaucccacuccuugguaaacacccaaaaaaacugaaaacagguacucaaacaagcacauguacgugcauauucauaacagcacuauucacaauggucaaaagaugaaaacagcccaaauguucaucaguaagugaaugaaugaauaagcacauuguguuacauacauacaguggaauauuauucgccuauuaacaaaaagaauaaaguacugauacauguuacaacauggacaaaccuugaaaauauuaugcuaagggaaagaaccagacacaaaaagucacugcacucuagccugagcaacagaguaauaauacccugucacaaaaaggucauauaugauuccauuuacaugagauauucaggauagauaaaaucuauagauauaaugcauacuggugguugacaggcacuggggggagagggaaauuaggagaaacugcuuaguguuuaagguguuuuacuuugaagugauggaaauguuuuggaacaagauagaggggauggucacacaacauuaugaauauacuaaaugccaaugaaaugguuaauuucuugguauacaaauuucacuucaaugaauuuggaaaagaaaaaaggcaaugguggguaaaaccgucagagccuuagcagaaaucaaggcaguggcaccaaaaugugcuaauauucauguuauucccugcuauacauucacugccaaaaaaaauucuuuuuaaaguaucaguuucacuuaaggaaguacucaaugaaacagcaaaauauuuuaaauuauuuaaacuucauccuuaaguacauuuaaaaaauauucugucuuggccaagugguagggugagaaaaaaaaauuccgugugacaacacaggacauaagcauaaaguacuucuguacaccaaaggaugaugguugucucaaggaaaagcccauauggaaauguugaguuauaaaugaauuagccacuuuuuucauggaaaacauuuuuacuugaaaguacuguaaacaguuuacuguaaauaaagacaaacuauuauccagaaguggguaucugcagauauuuucuugaaaaugaaaaaaaugagacugucacuucaaguaaaacgacaguauuuaucgccaacaauaaaauuuugucuuucaagugauaauuagaauuuuggaaaacuuguaucuuccaacuucaacuugaucgauacccaaaacuuaaaaacuuuucugagauuaguggugauuuuuaaaauacugcauaauaaaaugagaacaucuagaagaucugcagaacucagugaaccaguauuuuccaaacuacaauagcauauuacaaaaaucauucacggguaaaagauccauucaaaguacaagauagauuaacgaauucuaacauaacagagugcaaaaaguucacugauccacaugguacaaaaaguuugaucccacauugcaacuagccuuuaagaaacuaccacuugauuuuugguuguaguaucaaagaacacccacaacgaucuaaaaggcuacuaaaacacuccccccuuuuccaaucaccuauuuaugaggccagguuuucuucagacuucaaccaaaacaacacuuugcaauaaagugaaggcagaaacagauacaaaaauccagcuagauguaaagugauuugcaaaacugauaaaacaauacuuaucaauuuuuaaaaauauggguauuuuucauuuaaaaugucauuuaauuuuugauacaguuaauauucauaaucuacauaacuaaagcucuuuggguguucaauaauuuuuaaggguacaagaaguccugagaccagaaaguuugagaacagccacuauagaaaauaucaauacaccuaauagcaggcgcgguggcucacaccuuuaaucuugggaggccaaggugggcagaucacuugaggucaggaguucgagacuagccuggccaaccccgucucuacuaaaaauauuuaaaaacauuaguauuuugugaucaauguuuugggaguuaugaacacgacacuguaaaaucacagaccacagaagaauuaauuuggggggugggcgguuguaagaggagagugaggaauggugugggaauagacaaaagguaaagauauuugaggcauaccuuucagacagaauaaagauaccagccagaugggaagggaggaagaagaaacuacaucagcgacgcauggaagucugaaaaugcuucuuaguuuuuauugcuaucagcauacuagauugcuggcuucuaagaaucuacuaaagcuuuauaaaaaauugaaaaaugaauguuggccaggcacgguggcucacauguguaauccugggaggcuggggcaggcagauaccugaggucaggaguugggagaccagccuggccaacacggugaaaccccaucucuacuaaaaauacaaaaauuaacggggcauggugauaggcaccuguaaucccaguuacuagggaggcugaggcagaagaaucgcuugaaccugggaggcggagguugcagugagcugagaucccgcuauugaacuccagccugggcaaaacggugagacuccgccucaaaaaaaaaaaaaaaaagaauguuggcuggguacgguggcucacgcccauaaugccagcacuuugggagggcaagccaggaggaucacuugagcccaggaguucaagaccagucuggacaacauggugaaaucaucucuacaaaaaaauacaaaaacuggacaggcaggguggcaugugccugcaaucccagcuacuugggaggguaaaggugggaguauugcuuaagcccagguggucgaggcugcagugagccaagauggugccacugcacuccaaccugggugacagacagggaccuugucucaaaaaaaaaaaagaaacgccaacaaauuaggaacaacuuuccgauaaauaaaucaaaccuuagugcaggggccuauuuuggacuuuauugauugcauucaggauuugcgguugguuccaacugagauacuaaagugaagaaaugacacuucuuaaauacaaaguucccaagaacaagucacaucuuuuuuuuuuuuuuugagacagggucucacuccguugcccaggcuggagugcagucguacaaucucagcucacugcaaccuccgucuccuggguucaagcaauucuccugccucagucacugguguagcuggguuuacaggcacacaccaccacgccuggcuaauuuuuauauuuuuaguagagacagggauuugugguguuggcuagacuggucucgaacuccugaccuccagugauucuccugccuuggccucccaaagugcugggauuacaggugugaaccaccucgcuuggcccacaaaucgcaucuuucuaauaagauuuaaaaugucaucuucaaagggaucuuccauuugguccaugaaauagaauaaaaagugcauugacucaaaacagauauuaaaucauuccuauaaaagaaaucuuaaaaaguaacuaaaaaucaggcagggcgugguggcucauaccuauaaucccagcacuuugggaggccgaggaaagcagaucaccugagguccggaguucgagaccagccuggccaacauggcgaaacugcaucucuacugaaaauaaaaaaacuagcugggcacaguggcacacgccuguaaucccagcuacuugggaggcugaggcaggagaauugcuugaacccaggagguggagguugcaguaagccaagauugcaccauugcacucuggccugggugacagauugagacgagacuccgucucagacaaaacaaaacaaaacaaacaaacaaacaaaacugaaaaucagcacgguggcucacaccuguaaucccggcacuuugggagaccaaggcaggaggaucacuugaacucaggaguuuaagaucagccugggaaacauagugacucugucucugcaaaaauaaauaaauaaguaacugaaaauuauuuucaguucaggauaguuucacuggaagauaaaaaaaccccagaagaauagcuaaaauuuauguaaaaggcuaauuaauguggaauuuuuaaguuuugaaaaaagcagccuacucugaaucauggauggccuuuuccagccuaaaauuuacuaccaucuuucuacccacuacaauauaauauuuuuuauaaaaaaauuuuauucuagaggaaguaaaacuuaucucagauuuuuacucauauuggauuuccaugccuaggagaacuuacacacuaaaucuuuccugcuucagccuuuuucaaucugucugggacaucugcugaagauguguagugagucucuaaggucccuuccaguuuuaugacucugcagggagagaaagcaggcugaagagaguacuauauggcccauagcaaaaaaguaaaaagacaaaagacuaguauaguauugaaggguugaaaagcaaaagagaaugguaaguaacgugccauggaauaagaccugaagcaacagauaauaacugaagcagcagccagaggagcugaagcaaacccaucaaaaggguuugugaguuuguuaagagaauaauaauaguuaacauuuauugaguucuuacuacaugcugguauuguucugaccacuuaaauauacuauuuaaugcucauaauucuuuuguacauuuaucaaaaacagauacgaauacuaaguaacaaagaaguucucaauacugcuccaacuuuagcauguauaggaaucacauggcgauaaaugcaguucugaaucagcaggucuggguaagaccugagaaagugcauuucuuuuuuuuucuuuuugagacagucagugcaguggccugaucucagcuuacugcaacuuuagccucccggguucaagcaauuguccugcuucagccucccaaguagcugggauuacaggugcaugccacagugcucagcuaauuuuuuuguauuuuaguagagacaggguuucacuguguugccaggcuggucucaaacuccugagcucaggcauucugcccaccucggccucccuaagugcuaggauaacaggcgugagccacugcucccagccugagaaagugcauuucuaacaaacucuugggugaugcugaucuagcaacucagggaugaaacuuugaguaguaaaauauaacuaaacagaagaagcaaaauucaaauuauggcaaccugaguccaaaacaaguauuauuugaaagaaauuuguuauauuuagaagcacugugguugccuauggauuuucuuguucugaacaagaacauuuaaaaauuagcauauccuaagugcuaacaaccauaauuauacagccuuaggacucucaaagccaaaaugacacugauucuucacacauucucacauaaauuuuuaaaagauuacauagagacauguagguuuaucuauggccaucaauuuuucaaaagaaucacuucauuuaccauuauaaaagaaauauaauauuauuccacaucuuggaaaauccaaacuaacugucauaggauuaauuuuuuaguagguugcucccuauacaguuaaauagaacagaauggauaaacaauaaucccauuuacagagaauuucaaaugaaaagaguaaaggugaagagaaacaguacuuuucacauuaauuucugcaaaaaaaaauauuucuacagaauccaucagaggaacuaaaaguagaaaaaacuucuuuuuacuaaaccaagacgacacgucuucaaaagaaaugaaaauggccgggcgcagugacucacaccuguaaucccagcacuuugggaggccaaggcaagcggaucaccugaggucaggaguucaagaccagcguggccaacauggcgaacgaaaccccaucucuacuaaaaaauacaaaauuagccgggcgugguggugcauggcuguaaucccagcuacuugggaggcugaggcaggagaaucgcuugaacccaggagguggaaguugcagugagccgagaucgugccacugcacuccagccugggcaacaagagucaaacucagucucaaaaaauaaaaaaagaaaauguagaaauuacaacuaagacuaugaucaagaacaagguagggaaauaaaagggggcauaauuuagaauuauauacuuugagcaguuugaacaaguucucuuagaaggaacuggugaacuggcagaugaaauguauucagugaugcaugguauggagcagaaaaguugagcagauccuuuccucugauaagcaguuugccccuucuggagaauuuuuuuacaaccagcacaggaaaccugaauagcugugguugaaacugaaggaagcauuuuauucacgccagaugaugccagagaaagcugaaugccugcagucaacugugaagcuauaaaaacacaagagggagaaaaaaaaauuguuauuuacacaaaauuaaguaggcauuccuuuauuuucuuucuuucuuuuuuuagagacagggucuuguucuguugcccucuuuugcacucuaggcaguguagugauacgaucauggcucacugcagccuugacacccuguacucaagugacccucucaccaccuggugcgguggcucacgccuguaaucccagcacuuugggaggccaaggcagguggaucaccugaggucagaguucaagaccagcuuggccaacauggugaaaccccaucucaauuaaaaauacaaaauuagccaggugugguggcuaacgccuguaaucccagcauuuugggaggcaagguggguggaucacgaguuuaagagauugagaccaucccgggcaauauggugaaaccccgucucuacuauaaaaauuagcugggcauggugacacaugccuguagucccagcuacucgggaggcugaggcaggagaaucgcuugaaccugagagguggaggcugcagugaggcgagaucaugcacugcccuccagccuggcaacagagcgagagcgagacuccgucucaaaacaaacaaaauuaucugggugugguggcacgggccugugauccuaguuacuugggaggcugaggcaggagcacugcuugaaccuggguggcagagguugcagugagccaagaucgugccauugcacuccagccugggcaacaagagcggaaacuccaucucagaaaaaaaaaaaaaaccucccgccucagccucccaaguagcugggacuauaggcaugcaccaccacaccugguuuuuaaauuuucuguagagacaggaucucgcuauguugcccaggcuggucucaaacuccugcccucaagcugauccuuccaccuuggccucccaaaauguugggauuacaggcaugaggcaccaugcccagccucuuugauuuucuucucuuuuuuuuuuuuuuuagacagagucucgcucuguugcccaggcuggagugcaguggugcaaucuuggcucaccacaaccucugccucccagguucaagcaaaucuccugccucagccuccugaguagcugggauuacaggcaugcgccaccacgccuggcuaauuuuguauuuguaguagagacaggguuucacuauguuggccaaacuggucucgaauuccugaccucaugauccgccugccucggccucccaaagugcugggauuacaggugugagccacugugcacggccucucuuucauuuucuuacagguuacuucuccuggacuuaaaacccaacacaaacaaagcaauauucaaaggcauuaaaaaagaaugaaucagcugucguauuggucugaauaaacauaacuaacuuaaauaauucuauuaccacucucugaaaacacagcauuuauuuucaguucauucuccugaguucuggacuguugccuaugacaauacuccuaaaaagaaaaaaaaaauaauaauuaaaaauagugaauacaaugaauuuaagacaaccagucauucaacagaaaaugauaaauuguggucaagucuggucaaugaauuguauaacugaauugaaccaaaauacacagguaugcacuacccuuuuggugcucuuuggcugacaacacuaaucacccaauacauuauuuucuaugguauccaggugugacaucaaaaucuuugucaacaaaaucccuccauucacuaucaauagggagcagacauauugaauuacaacuauuuucccuacuuguuuuuuuuuuuuuuucuuuuuuuuuugagacaagaucucacucugucacccaggcuggaguacagugacgcgaucucgucucacuauaaccuacuucuggguucaagugauucuucugccucagccucccaaguagcugagacuacaggcacaugccuccaugcccggcuaauuuuuuaauuuuuaguggagauguugcccauggucuugaacuccuggccucaagugaucugccugucucacccucccaaaaugcugggauuacaggaaugagccaccacacccagccuucccugcuugcucuaaucauuaacagcuaauugucuucauaaagaccuuaacccaagaaauuguuaauugggcagaaugauucuuacaaaggacaauuuuuucagagcaggaggcaauuucauagccaccauaucuaaacuugaucuaugccugaauguccauggcaugaagaagcaauagauaguuccuagaugaguaacauuccccaguguuaacaacucaaugguaagcauacccuuauuuaauauuaaucuacuuuaggcuauuucuaaauagaauacuacaaauaaauuacccuuuuuagugauuuuuuucuuucauuagaacuuucagcugguucacaguucauauacaaacauuccuuuuuuuuguuuuaagagacagggucucgcuucguuacccaggcuggagugcaauggcacaaucauagcucauugcuuccuugaauuccugggcucaagcgauccuccuguuguagccucugaaguagcugagacuacaggcgugcaccacuaugccuggcuaauuuuuguauuuuuuauagagacaaggucuugucauccaguuggucucaaacucuugggcucaggugauccucccaccuuggccucccaaaguucugggauuacaggugugagccacugugccuggccauauauacaaacauucuaaggaauguuuucccuacuuaaacaauacucacaguucaagucaguucauccuuuauagguucuuuagugauaugucuaaaaaaauuuuuuuuaauuuacauaaauuaauuuagauuaaaaaauguaauuuguauuaaguuaagaaaaacaaaaacaaaauguguuaaccuucucuggaaguagaaucuggcaaaagaaaaaaaguguuaaccuuagcuaggcccacaacacccuaaacaauccuuuuaccuaugcaaaaacccaauuccaaacagucuaaucuuuccucaaauaauuuucuuacauauacuuguaguggcacuuaacaccauauaccuuguauuauuuaauuaacugcuuuggaggagauaaggauuugaguuuuucaaugaaucauuucagcaccuuuguaacuaaaauuuauaguuaaaugcugcucuagaaauaauggaaauaagggaaaauauuuacuugagcauugucggguucugucuuaauuucaucuagcagccccagcugugaugccacugccuugucacacucaccaccuaaaagugguucuuucauuuuaguaucugaugcaaaggaauucuccaguuccaaacuaauggguuucuuccugaagaacaguuuccagauuccuaaaauaaaauauugauaaagaguuugauuuuaaaauuaguccuuuuaaauaugguaauuuucuagaaccacaaaagggucuuuagacagcuuggcaucaagguuccuucauugaaagaacacuggcuucuuuccuuucauccauuauucuucaauauaguuuugcucuauacuucucugguagcuacuaccaacucugugccuucuucuggaaauagucuccguuucuguucccccaagacugaaugcagcauaaaaccaccaaaacuuacaaguuuauuuuuaacuuuucaauaggagaaaauguaaagcuuucggccagggucgguggcucacgccuguaaacccagcacuuugggaggccaaggcgggcagaucacuugaggucaggaguuugagaccagccuggccaacauggugaaaccccaucucuacuaauacaaaaauuagccggguugugguggcacauaccuguaaucccagcuacucgggaggcugaggcacgagaaucgcuugaaccugggagguggaggucgcagugaauggacauugagccacugcacuccagccugggugacagagugagacugugucucaacaaacaaacaaacaaacaaaaaagaaauguaaagcuuucuaucugagguuaacccaaucuguacucacuaccccucucugcccuccaguuauccuucucauuugcuucuucaguuccucuuccccuccuauugauuccaggauauaagcauuuaaauacauucuagaaucuaaagcuauccgcccucucucugaccaccccuuuccccauucuugaaauuucuuucauuuuucuuacuccgaggucuuuuaccucuuugccaguauuucucacaaauacuuauuuuaccugcuucuaaaauguuuguguuccacaaaaacacaauuccccaguacucuccuugccugcucuaugaucuugaacuccuggcuuuaaaaaaauaacgaaguuggcugggcacaguggcucacgccuguaaucccaacacucugggaggcugagguggguggagcacgugagaucaggaguuugagaccagucuggucaacaugcugaaaucccaucucuacuaaaaauacaaaaaauuaggcuugguggcaugcgcugguaaucccagcuacucgguaggcugaggcaggagaauagcuugaacccgggaggcagagguugcagugggccaagaucgcgccauugcacuccagccugggugacagagcgagacucugucaagaaagaaaagaaaaggaaaagaaaggaaagaaagaaagaaaggaagguaggaaagaaagaaaagaaagaaagaaaaggaaaagaaaagaaaagaaaagaccuguuggccgggcacagugguucaugccuguaaucccagcacuuugggaggccaagacggguggaucaccugaggucaggaguuugagacuagccuggcaaacaaggcgaaaccccgucucuacuaaaaauacaaaaaaaaaaaaaucaaccgagugugguggugugugccugugaucucagcuacucaggaagcuaaggcaggagaaucacuucaacccaggaggcggaggcugcagugaacugagaucgcaccacugcacuccagccugggaaacagagcgagauucugucucaaacaaacaaaaaaacgaagucuuuggccgggcgcaguggcucaugccuguaaucccagcacuuugggaggccgaggcagguagaucaccugaggugaggaguucgagaccagccuggccaacauggcaaaacccugucucuacuaaaaauacaaaaauuagcugggcaugguggcaggugccuguaaucccagcuacucuggaggcugaggcaggagaaucacuugaaaacgggaggcagagguugcagucagccaagauugugccauugcacuccagccugggagacagagcgagacuccaucucaaaacaaaacaaacaaaaaccaagucuuuuucucuuuuuuuuuuuuuuuuuuuuuugagacaagaucucgcucugucacucaggcaguggcacuaucucaguucacugcagccucacccuccugggaucaagcaauucucccaccuuagucucccacguagcugggaccacaggcaugugccacagugcccagguaauuuuuuuuuuuuuuuguagagaagguguuucccuauguugcccagacugaucucgaacuccugggcucaagugauccucucaccucagccucccaaagugcuucaacgacagguguccaucugcucccagccuaugaucacaaccucagauucaacuaucaccuaugggcuguuuuuccccaacauuccugagcuguggcccauauaccuaauugccuauuaaauaucuccacuuggccggggcaguggcucacgccuguaaucccagcacuuugggaggcugaggcggguggaucaugaggucaggagaucaagaucauccuggcuaacacggugaaaccccgucucuacuaaaaauacaaaaaagauuagccaggcgugguggcaggcaccuguagacccagcuacugggaggcugaggcaggagaauggugugaacccgggagacggagcuugcagugagccgagaucgcgccacugcacuccagccugggagacuccgucucaaaauaaauaaauaaauaaauaaauaucuccacuugaauguuccacaggucccucaaacucaagggauuugaacucuggucucaagcaauccucuugccucaguaaaacuauauucuuuuauuacccccacaaaccuguuuuacagauauuccuuuuuuuugguaaauagcagugucauauaccuaauuucccaugccagaaaucuaggauuaaccuggaauuauucuucuucucccuaaaucuaauuaugaaauuagaucaaucuaccuuuuaauuaagucuuuuuuuuuuugagacaagaguuuugcucucguugcccaggauggagugcaauggcgcgaucucagcucacugcaaccacagccucccaaguucaagugauucuccugccucagccucccgaguagcugggauuacaggcaugugccaucacgccuggcuaauuuuguauuuuuaguagagacaggguuucuccauguuggucaggcuggucucgaacucccaaccucaggugauccgcccaccucggccucccaaagugcugggauuacaggugugagccaccacacccagucaaauaagucuuaagucuauuuucccaucacacaugccugccugcuucuccucacuauccaaaucaauagauuccuuuuuggucaaucuuacaacuuuugaggaacuacgaaagcaaggucucuuuuucuuuuuucauuaaaguucugggguguaugugcagaacgugcaguuuuguuauauagguauacacaugccauggugguuugcugcacccaucaaccugucaccuauauuagguauagcuucuaaugcuaucccucccagcaaggucucuuuuucaaagacagauugguuccuucuuuucuccuuuuuccuugacugaggccuacuuuccacuuaucugguagcuguuaccucugauucuaaauccuuuggaacccuuucccuuccugccacccuagcuuggcuucagagugcaagucuuccugucuccuagauccuuaaaaaagagccuuauaggccaggcucgguggcucacgccuguaaucccagcacuuggggaggccgagguggguggaucacgaggucaggagaucgaggccauccuggcuaacauggugaaaccccaucucuacuaaaaauacaaaaaaauuagccgggcgugguggcaggugucuguagucccagcuacucugggaggcugaggcaggagaauggcaugagcccgggaggcggagcuugcagugagccgagaucgcgccacuacacuccagccugggcgacagagcgagacucugucucaaaaaaaaaaaaaaaagagccuuauaucgggcaccuguagucccagcuacucgggaggcugaggcaggagaauggcgugaaccugggaggcagaccuugcagugaaccaagaucaugccacugcacuccagucugggugacagaacaagacuccaucucaaaaaaaaaaaaaaaaaaaaaaaaagccuuacaacuaaucauuauggagggcagaugauaacuaacacaaauguggagaaguugaaguuguuacaggaucacuuagaauaaugggcucaaaaaaagaaaaaaauaacaaaaaaccucuuacaggaguaauuccaggacuaugguuuuauucuggguuaguacaugaaagacccaaguaauucugccauuauuuuuuauuucugugauuggggcucaaccaccuucccucauuuccaucuuuagcucagcuuuuguugaaaguuccuaucccaaugcagaaaguuaaauaaggccugagagucaagugcaauaaauagcucauacagccucuguccagcccauuugagcauuauacacaaacaguaaagcaaaacucacuaaaaauuaacuauuugucauuagguagauucccuucaccugaaaguacacaugccaugcaagucuuaaacaucaauuaaaaacaaagcaccgaguuuugugcaguggcgguaucacagccaaugagguuuacgugagguacaauuauuguuauucguaagauaaaacaaaacaaaguaccuaugagcuuuggcaucuugcaacuccuucaaaugugucaccauacaaacauaaaaauaguggaggcugggcgcaguggcucaugccugaaaucccugcgcucugggaggcugagguggguggaugaggaggucgggaguucaagaccagccuggccaacacagugaaaccccaucuccacuaaaaaauacaaaaaauuagccgggcgugguggugggcgccuguaaucccagcuacucggaaggcugagacaguagaauugcuugaaucugggaggcagagguugcagugagccgagaucaugccauugcacuccagcucaggcaagagugugagacucugucucaaaaacaaaaaaaaaaaaaaaaaaggaaagcauccugaaaauuucugaggcaagggaaaaugcuaugcaacauuuguuuggcuauaagaagagcaaaacauguauuagugacagauccauuacuuccuuuuccaacaagaugcacauuagaguaaaauaaguccuacagacuuucuuuuaauauagcccuacucaucuuuccaaacuagggcuaaaucauaguaugaaagaguacagguauuaauagucaaaggaugaauguugcacaucuuccugcugggcaauacuacuugguaguaauauaaaauauauauacauauauguacauacacacacacacacacacacacacacacacacacacacacacacacauauauauauauauauauauacacauaaacacauuuuugagauggagucucacucuguugcccaugcuggagugcagcgguacgaucacggcucacugcaaccuccaccucccggguucaagcgauucuccugccugagcauccuguguagcugggauuacaggcacgugcuaccaagcucagcuaauuuuuguauuuuuaguagagacggguuuucaccauguuggccaggauggucucgaucaccugaccuugugauccgccugccucggccacccaaaguguugggauuacaggugugagccaccgcgcccagccauaaaauauuuuaauuuaaaccaaagagagaaauaugauaagagcagacaacaaaauucacauucauuuuuuuuucuugagauggaaucucucucugucacccaggcuggagugcagugacauaaucucagcucacugcaaccuccgccucccagguucaaccaauuaucugccucagccuccugaguagcugggauuauaggcaccagccagcaugccuggcuaaguuuuguauuuuuaguagagaucggguuucaccaucuuggccaggcuggucuugaacuacugaccucaugauccaccggccucagccucccaaagugcugggauuacaggcaugagccacugcccucggcccauauucauucuuaaaguaaaacacgagaucacaaagaaacugcaaguuucgaggccaggcgugguggcucacgccuguaaucccagaacuuugggaggccaacgcgggcugaucaccugagguugggaguucgagaccagccugaccaacauggagaaacccugucucuacuaaaaauacaaaaaauuagccgagcgugguggggcaugccuguaaucccaguuauuugggaggcugaggcaagagaaucacuugcacccaggaggcagagguugcagugaacugagacugcgccauugcacuccagccugggcaagaagagcgaaacuccaucucaaaaaaaaaaaagaaaaugcaaguuucaagaguuauuuccagauacacauauagaccuccaggggauaucauccagauuccuccuggaaaauuaguacaauaguauuuauauaacccugaugguucaaacuacuguuaaaaaaugaauuuuugggcgggcacaguggcucaccucuguaaucccagcacuuugggagccugaggcaggcagauuaccugaagucaggaguucgagacuagccuggccaacaugguaaaaccccaucucuacucaaaauucaaaaaauuagucaggugugguggcacacaccuguaguuccagcucuugggaggcugagacaggagaaucucuugaccugggagauggaggcugcugugaguggagaucgugccacugcacuccagccuggguacgacagagcaagacuccaucucaaaaaaaaaaaaaaaaaaaaaaaaaaggcugggugcgguggcucaugccuguaaucccagcacuuugggaggcugagguggguggaucacagggucaggaguucaaaaucagccuggccaagauggugaaacccuguuucuacuaaaaauacaaaaaaaauuagccaagcgugguggugggcgccuguaaucccugcuacucgggaggcugaggcagagaauugcuuaaacccaggagguggaggauguagugagcugagaucaagcucacugucgcucaagccugggugacagugcgaaacugcaucucaaaagaaaaaaaaagaauuuuuuaauugaaaaaaaaauugcaugagauuucaaugaaauauaaggcaguuacaauaaugaaaggaaacugcaugacgaugaauaagauucacagacauauaaucucaaaacuaauuuauauagagacuauuuuuuuuacugcuacagauuaaguuacaaucuugauuggagacagaguugaacaaauuuagcaacaaacagucauuuucugcuuuuuauaaauagcccagacuguagucccagcuacucaggaggcugaggcaggaggaucaccugaaccugggaggcagagguugcagugagauaugauugcgccaccacacuccagccugugugacagaguaagauuccaucucagaauaaauaaauaaaauaaacuaauaacccaauauugaaaauuuugggaaaaaaccuuaaaauucuguauauauugaaaauuuugggaaaaaaccuuaaaauucuguaugaauauaaauaugacuugaagaaaugauuuuaaaaagccacauuaugaaugacagugauuuauauaaugaaauucaaaucuucaauauuuucugugauaacaauuuaccaugaguaacccaaauacaauguuuaaacguaauacauaaaauugaauucugucaucauugaaaauuugcuuacuuucaguccugaaaaccacagcuuuacacguguuuuucuauuuggucauuacaaagguguauuugucacggcaggaggauggaacucauuuuauuccacgauguguuagcuuaauuuauaacuuuuaaauauuuagacacagaguaugugggcuuccauucauacucuuagcaaggaccccacaaaugcuaggggccagugugaaccuagcacuccaaccacaaguacauuucaaaacuaggcugggaaugagggguacagaauacugauuuaacaacaauaauucccuauuagagcuagguggcuggcaugugccacaccaaaggcaagaaagggcaggcccaagagagcucuaggaaugacuguucaaggaaggaggcuauugucccugaagcuggaauguagucauggaggugguuucagggucaggaaaggacagcugcagccaaagggagaucuacaacaaccacaggagaaaacacuauccuccucuuugggccagagggaaagggagacagaugucaaggcaaagaaucagcugcaccuuaaccuccucacuuuacuuguccucauacugcuuuccuuccugccaaagucauuucugccuaaucagauccuaugcaguuuggaaaccaacugagcuccagauuuuaacagacuagcaugaaguaaaaauaauaugggggccgggcgcgguggcucacgccuguaaucccagcacuuuaggaggccgaggcggguggaucacaaggucaggagaucgagaucauccuggcuaacacggugaaacccugucucuacuaaaaauacaaaaaauuagccaggcgugguagugggcaccuguagucccagcuacuucggaggcugaggcaggagaagggcgugaacccaggaggcggagcuugcagugagcugagacagugccacugcacuccagccugggcgacagagcgagacucugucuccaaaaaaaaaccaaaccaaaacaaaacaaaaaacggauaaauccaggcauaacagaguagccuuuagcauacuaaauccuuucacuggaauuaauuacaaaauuuaacagacuuuacugguaaggggacuuuccaugacaaaauaguggaaacccaagcagaaaacagcaggagacaguuagaaguacuggauucuaaaguagcuggaacucaagaggcacaaucugggagaggagggaacuacagaaaaauaauaugcauagaaaucuccccuccuccaagucauuggcggacuccuaaacugcacauuuacagagugagacuucaaaaacuuaacagaacacagcaguuaaacgucaaagagcuaauaagauuauagcagcuaugcugaguugagaguugaaauuuaagaccagcaagauagagggguuuugguaaagaccuggauuucggguugagacucaaggagggccuugcccuaggaguaauggcuaugccccaggaggaaaagagaccacuuccaagaagaaaggacaaacugaaauagaccagucuuaacaagaccuauaaucaacccucaacaggaucaaugucaucugcuacuacuauccacgugccuaauggcaaccuuagucugcuuugaaggaaguacauccggaugcuaauaauguucauccaaaauuuccagaauccaguaauaauuuauggacuaagaggaauuuuuaaaaucccaaaacugacuggaaaaaaauggcaauagaaacaaacccacaggugacucagauauuguucuugucaggcaaggacuugguuauguuugagaaaacagaggaaagauggagaaguucuguagugaccuggcauccaucaaaaaaaaaaaaaaaaguuaaauggaaaaucuagaauuggaaaacacagugaggaaguuaagaauucaaucgaugaauaucaaauuagugaagaagacaagcuagaagguacacugaugcacagagauaaaaggauggaaaauugaaauaaugugccaugugggauuccuauucaguucuagaauaagaaucuagaauaaugugccacgugggaucucuuauucaguucuaggauaagagaaaauagacaaugcaaaagaagcaguauuugaaagaaaauaccaggcaagguggcucacgccuauaaucccagaacucugggaagccaaggcaggaguuugagcccaggaguucgagaccagccugggugacauagugagacccucaucucuacaaagaaauuagaaaaauuagcugggcauggugguggaugccuguaguacaggcuaugugggaggcugaggcuggaggaucaccugagcccaggaaagaguuccagguuacagugagcuaugaucgcaccacugcacaccaaccuaggugacagacugagacacugucucgaaaaaaaacaaaaacaaaaaauaccuacaauuuuuuaggacaauuuccuaaaacugaagaaaaacaucaaaccacaugaauucaagcucugugaaucacaaauaagauauaaagaaaaacgcgaguaggcaugucauaguuacacuggugaaaaccaaaaagaaaaucuuaaaagcacuaagguuggguguggugauucacacuugcaauuugaacaugucgggagguagaggacagaggacugcuuagcccaggaguucgaggccacccccuggcagcauagugagacccccaucucuaaaaacaauuaaaagauuagcuggguaugaugguaugcaucuggagucccagcuacucgggaggccgaggugguaagacugcuuaagccgggagggugaggcuacagugagcugugaucaagccacugcacaccagucugggggacagugagacccugucuuaaaaaaaaaaaagaaaagaaacaauaaaaccccagaagccaauguaauaucuuuaaagugcuggggaaaaaucuacuuaaaauucuauauucaguaaaaauauccuucaagauuaagagcaaaauaaagacauuuucagacaaaugaaaacacuguagaaaugcuacaggaaauucuuuuuuuauuuuuggagacagaguuuuacucuugcugcccaggcuggagugcaauggcacaaucucaggucacugcaaccuccaccucccggguucaagugauucuccugccucagccuccugaguagcuaggauuacaggcaugcacuaccacuccuggcuaauuuuuuguauuauuaguagagacgggguuucaccauguuggccaggcuggucuggaacuccugaccccaggugauccacccgccucagccuuccaaagugcugggauuacaggggugagccaccacgcccggccacuaaaggaaauucuuuaagcuaaaguaaaauaguagaugggaauuuagcauaaaaguuggaaagcaggccaggcgugguggcucacgccuguaaucccaacacuuuaggaggcugaggcaggcggaucacuugaggucaggaguucgugaccagccuggccaacauggugaaaccccaucucuaccaaaaauacaaaaauuagcuggguaugguggugcacgccuguaaucccagcuacucgggaagcugaggcaggagaacugcaugaacccaggagguggagguugcagugagcccagaucaugccacugcacuccagccugggugacagcgcaugacuccauuuaaaaaaaaaaaaaaguuggaaaggaagaaaacuuuuuauuuguagacaugacugcauauagaaaacucuaaggaaccucccccaacucaccccccgcaaaagaaacuauuagaauaagugaauucagcagaauuauaggauaauacaagauccgcauuuuagaauuuuucuuaucacuuaucuucaacauuguaguagaaguucuaguuagaucaauaaagcaagaaaaaauaaaagacaaacuuugaaaaggcaguuaaaauuguuauuauucauggaugacaugauucuauacaaagaaaauucaaaagaaucuccaaguuauuaagcuuagcaagacauucgaaaauaaauuuuggccaggugcaguggcucacgccugucauccuagcaauuugggaggcagagaugggugaauuaccugaggucaggaguucaagaccagccuaacauggugaaacccguaucuacuaaaaauacaaaagaauuagcugggcaugguggugggcaccuguaaucccagcuacucaggaggcugaaacaggagaaucacuugaaccugggugucagaggcuacagugagccgagauugugccacugcauuccagccugggugacacagugcgacuccgucucaaacaaacaaacaaaaaaucaauuuuauuucuuuauacuagaacagaaaaauauaaaaauaaccauuuucugcagcaucauaaauaucaaauauaggaauaaaucuaaugaaagcuauuaaagaacucuacagugaaaacaaaacauugcugagagaaauuaaggaagaucuaaauaaaugcucauugauggaaagagucaauauuaauuuuucuccuaauuaagcuguagaugaaaaucccagcagggguuuuuguggaauuuguaagguaauucuaauguauauacaaugugcauacagagccuagcauaaccaagacaauaucaaaaaaaaaaaauguuggaagggcuuauaaagcuacaguaaauuaagauagugugguauggacacaagcaaaaacaaaacagagucuggaagcagauauacuccuaucccuuauuucuucgcauuauaccacuucuuuauacauuacacuuugcuaagauuuauuuuauucggccgggcacgguggcuccugucugcaaucccagcacuuugagaggguggaucagcugaggucggaguucuagaccagccuggccaacauggugaaacccugucucuacuaaacaaaaauuagccaggugugguguaaucccagcuacuugggaggcugaggcaggagaaucacuugaacuggagguggagguugcagugagcugagaucgcgcuacugcacuccagucugggagacaagagugaaaugcugucucaaaaaaaaaaaauuauuuuauucaacugaguucugcaaggucuuuuacuagccugaugggaaggcuggaggcagaaggcuauauguuuuucaaaccaaacuaaaauguccaugguuaauucugcaggcaaugaagagccaucauuuccgaagugccuugguaccggguuacacugaugaguaggaugucccaaccaguaaguauauacaagguacugagaagaaaugaaaaaagaagacggucagucuucugggaggugaaauuugagcuggguuuuaaagugucuaccaaccaaugauggcggauauuccugguauagagacagcauguacaaaaccacaaauagccgggcacaguggcucaagccuguaaucccagcacuuugagaggcccaagcagguggauugcuucgauucaggaguucgagaccagccuaggcaacaugaagauaaccugucucuacaaaaaauacaaaaauuagcugggcguaguggggagcaccuguuguuccagcuacucuggaaccugaggugggaggaucgcuuaagcucggaaggcugaggcugcuugugagccgugaucgugucacugcacucagccugggccaaagagcgagacccagucuccaaaaaaaaaaaaaaaaaaagaagcacaaauauaugggaacuagaaggagugggacuguuguugcagauaaaguacaagugcaagagugcuaguagaaggaacuggaaaguuugaaaaguagacaugggucaugucaggaaggucccugauaccaaauaccuuaaaauuaaucuuguaaaucagcagcguucaaacugugcuuuugggguucagcaaacauuucauuuuuuuuuuugagacggggucucgcucuggagugcaguggcacgaucucgacuaaaugcaaccucugccucccgguucaagcgauucuccugccucagccuccugaguagcugagauuacaggcgccugccaccaagcccagcuaauuuuuguacuuuuaguagagacgggguuuugccauguuggccaggcuggucucgaacuucugaccucaagagauccgcccgccugggccucccaaagugucgggauuacaggcuugaggcaccacgcccggccaggagucaaacuuuugaaaaaucacugcucaaugaaggagagauacaggugugauggggcuucugaaacggaggcugcggagcgagacuaaagucugaaggcccaguuacuacacaggagcaggaggcggcgagaaucgcuggaagcggggagcacuaacccccccagucuaugagggcaagguuaaaggaggcggcaaacacaauccacgucagggccuggcccggaguucccgacccccaucuggcggaauccgcacucaaagcuccgucucuaaaaccccgacccggcgcgucauccucccuccgaccgacagcagaaacccugccccuuucgaguaaggcgcaggaguaaagaccgaaaccagagccgcaugaggaggcuuacuaauuucucucagggacgccccgcccaacgcuucugaaacaaucuucgaagcgaaacggccccgccgacccc

SEQ ID NO: 191414 - RNA, 18542 nt, Homo sapiens
uaaggcaacagacucuuuauuuaaugugguuuaaaauacaucaaaaucaagucccuggcuguugugaauacccaaaggagacaaaaaagcugccagugcagcuucaaacaagucugaguggccgggcugggccauaaggaaagcaguuacagggacagaaggcagcucccuucccccaggaagggcaagaggagcaggugccuggcugucccuggggugaccaccucugugcugugcaaggcggaaaggcuggggcagcagcuggagaaucagcucagcaggccuuggcccucccccguggacaccaggcagcuccacuggccuccgggucagcccucagggccaccgugaugggguggaggaggguuaaauaaccaucuuuacagaaauaacagucuccuacagaaagugccugagcucagcccaugguccgauaaccucauggaaaacaaacaacaaauaaaaaaaaaaagugcugcugacaccucucagaaucugguggacaugaagcucucagcuggacaaggcccugaaaacaauuuacuauuagcagagccaugcgcucuugagcuucaccugcugugguccccuggaggaaaagcuagcaaucuaagaaaccaacacagaucuugguccuaaaacugaggucacaagugugggacccacccaggugaggaagacacuggccuucacucauggauaggcaccuccccugcaucuggcccaggaccugggcuacuuuggaaagcagaagcagagcagcuguagugauugguugauuuggucaaugaagagaagaaaaagguagggaaccucaucugcagacuggccugaaggucuagacauggauggagcugugagcaaaggcugcaccuugccuggggcccacauuccugaccugggaaacccagcuggggccaccugcucacuguggccuccuacaccaccacacugggauccagcagcuccagucccuccacaggcauuaagagguagcugaagugugagucaggcaauuaugugggccacuguaggccuuuccccucucuucaagggggaaggugcauaccucugccucuucccugcaccucucucgccuagcaaacacucugugagguuggcagcucuuguaccagcuuagccuggcacaggggcugggguagggaaaaggcccuacuggagcaggaagaggcaaggacuacuccagacagagggauucaaaggggaagaaaaaggucaugggaaacacuucacaggacagcaguaucucagccagagauggcagagaucucaacacucacacagcugcuugagggcaccuagaugugaaggauacaccagagaauagcaggcaacucugaugcagaucagugguaccugcccuggggcaggagaaggagaaauggugugccauucauuugccaucucuggucucagucacacaugauucaguacuuaacauucuuugugaaccaacuuaucugagagauuuaagguaagggcuaaaagagugggcuagguauggaagaugaagggaccugcaggacaaugaacuagcuucaaagaaaaacagcaagaagcaaagcccuaaccauccuauccaucuuggucugagucauucuguugucccagaaaacugcuuggcacaaacacuggcuaauacccuggcaaguuugcaacagcagaacauucagcauauagaauggcucuacacaguacauaguaguuauguacuggaguggggguagaacaggacacagaaacaacugucugcagccauuuuauggauuucuggggcccagucaauaguucaauuucauuucuuaccuguuagacaacagcuaugggcucccacacaggaagaaguagaauccccaaggacaggcagggaggugccaggaaauagaaucaggacaaaucuugaggauugcacaugugggggugggggcaggaagcagaaaaacccaugaagccaaagaggcagcuggacaugggacccagcaacugcugcauggagacagugcugaugggaacuggugguggccucucaggacugaaacccacagguaagcuuguggcaaagccaucagaagcccuuuccuuucuuuuaccacaaacaaccugaucucaccaaacaggaaaccucagcaucaagauggcaaaggagccaagugggguggugaaggaggugggacacuggaggccaggcacccaggcaccacugcuacagcaucccucuuccuuggaagguccucaauacaaacacugucaugugcaaaaaaaaaagaaaaagaaaaaaaaaaaaaaagaaaaagaaauaaagaaaaaaacaccuucagaaauaauccuuugggugaucucuugucaaucauuugugcaggcuagagaggcaccugugaaugauaaggcuacugagaagcaucauuggccugguccuggcacuaccaaagggcaggggaagcgaugcccaaggggcuccugaccagcacaucaucccacgcaaaaacauucuccaggucccuuguuccaggcaggaaauccccagcucugagcgcccugccagggcucugccuagggacaccuuuuccaggucuagagaaucaaaggagccuccagagcagcuaggagggccugagcugaccaagcaagcccugcucacaagacaaaugcagucaagaccuggguguauuacuugucuugagcucugaagggcagggaggggucugagccucaaaucagacagagaaaugcucaagucacuucugccaacucacugugauggcagcuacagaugacagccccucucaagacucuucagcucacagacaagccacugacuucaucuguacacacccccauccccaaugcaagcccacuguacacuuacagguauaaaugcauuugcaaggccuugcaaaaugcccuauguacguaaaacugacccacaaaauccaaaauugcaagugccagaugccagccaggucagaacauccuggcuucagcaaugggcugcucagcaugggagccuuuuaugggccaggccuggcugggcugccgcucccuucccagcaugacccaacaccaggcucucuaggcccuggcggaggugggcucuugaggcccagucuggccugaugcuucugugcucggugcuccuggguagcaaggcgcuucugugacccugggggagcugggugcuugagccccaggccccucuggccuccucucagggccacugucagugagggagcccuggccaccagcacucagguccuguacccucuuguucaggucauugcgcucugucugcagugcccggcacagcuucuccagccguuggauuuuuaccugcaggcccuccaguucuuuaucccggacuguuuucuagggaaagaaaugagaccuucagugccgugccccaucaaccucccacuuaccaucaccacuuggcggcaaacacuuuaacaaggcugagagcagaccgaguccaaagcuggcccccucuaggaaacaguccuaguugaagccaugacuaggcugucagguggggcagcauggugcagaaaaggggcacggcuuggagauaacguauuccuccauuuaucuaccacgugaccuuggcaaaggacuugacuuuugagccugucucaucuauaaaacaggacuacuaauaccauccucagagcucaagagaagguucaaugaacaacguaccuaaaaacauucagcagcaaaaaagacaaaaaaaacccaaaaacuuucagcaaggucuggcuugcaguugcugcuccaucguuaguuccuuucuucuacauuacaagcugugaaaucacaaacuaccugggcugcuuuacauguaaaccaggcacaucacuggcacccguuuuuuucugcucuuuuauuccuuucuuccauuugcucccuucacucccacuggagaccuaccacugggcucaccaccucccauggggagagaacagcauuaacuuuggacuuggacauugugugcaaaucucaccucuaccucaugcuagcugugucacugauggguagaacauacaggaaagggccugauaugcgcuaagugcacacccccacccuggcugcagaucacagacagcccaccuccucagccaucucaagcagggccuuguugcugcucucccaccgggaccgguacauggugguuucuuucuccagcuucuugaucuucuuagucaucuagguuaugugacagacagaaggaaauggucagagcuggccucuccaaggucugugucuccaagguggggacugcaccugugucuccaagguggggaaugauugaucccaaggcgcaaggcauuacaggaugcagucaaugcccucugugccaccucaccaccaggaagucagagguguccaccaccaauaacaaggaaugguaaggggccaggcaugguggcucacgccuauaaucccagcacuuugggaggccaaggcgggcagaucacuugaggccaagaguucgagaccagccuggccaacauggugaaaccccgucucuacuaaaaauacaaaaaaaaaagaaagaaaaaauuagccaggcaugguggcacgcgccuguaauuccagcuagucaggaggcugaggcaggagaaucacuugaacccggggggcaaaggcugcaaugagcugagaucaugccacugcacuccagccugggcaauaggugagucuccaucucaaacaacaacaacaacaacaacaacaacaacaaaccccccaaaaaaaccaaacaaacagaaaagacugccccauucccugggacaaccuggaguguauacauaccacugauacugccucaagaggggaaaggcugugaaccuuccuaacagcccugcccuugagacaccccagaugggagcuuccugaaggcaggcccaacaauuuugaaugaagcagcuuaugccccagcagccaugccuggccuggaccacaguuaccuuuuccaucuccugcuugaauguggugaauaccucgcugcuuuuggaaaguguguucuggaacuccucaaacuucucuguguauagggcaagcuguggggagaaagcagcccacagauaagacuggguuucucugggaggcacucuggucaacacacucagacccguccuugacucucugaccaguaauucuauugagauacuauuuuuccuuaaaacaaagcaaagcuauauauuuggaaggauauaauccaaaaugcuaagccuggaaaguaggagacuuagggugacuuuuauuuugccuuuauguugauuuucaaacucuucuguuccuaccuccucaaaagcaauacauuucugagcuacaaaugaaguccucugagcccaccuaacuaccuggucaccaccacauagguacugugcagguccggagagaacaaaggcucaaccaaggcgucauagcagccaggacacagccaguccuagaaugagggucccauuucacuacccccaggauggggcccagugagggaaacuugaaggcacagggucagguuauaugcucucaccuguugcuucaggugggucucuugcugcuucaucagcucacacauccucugggacucuacugccucuuucaggagcuauuuccaagacagaaccccagauccugucagaagcccccaggggcuauguuugguuuuuagccacaagcaccagacccacugaggcuuccugcucucagacugguacucaaggaaucugugccuggucuggccagacuucucccauauaacccggcuaugagcugagccagagcccagccugucuccucccacccccaccccaacccuggggccugagccucacaaaauccuucucccgcuggugccgcucuucugccuccuuuagcaucuccugggccugcuggagcuuggcauccaccagcugcuguuguagguccuuguguuugaagacuuugucgauaugcugcaacaaagauggugggagcagucggcuugucaggcgcucccuuucucaggguagccccacagccacagaccagggcacuuugcccagccccccaucucaaucugauaugauggacucccauguguaccacacaacaugggccccaagucucuggaaggucagcuuuccaaccucacgucguuucucucccagugagucagaccuugguaagcacaugguuuauggauggaaucugcucccaagaaggcaagcaauaaacacacucaaaucucugaccccaggauugaucaccuauggggcuggaagcccucacuucugugucccugauucucuuguaaaugggaagaaugggcaaaaacaaugccucuaagaacauaacagccuagcucaguuggcaaagacuugccauaucuaggcaaagacuagacaugugcauccccaaggaauggcuguccugccuacuagaggagcgcugcagaccugugucaggugagagagaagggauggagagaaggugaaggacucaggugcuacuucaaagguaaaaucaacuggacuugcugaaauaagggaaaauaacuccauuuuuuuggauggggaagggaaggugccuagcagguaaguccaguuuggguaugaugagggugccugugucugucuggggagggcuguaaaugcaaagcagcagggccugguaguccugcaccuccuucuccacagguaguacuaaguccuuuuuugccuuggcggggagagaaaacggggguauucagauucuugaaguucgugucucacuguaguggcccaggaagccucuaugucucagcgcugagggauaagaaccaaaccaacuccccucaaaccaaacaagcagcuuuguucccagaggaugaaguauggcaaggaaaggggugggucaggggagcgcccucuagguccugcacacacgaucaucacuuuggccuaugaaccuaagagggcagaucuucccggucucacccacugccacaccccaggggcuaggaaagggccuaauccagagcagguccucugccagcccuguaagggggcugcaggucucccuucucaugaugagaacgcgcccagaacagccaggugacuggcagggaagauccaaagauucaagugccugggguggcagccaacgcagugacaaagggagugacauccugcuuuuuuuuuuuuuuuuuuuugagauggagucucgguauaucacccaggcuagagugcaguagcacaaucuuggcucauugcaaccucugccuccuggguucaagcaauucuccugccucagccuccugaguagcugggacuacagccgugcaccaccacaccuggcuaauuuuuuguauuuuuaguagagacaggguuucaccauguuggccaggcuggucuugaacuccugaccucaggugauccgcccgcuuuggccucccaaaguguugggauuacaggcaugagccaccacgcccagccugauaaauucugccuuuugaguggcaggagcagcaaggaaucaguggacacagucucuggaguccaucacugaucacagguacaccccuccccugcaauuccaaauucuacaaaguucugaaaauggaaauugucauaagcuggcagccagacuugaccugcaucauuguaagcccauaauguaggugaguauuuggaaguucuacugcauaaauacauuaaugugucuggcuuccccaaggcccugcugagggugcuauauaacacacaguccauacauguaccuccauucuaaaauguggauaguucuaauuccaaaagaugccuggcccagucauuugggacaaggcacuguggaccuggggcuguguggcuguaagugagucucuucuccacaccuguuuuuuaucuaugaggaauaacauuacucuccucccaaggaggaggaggaggaagaaagggagaaugggaugaagccugaaaagguacugucccagugccuagcacacacucaaaaccucacaauuucugggccaugacugcuguccgugauacccuuaccuccucgcgcagcucauacugcucaaucagcuucuugagccucucagccagcuccauguucucuuggcgcagcuuggaguugcgcucauugugcuguuccaucugcagcugaaugucauucagugucaccuggaagugcgaggucaccuccuugcgcuucuccuccuccucccgggcccgcugcacaccuucuuccugggcaaagaagucagcccgagagccaucauccacugcuaccucacaagggucccccagcuaguccacagauggucucugccaacagcccucccugcucccaaagcguggaguagccagacuccaggauguugugcaaugcggguuccaaugggccccucuguauaucaggugacaucaagugagauucucccccuagaaaaaugcaggcacauggcaggcgcgguggcucacgccuguaaucccagcacuuugggaggcugaggugggcggaucacgaggucaggaguuugagaccagccuggccaauauggugaaaccccguuucuacuaaaauacaaaaauuagccggcgugauggugugcaccuguggucccagcugcuugggaggcugaggcagaggagucauuugaaccugggaggcggagguuguggugagcuaugaucgcgccacugcacuccagccugggcgaugggccacagagcaagacuccguccccaaaaaaaaaaaaaggaagaaaaaaugcaggcacacaugcacacauguaagugcuaagugccauucugaagcaagucggaucuccuaaggccuauucuuccagauuucagauuaaugugcauuuguccccucuguacccccagagaccaagcuguuaaaauuuaguaacacccaggguuugcaaaguugugcagaauuaggcacucaacacuuuugauggggaaggcacacugcccccucacuggaaggcaauccagcaaaaucuauuaaaaugaaaaaucugcauauacugugaccuagccauuucaauuccaugacuuauccuacagauaaguucuauauaacugaccagugauaaauauaacaagaauuuucacuauaguucuauauguaauaaugaaaaauuguaaacaacccccaaaaugcuuuaacuagggcacugauauaauauauccauauaaugagaagauagcccuacacauacugauagggaaaaauguuauguaaagugaaaaaaaggcacaggauaugaaaugguacauguauaauaauuucauucuaaaaacuacauguaagauuuuacauauaaaaaagaaaguuaaaaggcuguauuuaaacuugguguaaccacagacugaccucaccauagaagcagcagaacaugggaaggacccagguuccugacugaccaacgucugggacaagagcugcuugucagagccaggccuccgcuuaccaggggacugucauuucauugagaaauacuaacgccagugcauuauggauucucuuaguacuuuauccuucaccuuaucuaauacaugucaaaugauuacaagcaguacucucuuaacguaaggcauuauugagaaaguguauuucuaugccacaagccugcacuacuuuuuuuuuuuuuuggacacugagucucacucuguugcccaggcuguaaugcagugaugcaaucucggcucacugcaaccucagccucccaggugcaagcaauucucaugccugagccaccugaguagcugggauuauaggcauuugccagcacacucggcuaauuuuuguauuuuuaguagaaugggguuucacugcguugaccagguuggucucaaacuccuggccucaagugauccauccaccucagccucccaaaguguugggauuacaggugugagccaccacacccagccuugcuuuuuuacacugauuucauguugaaauuguaauguuuuggauauuggguuaaguauauuacuaaaauuaauuucuguuuuuuaguggccagaagauuuuuaaucacuuaugugugccacugcgccuggcccuagccugcacuacuuuuuaagaggaaagcccaugaaagaaacauuaaguggaagucaaggaaaccagagucaccuguuccagggggcccaggccuaccuugagggagcgguugugccgcugcagcucacggcauaggcucucaagcuugcugcgggccaggacggccuugcugugcucaccgcgcaggugguccuucucuugcaccagcuggcucugcuuuuucuguaggagcuucaucugcuucugugaauuccggugcuccuccagcuggggacagggauagggagggcaggugagcaucuuguggggccuuccugguggggggaucacuaugcaggucuagggucuccugagcugcccugacccuuacccucucaggccaggagcacucucaugggcugaugcugugccggugcuuacacgcuccucccaugaacucacaauaaccccaaaggcuccaccguagggacagagaaaugguaacucacuagggcaagcaggggccacacagccagcagaugccaauuccuauuccagcucugacucugggccacuagagccacuucaagcuguugcauuuccccaacuugcuggacacucaugcccgaggaugagaccaccugcuaccguaccuugugccuauuaacagacagacccccaucgcucccucgcauuccuucaaaacguuagcgcugcguucaucagcgcucuccccaacacaauuacuuuucucauuuguggccacuucaguaucaacagauaauccuucuaacucccuggccucacaguccaucaccucuuccacaaacccacuccuuuccccagcucaguuccccucccaugacccuauccaggccuguacaacagaaauauaaugcaaaccacauaaguaauuaaaaauauucuacuggccgcacuaaaaaaguaaaaaacaggugaaauuaauuuuaguaauauauguauuuaaccuaauauccaaaacauuacaauuucaacacggaaucaauguaaaaaagugaggccgggagugguggcucaugccuguaaucccagcacuuugggaggcugaggcaggcagaucacuugaggucaggaguucaagaccagccuggccaacauggugaaaccguuucuacuaaaaaaaaaauacaaaaaaguagccaguuugguggcaugcgccuguaaucucaguuacucaggaggcugugaggcaggagaaucguuugaaccuggaagcaggacaucacgccacugcacuccagccugggugacugagacacucucucacaaaaagauguuuuauauucuuuguuuuugcuuaagucuucaaaagcugauguguaucuuacauuuauagcauguucaaauucaaacuggccacaugucaauuagcuagagacgaauuuaucuuggacagcgcagaucuagacuuugucacuaccagagagcacacccacuaucucaauuuccagcaucccaguccaggacuaccaucaccuaucuuuuuagcucauuccaaucaguaucugugauccucagaaagucucuuacccuauaggaccuccaauccauugacucaaccauccuuccacucuccuuuaaaauaacuacauuaccuggcuuggauuucuuacacccucaacucucuuggcccuuccccaguaguacugcaacccuaguaaagcaccuuccugcuuuacaccaguacuauaacaacccuacuugaagagucucacuuuaaauucauggccaccaauuucaggaagaccagcaaucccaauacaaugcauaugcuauucacacuccucuccuuccagacaacuauuucaucguucucaucaaaucucaaaacacagaagaaacuagagaaucaggggcacaagcugcacaucuaccaguccaccugccccguccucuccuccagucacacagaccuagccaugugguuaccacagccaagcccccuucuugggcaggccucagcuccccuccucuacucacaacaccacucuagcaacucauuuccucucuugcaucagcaauuuuccccuggcuggaucacuccaaaagggugcuuaucuuccuuauaccuuuuauuuaauccuuacaagaaugucauuaggcagguaugacauuccccauuuuaaagaugaguaaaguuccuuacaggaaaauauuaauaaauguguguggaaugaauuaauuuuaaaauaaauacuuagaggccaggcacaguggcucacaccuguaaucccagcacuuugggaggcugagacgggcggaucacgaggccaagagaucaagaccauccuggccaacauacugaaacucugucucuacuaaaacauacaaaauuuagccaggcauggugacaugcaccuguaaucccagcuacucgggaggcugaggcaggagacucgcuugaaccugggagguggagguugcaaugagccgagaucgcgccacugcacuccagccuggugacagagcgagacucugacucugaauaaauaaauaaauaggccaggcgugguggcucaagccuguaaucccagcacuuugggaggccgaggcgggcggaucacgaggucaagagaucgagaccauccuggcuaacacggugaaaccccgucucuacuaaaaaaaaaaaaaaaaaaaaaaauagccuagcaugguggcgggcgccuguagacccagcuacucgggaggcugaggcaggagaauggcaugaacccagaaggcggagcuugcagcgagccgagaucgugccacugcaccccagccugggcgacagagcaagaccccgucucaaaaaauaaauaaauaaauaaauacauacauacauacauacauacauacauacacaggcugugaccaucaauggauaaaucuguuaguucaaauucugacaagggaccugaugauggaagaaucuggcugccccacccccaacccacugaacaauguuacaacaaagugggaagagcaugcuuugcauuuauugugauggaacaugaaguacuuaugaagaauucuugucaaaaaguugaagcugaauuggaucaagcuuuagagcuaacuucuacuucacuuacauguaccaggagguaaagaaguaaaaugauaccacagagaugacaaagcuagaagggggcauccuacaagacagcuagucuaguuucuguuaaaagucaaugucauggggaauaugaggaggcagugacaagaagacugcucuggaguaaaaggaaaaaguaucaagugacuaguguuaguuuuauuaacugugauaauggcucuaugcaucuguauuugaggaagaagcaucaagaucacaaggugucuuggacucaggccaggaacaagggcucuaccaccuuggaaucauucuuugagaaauuucuuucaaggaauaugcaguuucuccucuugcugcacagcccugaagaggcuggcuggaagugauuccccauuuaacagauaguucagagaaaagcugaacaggaauuaagccaccuacuugacucugcacccccaaccuuacaccagguggcaugcugauuuucccaacgcagggaaggugcccgcggaggggggaacugaccaguucagcauacuucuugcacagagcagccagcuucuccucugggguacucagaguauucaaugucugcaucagcaacgugaucuccuucccugaaaagcacaggagcaaagacaugcacccucuucuccagguguccccuccaggccugggcucacacucaugagugcugaagacagcccuccccaucauacuuuauauuuugcuuguugauuagcugccuuccuugccauaaggaccaacucaauccugcccucacuauagccccaguacuguccauaguaccaucacagaggauaugcucaacaaaugcuuaucaaaugaacgacuguacccuagugaaaucuccuuaguaggcaccauuggcaggagaaaaaaacugccugcucuaccaauagaagaaaggugucccacuuaugaauucagggcuacuguuucauacuguuucaaugcaaggaaggcccacccuccugauagagguaggauccaaaaaggaauagguaucuuagccuccuugagaaauacuaaacucuugucaacagaguagccaaacagugaacuuuaaaaugaagauacuuucggccaggcaagguggcucaugccuguaaucccagcacuuugggaggccgaggcaggcggaucacgaggucaagagaucgagaccauccuaacauggugaaaccccaucucuacuaaagacauacacaaaaaaauuagcuuggugugguggcacgcgccuguagucccaguuacuccggaggcugagguaggagaaucgcuugaacccaggaggcggagguugcagugagcccagaucgcgccacugcacuccagcuuggugacagagcgagacucugucuaaaaaaauuaauuaauuaaaaaaaaaaggcaggguacaguggcuuacgccuguaaucccagcacuuugggaggcugaggcgggcggaucacgaggucaggagaucaaaaccauccuggcuaacacagugaaaccccgucucuacuaaaaaaaauacaaaaaaauuagccgggcaugguagcaggagccuguagucccagcuacucgggaggcugaggcaggagaauggcgugaacccaggagguggagcuugcagugagccgagaucgcgccacugcacuccaaccuagggacagagcgaggcuccaucucaaaaaaaaaaaaaaaaaaaaaaggcaggguacgguggcccacgccuguaaucccagcacuuugggaggcccaggugggcggaucaugaggucaggagaucgagacuauccuggcuaacacagugaaacccugucacuacuaaaaaaauacaaaaauuagccgggcaugguggcaggcgccuguagucccagcuacucgggaggcugaggcaggagaauggugugaacccgggaggcggagcuugcagggagcugagaucgcgccagugcacuccagcuugggugacagagcaagacuccaucucaguuggggguggggggugaagaagaugauacuuuccauguaugugacguuaagauuuuuuccuuuuucuuuuuuugagauggagucucacccugucacccaggcuggagugcaauggcaugaucucagcucacugaaaacucugccucacggguucaagugauucuccugccucagccucccgaguaucugggauuauaggcacgugccaccacgcccggcugauuuuuuguaucuuuaguagaacugggguuucaccauguuggccaggcuggucucgaacuccugaccucauaaucugccugccuuggccucccaaagugcuggaguuacaggugugagccacucugccuagucgucccuaagauuuuuuaaaguuccucuuuaaaguaagaggauacauaaggggaaaagggaauaggaauaaaacauggauauaaugacacucgacuuagauucuagauucuuuuuuuuuuuuuuugagacagaguuucacucuugucacccaggcuggauguaguggcacaaucucaguucacugcaaccucugccucccggguucaagccauucuccugccucagccucccaaguagcugggauuacaggcgugugccagcauguccagcuaauuuuuguauuuuuaguagagacgggauuucaucauguuggccaggcuguucucgaacuccugacccucaggugauccacccgccucggccucccaaagugcugcaauuacaggcgugagccaccacacccggccuagacucuuaaacauacauacccugcuguaaaaugacugucacugccuauuccccauugccugugacugagucagggagccuucccucugccuccccagaagggcccaagagaucagcauggagacugcaauucgcaggcaugugugccaaauccaacccacggauggguuuuguuuggcucuuaccauuuuagcugcuaacuaugaaaaaaucuagaguucucacauaacucuagauuucuggcuuuucuuuauuuaaaaaaaaaaaaaaaaaaaaaaagccugacugcacccagccuguaguuuugccugcucucaguuggcuagcugagagcaacuaaucaggaagcaguaaagccuccaucuucagguggccccauggccagcccagcuuaugcagauauuuggguuuucaacucuggccuagucuaauuuucuuacuguaaagagaaauauaaacuaagacccagagaggagaagggacacacccaaggucacacagcagguaguacuggcuggcacaggagccuacccuagccucccgucuccauuuucucaaagagagaacaggucccaugccaagcuccaguugcuccaaaacccagaaggcuuugugcugguaacuccugcaucucucuaugccguggcccccacaucccuggcuuugauuagacuagagugacuugcugcucugagaaguaccguuuuccuuugaauccuggcagaacagacuggcccagagaacgucaaguccaaacucccucuccucaccagcuucacaaagagccgcccucugcucacccaaacccuuggcuuuuuucuucuccuguggccuucgauggucucggucuccgaccucgucacucugccggaucucuucuguguuuggaucccccuuggaggguuccuucucuccauugacuacuggaguugguucaggcuccccauuccuugccacauagguccgggacuucucugcaucuucggguucagccggcucacccugugccccauccucgccggggccccccugguuauuguccacacaguaugugcucaguaugucuuccaguuggcggcucagcuccucagagacaucacgaagggccccagacugagccguucuggcuugagccccuacagcaggagaggaugagggguagagugagaaagaagacgauuauaccacugguugggauuuuucaggcccagccaaacucaucaguuugaguuaaauguugccuaacuuuuuuuuuuauggaaacugagaagcaagaauggaguaucauucagcaaaucuaguuccugucagaauuuagauucgaaacaucuuuuaaaucaagaaauuauaguaaucguugccuaacuucuuuaagucuguuuacuuguaaaaugacacaacuauuucucacuaccacccgaacauauuuguuagaucauaaaaguauguaaagcaucagcacacagggauggcacggagcaacuucuaguccaucuccuucccccccacaaaaccauuucuugccauucagaucauucuagaaaugccucaaacaggaagggcaguuagcugcugguggcugagguguuucuaacgggaccuggauuuccugacugggugccucguuuggcugccaccugacuuaaucccgucggagcuucucuccagaacucuguuccugugcuuagagggggcagcuccgccaacucgccagagcgcaggggggaccgcggcccccagcacuguccucucauucuacaucuccuccucccggacaaccuggccucggccuguaaguccagaagcgaggccgaccccacagcuccucccccugcccgcuggcaacgcagagcuggcacacacccuccggcuuccgaggagccuggcugcugccgggaccuucugcuucuacugcaggagccgccuggcugggccgcuccugggcucccucggguccugcuuccgguuguccugggcugcuuuuuggauuggauuguuuggcagccccguucuuuuugucuugguucuucauugugaugagcgaugcugggucaggagaagauccuuuagaaacaaacacaguugcuauuuuccagacuucgaaauucuucgcagccuggaucagaaauccccacagcaggcgcacaaagcuucuuaaaauaaacggaccggcaggcccgggcggagggcgccaacggcucucuggucuuggcgggucaggagagcccgacgugccggggcaggcuuucggggcgcagcucccacagcgggugagggaagaggccucuucucccuggagccacuucccggcacaaccggcccccucgcggcaggccgggcgcgggauuggcucagggccggagacugacguggcgggacucccggcaccgcccccgccccucaggccccacgugcgccccccgcgcgcgcagccacccacgccccgcgcgcccucaagccgcgaggcacgcccgcgcaugcgcauauccccagacagcccccggcccacgcggggaguuggcgugauuuccccacaggccgagaacaucccggcccgcacacucucaaauagucucgcccaccggccgccgcugcacguaccucaccgccgacguccgauggcuuccccaccuc

SEQ ID NO: 191415 - RNA, 67939 nt, Homo sapiens
cuuguggguggaaacgcgcuggcugacuggggucggcguuuaguucagcgcagcgacucggggaccuggagcugacgccuaguacguaugaggaagaacgggguggguggcugccugagucuggaggcgacgccucgguugugcagucugaaccugcccuucucagcugagggugcugacagcaaggggugggaggcgggccccgaguccccagcugugguaaguaguagccugggcucccuuucggggcaggagcggagccuuggggucucuggcggcaagacccagccccugcggcucccuucuucaagagcgcccaucguggccaguccugugccgggcauucccagggagaaaggccugcgucccagccuccuccggugccccauuuggccgaggaggcugacuuguuucugccacugauuuugcaguuuuugaucagggccuacuguaugccccccugagagagacagugaugaaggaaauguccgacuccuucuccagagcacagucuuguugagaaauuugagacucaugcccaugaacguggucauugccucagucguccugcugauauucauuuagcagcgcguuggggguauguugugaaccgggcacggucccuacucucagggcguuuaacucugguggggaaaacguuaaacaaugaccucacuaauacauggaaaugccuccuacugcugccugaugcuaugagugccugaaauaagcaggaagguuuuucagaggaaaagaugccugcgcugguagcugcaggaaguguuguaauuaauuaggugaagaagugaaggcagaaccuuccauagagaacuacuuguucagagcccugaggcacuugggaggaaaaugacuaaaagcacaaagagccaguguggcugguacaaagagaaugaagggaguaugguacaagaugaagcuguacgugauagcggucagaccuugcaggaauuuguagcuuuuauuuuaaaacggaugagauaccacugagccgucuucccccaguggggugugguggaggaggggacuugaucccucaggcucaguggugugaacagacggggguuggggaagcccuagucgauguauguggaccacuugggauaugcaguaauccuggucagagaugucagugaggacugagauauggguggaacugcagagaauuggacagauucuagagguauauaggagguaaaaugggugggacuuggugauggguugauuuuagggagugaagagaggaaucaaagguaacuccuagguuucuggcuuauguaguugaauagauggugguaccauucacucacuaucacggaaucccucaagcuggauagggaacacuagaagaugauuagagaccaguuuuuuuuuguuuuuuuuuuuuuuuugagacagguucuugcucugucgcccaggcuggagugugguggugcaaccuuggcucacugcaaccuccaccucccagguucaagcaauucuccugccuuagccuccccaguagcugggauuacaggcgccuccacugugcccggccaauuuuuguauuuuugguggagaugggguuccaccauauuggccaggcuggucuccaacuccuggccucaagugauccaccugccucagccucccaaaauucugggauuacaggccugagccacugcucccagcugagaucaguuuuuauugauugauugauugauuguguggggucauucaugacauccaagaggcaguuugaaauacagcuuugugcucagaagagagauuuguguugggaauauaaaauugggcauaauuuguauauacaugaauugagccauagguguggguaaggucagcuaagucagaaccuugacuaguuccaacauuuaauggugaagaacaggugaaccuacaggagauacagaagaaaggaaggaggacuggaagaaugucucagaagcaaaagaaugauuugugauagaaauuucuagaauuuaaauaacaugaagauugaaaaacauauuuuggcuuuuaucaucauggaggucacaguaaccuuagcaagaguuauuuuguuggugugauugggccaaaagccagauaugaggcaaggauuuggacaagaaaauguagguagugaaccuacacaguauuuuucauagaucugauuguaaagaggaggagaggaugugcuaaccgauggggauaagggauuauccaggauccaguugaggauccaguuuugagaaauuugagaauauuguagaagauuugaaagucacuguggagugugggagaaugagguuacuagagaaauguaggaugcaaggaaaaaaaaaauuuuuuuccagcauauccagcgguuuagugcaugcauggagaaaaccuuucuggguauggcaaggacaucgcuugcucaagacacauucuaaccucuaauaugucuucucuuccugaaaaaucuggaaaacuaaaaaccauuuucuugacucccuugcaccuaaggugaaaauugaauuuggaacugaguuaaauguggaaagaaggagggugugagucauccaguuuugcugccagucauggcaguaaauuucuccagucaauagcucccugguuugguggcuugcugcagugauagccauaacuuuccuggauuguggcaaaggugguauuauuuuguggguuagguguuguuccuggaaguucugccaaagucuuuuauugcaauacaucccuuacugcuuaaguggguucuguugucugcaacugucccugaccagguuagagguacugccagagaguuaaauauaaagacagaguuaaagggaguuuaggguguuguuggaaugaugggcuauggaaucuaagcuggauuggaagaaaacugaagaaaaaggggagggcugauagauuggaagaaaauagaggccaauaaaucaggguucuaaugaggucaaagaacaguauucucugcuagaggauuucuguuuauccuaaaaggcuuauucaguuaucuguuuaacuucucuacuucccccagacccucuuucucuuccuagcuacuacuuuuguuuguuuguuuugagacagucuuacucuguugcccaggccgauugcaguggcaugauuauggcucacuguagccucgaccucccaggcuccagugauccucccaccucagccucuccaguaggugggauaacagguaugugccaccaugccuggcuaauuguuguauuuuuuauagagauaaggucuugccauguuguccaggcuggucucaaacuccuggccucaagugaucuugcugccuuggucucccaaagugcuacgauuauaggcauaagccaccaugccuggcccccaagcuucugcuuuagcacuuaucacauugcaguguaauugguguuauuuuguggguuagguguuguuccuggaaguuccgccaaagucuguuauugcaauacaucccuuucugcuuaaguggguucuguugucugcaacugucccgggcuagguuagacauacugccagauaguuaaauauaaagacagaguuaaagggaguuuagaguguuguuggaaugaugauaucugauaucccuaucagauuaggaggucuuugagaacagggacuguguugaaaagggugguuuaggccgggugcuguggcucacuccuauaaucccagcacuuugggaggccgaggcagguggaucaccugaggucaggaguucgagaccauccugaccaauauggugaaacccugucucuacuaaaaauauaaaaaucagcugggcaugguggugugugccuguaaucccagcuacucgggaggcugaggcaggagaaucgcuugaaccugggaggagguugcagugagcuaagaucgcgccauugcacucuagccugggugacaagaacaaaacucugucucaaaaaaaaaaaaagaaaaaaaagggugguuuaguggcaaguguguguggcccuuggaauggccuaagauuugucucuuucuugcuguguuguuuuggacaaguuauuucauuccuguaaaauaggauuacuugcuuuguagaggaguuuuagggauugaaagcagguuuauaaaguaccuuauauauaaacaucaaucaauagcauacugaauugaugaauuaacaauuuaaaugggguaaaauuaaauacuucacuauuuuaguagacaauuuccauguguguuacacugugcuaggcacuggagauuuggggaggaaggauaugaugaugugcaagacaaaggcaugcuuacaagaguuccacacucuacaaagggaggaaaaaaaugucccuaaaaaugauuugaaucccauccccaucauucauauuuugcaaucuugagcgaguuuacuuagcuucucuuguguccucauuuuuaaaauggcaaugauaauugccuguuuuaugggauagucaagaagagaauuauugaaugucaugaagauaaaauuuuaaaaagaaaaauuaguuaagagaaguaaagcucuuagauuaauacauggcagauaugaagcacucaaauauuagcuauuauaagacuuugaagggaucuuaggaauaauugacugaaaguguagugucgagugguagaauaagugcugauccuggggucuuauaccaauguugcuaacugugagcagccuuugucaaaucacuuggcuucauuuucaguggccuaagaguaauagguuuaauuauuuccauaauuccuuuaaguuuuuacauuuucugaguucaucuuuuguguuuuuccuggcauuuuacuauuccucuuuccugcuuuuggcuauuuucucaacagguccacgacuggaauuugaaagcaagaagcaucuaucuuacauggucacucuagaauuuggugggagggaggaaaguuggaccaccaguuugacauuugaaagugucccggccgggugcggugguucacaccuguaauccuaacacuuugggaggccgaggcgagcagaucacuugaggucaggaguuugagaccaaccuggccaacauggugaaaccaugucucuacuaaaaguacacaaauuagcugggcaugguguugcaugccuguagucccagcuacuugggaggcagaggugacagaaucacuugaacccgggaaguggagguugcagugagucgagaucgcaccacugcccuccagccugggcaacagagcgagacuccaucuuaaaaaaaaagaaaaaagaaguguuccaucuguugaucuguccaacauauuaaaugggaccuagcuccuucuucuucuauauccuuuagaccagaauguguuccccccucuuucucuaccugugcuuggcauauagugaggcucaguucacucauuuaaaaaaaacugaguacuuguaguauaccagaccccaggaacacaaaaucaaaugagaaaugguccuugguuucauguuugaaugaauggauccagacguugcucauccuagcucuuccaugaaugauauccacauugauuccucuaauguugggaccuaguuaguguuagagcuauauucuacaaaauuuagauuuagaccguguauuagcccauuuucacacugcucuaaagaacucccugagacuggguaauuauaaaggagaaagguuuaauugacucacaguucugaauugcuggggaguccucaggaaacuuauaacucauggcagaaggugaaggggaagcaaggcacgucuuaaguggugucagaggagagagagagagagcaagagaaacugccacauuuaaaccaucagaucucgugaaaacucugucacuaucaugagaacagacugugggaaacugccaugauccagucaccucccacuaggucccucccccaacauguggggauuacaguucaagaugaaauuugggugaggacacaaagccaaaccauauucgauugugaauucuuuuugagguauagugcuuaagaaugcaggcucuuggccgggugccauggcucaugccuguaaucucagcacuuugggaggcugagguaggaggauugcuugagccaggaguucaagaccagacugggcaacauaaugaaauccagucucuacccccccucaaaaaaaaaaaaaauuagccaagcucguugguguguuucugucccagcuacuugggaggcugaggcgggaggauagcuugagcccaggaggucaaggcugcagggagccauguuuggaccauugcacuccggccuggacaacagagugagacccugccucaaaacaaaaaacaaagcaaacagugcaggcucuggagucauuauucugucucuguucauauccuaguaguuuuaguuagcuuacuuugcucacaauuccagcacagcuuaaagauaaacuaaaauuccuuuaaauucuuaggguucuagucaauuaguacucaaguaacaaaaaaaucuaaauccaaacaagcuggaaaaugauaacaacaaaaaucuugaccaggucaguaaggugacacauuaaaugaaguuccaaaaaggcuauaaaaugucuggccaauuuaauauuguucuuuaaacuuuucauugcuugggggauaggaggacaggauguguaggguuuuuuucccaguugcauguguacuuuaaaauuuuuuuuugaaacuaucacauaauuauggaagcauguacagauaacauuuuucugaauuauuugaguuaaauugcugacccaauaccccaacagcccugaaaacuuuuuuuccuacaaacaaggacauucuccucuauagccacaguguaauuaccaacauuaugaaauuaacauugcauuacuucuuugauccucaggccccaccucuugaugcucgagcucugacuacccauucugggcugcuccagugugugccuucaucaccuuauucuucccuauauugcaguucucuuuguagauuuccuccucacccagcuuagacucugaccucacucugggccaccauuucuucuccuguauccuuuacuuccaucccauacuuuccuuucucugucccuuguuuuggaaagagaguggcuaguaauugguccccuguugcuucccuauguaacacaguuguuuaaaacaugcaagcaaaaugcuuuguucugcauucagagcuauugcaaggcaacuccaaaugguguaccucaauccuugucgacuuacuggcucuuuuaaguguaugaaugugguccugucugacugacuguaucuaucuuaauguuauauacucuuuuuuuuuuuucuuucugagacagagucucuguugcccaggguggaguugcccaggguggagugcaguggcaugaucucggcucgcugcaaccuccaccucccauguucaagugguucuccugucucagucucccgaguagcugggauuacaggugcccaccacaaugcccagcuaauuuuuguauuuuuaguagagaugggguuucaucguguugcccaggcuauucucgaacuccugggcucuagugauccacccgccauggccucccaaagugcugguauuaacaggugugagccaccgugccuggcucaauguuauauacucuuauuuuuuuuuuuuagacggacucucgcucugucgcccaggcuggaguacaaugguacgaucuugguucacugcaagcuccaccucccagguucaugccauucuccugccucagccugccgaguagcugggauuacaggugcccgcugccacgccuggcuaauuauuuguauuuuuaguagagauggaguuucacuguguuagccaggauggucuugaucuccugaccucgugauccaccugccucagccucccaaagugcugggauuacaggcgugagccaccacgcacggcuguauacucuuuaaaaguagcagaacucuuuuuuuuuccaagugaaaucuuacacagaauuuuaauauguaaacuggaucaaagcagaauacguuguuacaguaggcacccuugcaguaauucucacucacucccccuuucacuguggcccaccauaagguugggagauuaacugugaaucaguaauaauugaccuuugccuaauuacugaggagaggcuucuacccaacugcucugagugggacuucucccagcucuaguuucuuuggggguucuacucccucagccuuugguauggaggcucaccucugguugguugacuuagaggcagccucacuggucugggaccuuguggugaccuagauauuucagaguugacuuuuuuuuuuuaauuucuuuuuuuugagacaggguuucauuuugucuucuaggcuggagugcagugguaugaucacggcucagugcacucuccaucucuugggcucaagugauccuccugccucagccuccugaguagcugggacaauaggcaggugccacuaugccgagcuaauuuauuuuauuuuuuguauuuuuaguagagauaggguuuuaccguguuguccaggcuggucuugaacuccugaccucaagcgauccacccaccuuggccuuccaaagugcugggauacaggcgugagccaccaugcccggccauaauuuucuuuucuuuuuuuuaaaaaauauuuuguggagauggggugucgcuguguugcccaggcuggccucgaacuucuggucucaagcauuccuuccaccucagccuuccaaagugcuggaauuacagguguggacuacuguaccuggccuggaaguugacuuuuuaaaaauaaauuuggauuaacuaaggagccucugaguaaccgcaauagaacccucgguuucuacagaauuugaaaaaaaguuuuauauuccauauuuaaaaaaugacaaccauuuacuuuccugaaauuguaaaccuguuauagucauacccccuuguucaugggggauacauuccaagacccccauuggaucccuaaaauugugggcacugcugaacccaguugcuaucaauuggaagacguuucuguuuguauuuucuacccacaaauuuaaugccuucuccaucuuaacuaagcacuuaucauacacuguggcuauaacuuuagcaguuugaggugcaacagcaaaacuaacaugaauguuuuuuucuuccucacaauuucagacaucgaagauucauucuuacuauagaucuuagcaaccuuagcauacaauuuuuuuuuuccccuugagaacuuucacccuuucacuuaaaggaagcaguuuacagcuucucuuugguauaccaaaauugccagcauuacuacucugcuucguggccauuauuaaguaaagaaaggauuauuugaacacaagcagagauacuucaacagucagucugauaaccaagauggcuacuaugugacuaaugggcacuuaauauacacugagugacuaguguaugcagcauggauacgcuggacaaaggggaugauucauaucccagauggaacagagugggauggcacaagauuucaucacacuaauaagaacaacauaacaguuuuaagcuuaugaauuguuuauuucuggaauuuuucauuugguguuuuuggaccgugguagacugugaguaacugcaacuguggaaaguacaacuguggaugggaggacuacuguacuguuauauuucaggcuuucccucaaaaaugcaugccaguuuuuuuuugagauaaggucucacugugucgcccaggcuggauugcauuggcaugaucguaccucacugcagccuugaucuccuuggcucaagcgauccucuugcuucagccucccaaguagcugggauuauaggcuggugucaccacaccuggcugauuuuuuuucuuuuuuucuuuuugagacggagucuugcucugucaccaggcuagacuauaguggggccaucucggcucacugcagucuccgccucccggguucaagcaauucuccugccucagccucccaaguagcugggacuacaggugcgcaccaccaugccuagcuaauuuuuguauuuuuaguagagacgggguuucacuauguuggccgggauggucucgaacucuugaccuugugauccacccgccuuggccucccaaagcgcugggauuacaggcgugagccacugugccuggcugauuuuuuuuuuuuuuaaguagagauagagucucacuguguuguccaggcuggucuugaacuccuggccucaagugauccucccgccuuagcuucccacgauuacagucgugagccacugcaccuggccccaguuuccuucuugaagaauugcaugggguuucuuaggccacuguucuacaagagguauaaaucugggagcauuaaaccuagcuuuuuguaugcuuaucacagcagaagucuguaagcaacaauguaaguucauuucugcuuuagacuuuuuuuuuuuuuuugagauggaaucuugcucuguugcccaggcuggagugcaguggcccaaucuuggcccacugcagccuccaccucaccgguucaagugauucuccugccuccagaguagcugggauuacaggcgccugccaucacgccuggcugauuuuuguuguuuuuuuuuuuuuggagacggagucucacugugucaucaggcuggagugcaguggcacaaucucggcucacugcaaccucugccuccuggguucaagcaauuccccugccucagccucccaaguaguugggaccacaggugugcaccaccaugcccggcucauuuuuuguauuuuaguagagaugggguuucaccguguuggccaggcuggucucgaacuccugaccucagaugauccacccgccuuggccucccaaagugcugggauuacaggcgugagccacugcaccuggccuaugaccuuuguguguagaguaacagaugauagauuaagauguuugaaguuaauuuagauguuucagcugcuggugccccuauggauucuguaccucacuaauacguuucaaguguuggagggauaauaaaagucuccugauagaaccugauagauuaguaacuccuguucuagcaugugaggugagggauacuggacagagggaaaggacaggcuagagaugagauuguauugcuaugaaauggaagaggcaggauuuaaccagaauguaaaacuuggaauuaaccuguuuaugagcuauuucucaagaacugacaaaucugccuguauuagcucuguguacuuuuaguacaguaauaaaaagacacuuuggcugaccuaagcagaaaagggcaaguuuaguauaaggauauaagauuaucuuagggagcuugaggacagggauguuccugagcugugggauaauacuagaacaaggguuuggauguccugaaaggauuuucuuucauuucuguuucaagugaagcugucaauuuaauggauggucauuguaaaucgggaauacuuaccaaaaucaggacaucaagucauccucugaaagugaaaggaagcaguggggguugaggagagaagaaaguauuuaccugugaaaacacaagaaaaauaauuucaggucuuacuggugucaaauguaauugggaggaaagagaacugaggauaguaccauuagauuuaucuuggcagugauuuauccaacagaguaaagaggcauguuuaagagccgcuagauugcugguuuccccucuguuuaagaucaggaggcugagcaagauuaucucuaagguaaguauccaaagcuguaaguuuugcuacuuaggcaguaucagugucaccuaguagcugguugaaaaugcauuaucucagguaacaccucagaccuacugaacugcaaucugcauuuucacauaauucagaaauaguuaaaugaauuugguacauccaacaauggauuauuagguacguguuaacaaaaaguuguguaugcguaugaauugcuguaguaagaaaaugauuucaugauuccauuaaaaaaccacuucuacauauaaaaaaacuguaagaauauagaucaaauugaauuacaggugauuucauuuucuuuauuauuaauguauuaucugaauuuuuuuauuaucugaacuuucacaguguguauguguuuuaauuuuaucaagaaaaaaaaaguaagcccuuuucucuuugaagucacuucagauuuaauaccuuagcauaguaguuaagagaauggacucuggagucagccaguuugacuccccauuuccuggcuuuuugacaugcuuaguaauuuaacuucuggaagccuuuguucucucaucuguauaauauaauaguaauagaacuuacauuuuaagaguuuugagaauuguuuuguuuuguuuuugagauggaguucgcucuguuccuuagucuggggugcaguggugugaucucucacugcagccucugccucccagguucaagugauucuccucccucagccucccaaguagcugggacuacaggcuccugccacuaugccuggcuaauuuuuguauuuuuaguagagaugggauuucgcuauguuggccaggcuggucuggaacuccugauccugagaucguccgaccucagcaaccacagugcugggauuacaggugugagccaccauacccagccugaguuuugagaauuaaacgagauugcaugucuagugcuuagcacagugccuggacauaguaagugcugcauuaauguuuuuauuucuguuauuccauuuuuuugagauccggucaaacauacuuaacaucuuuucccacccucccccaaaauucuuccccggcaaaaaaaauagcaaaaauagcaauuuaaaaaaaccaaacacaacaaaauuaguagccuaauggccuuggguaaguaacaaauuguugagaaauaggaucaagguuuccaaaacuccccacaauuagaauaaacaaaagagauuuggauaaaaguguaugguguuaaaucuagugguauuauucuguagagaauagcuguggauugucugcauauucauuucuuuaaugcagauaucucucuaauuggugucugauuucuuuaugacaggacacuuguauuagcuuuaauagaagagaaauggaggagccauagaauauuaaggaugaauucaggaaggccugagaccauggaaaacuugccugcucucuacacuauuuuccaaggagagguauauucuuuugugcuuugaaaacccaccauuuauguuaaaauagauuaagggugacaacuggguuuguuguuccuguccacuuaagucugucuugagcauuacagcuuaaaugggaagggccagcggaacaucuggcaaucacaugugccuucucuaagcuccagauauuuaagugcguaguugacaucgucauuggaauaccagcauguguaauuuauguuuuaaaaugaauuuauuuuuucacugcugugguuugaauguguccccuaaaaagcauguuuuggaaacuuaaucuccagugcaucaacguugggagguaggaccuaguaggagguauuuaguucuugagggcuccacccuccugaagggauuaaugccaauuacugaaaggcuugaggcugugaguuugaucucuuucucuccuucuuacccucuuaccuuccaccaugggaugacacaacaagaagauucuugccagaugcuggcaccuugcucuuggacuuuccaaccuccagaacuaugagccaaauaaauuucauuucuuuauaaauuauccagucucugguauucuguuaaaguaacacagaacauacugagacacucaaaaaauuguuucucuucuagauguuuucaccucaacaaauagaaccacuauccugcagguucccagacuacacaucuggccaucacccuugauuucucuucuugauuugauuuugauuuucccucccacuccagucuauuugcaaguccuaauuauaucucuggucuauguacuucuuuauccccuuggcacccuauuaguuaaaacucucuaucucuugccuggucuuuacugggaucccugcuucaucguagcuccucuccagucuguucuucacauuguagcuagcauaagauuuuuguuuuuguuuuuguuuuuuaauucuuuuuuaaaaauugagcuggggucucacuauguugcccaggcuggucucaaacuccugggcuuaagugauacucccacuucagccucccagaguccugggguuacaggcaugagccauugugcuuggccuagaauaagauuuuuaaaguagguuggacauguugcuuucucacggcucuucagaagcuucucauuacaauugaauacagacauggaccuuccacagcuugccccugggugcucucacaauguuguuuguucuacccugcucguagucaagacacacuggccuccuuaauagcuuugaacagucugaguucuugcucucucuuuaggauuugugcacaugcuguuuucuuuuuagucugugcugcuauaacaaaauaccugagauuggguaauuuauaaagaacagaaauuuauuucucacaguucuggaggcugggaaaucuaagaucaaguugucagcagauuuggugucuagugaagacuacucuguuuccaagauggcaccuuccugcugcauccucuggagggaagaaaugcuguguccucacaugacggaagggacagaaggagcgaacucacccuuucgagcccuuuuaugaggcacucauccauucaugaggggccuaagggccccaccucuugauaccauugaauuggggauuaggcuucaaagugaauauuggagaaauaccaaaguucauguugaacuuuagucccccccguggggguauuaagaggugguauuaagaaguauuaaucacuugggaagugguuaagucaugaaggcucugcccuuguaaaugugauuaaugcccuuauagaagaggcuacagagagcugccuggccccuccauuccuucugcugugugaagacacagcauuugucaccuccaaaggacacaggaauaaggugccaucuuggaagcagacagugagcccuuaucaaacacaaaaucugcuggcaccuugaucuugaacuucccagccuccagaauugugagaaauaaauuucuacgguauuuuguuauagcagcaccaacagacuaagacacucuuccuuuuaacuacccacuuucccaucaucuuguauucauccuuuaggucucagcccuaaugucuccucagaauuuuuuuuacccaucauaaauaaaucgguucacacuguauuuaauuauauacuuguuuaaugucuaucuuccucacaggacacuaagcuccaugagggcugaguugugucuguuuuguuguauaucucagucuuagguggauggguagaaaauaguaagugcuugauacauuuuugaugaccgaaugaauuaucaaccuuugguagagaaggcauauuuguuucaagagcagaggcuuugaaaccagacaaaaucgggauucuagucccagcucuuuuugcuugcuaugugagccuuuagggugucacuuaaucucuuugaaccucaguuuucuuguuuguuaaauggagguuccauuuauucacaguaauucucuuccauagaauuacugugaugguuaaauaagcuaucaucuauaagaauacaaugccugagacauaguaggaauuaauuaauguuggcucccuccucuugaagugaaaguaaagccaaaaaauuguuuucagugucuuacaagagcauguaguuugcuuguucauuuguuugagacagaguuuugcucuuguugcccagguuggagugcaauggugugaucucagcucacugcaacugcucacugcaaccuccaccucccagguucaagcaauucuccugccucagccuccuaaguagcugggauuacaggcgcccaccaccacacccagcuaaauuuuguacuuuuaguagagacaagguuucaccauguuggccaggcuagucuccugaccucaggugauccaccugccucggccucccaaagugcugggauuacaggugugagccaccacacugggccucuuuuuuuuuuuuuuuuuuuucuuuuuuuugagacaagaucucacucuguugcccaggcuggacugcaauggugugauuuggcuaacugcaacuuccaccuccuggguuuuaagugauccucccacucagcccccgagguagcugggacuacaggcacacaccacaacaccuggcuaauuuuucuguagagacaaggucucacuauguugcccaggcuggucuuuugaacuccugagcucaagugaucugcccaccucagccucccaaagugcugggaucaggcgugagccaucgcaccuggccugagccuauaguauuuuaaugguaucauuuauacuugauauucauacuuggcauucauacuugcuuuauaugguugacaaaaguuuuacauccuaauaaugugaggucuuggagggcagacuuugugauuaucagucaguuauagauaauuguggcucuugacuucuguuaaguugaucccaacuuguaauauaacagucaagauacaaaguauaauaccauuuuaacacauagcaaacagcucugcucuuuaaagccucuguccuuuuucuuuauggcucaugguauccccaaagguuaguaagguaccggagcucagaagaaggaaguguagcacuggaggugaaacugauuuuucugaucaugaagcccucacucaucaggugcugcccaaaagaaagggaagaacacucugcccuccacagaauaacucggauuucuaaaguggauccuaaccuacagcucgcucuuuucuuuucucuucucuucucuucuuucucuuuuuuuuuuuuggacagagucucacucugucacucaggcuggagugcaguggugcaaucucggcucacugcaaccuccaccuccggguucaagugauucuccugccuaagccuccagaguagcagggacuacaggcgucagccaccacgcccggcuaauuuuuuguauuuuuaguagagacagaguuucgccauguuggccaggcugacuucaaacuccugaccucaggugauccacccaccucggccucccaaagugcugggauuacaggugugagccacugugccuggccaccuacagcuuucuuauaugagauggagcuugaauuagugcagguuuuauauauuacuaucaaggauggauggucuuuaggaauguucagagagaacuuuauaguucuaacuuacuauuucaguagcauauuuugaaaagggaugguuuagaagugacuuggaguuagggaaagagaaauacgauaaauuggaaagaagaaacuuuucagaauauucauccaauaaacauuuaaugaguacccaauauuuacaaagaagaggaguuacauuaaaauugaaaaaaaaaaaaaaagguguaagccuaaucuaugccagcacuuucacacauucugucuuauugaaucucuccaaagaaauuguuaacucuauuugauagauagggagacucuucucagaaguuaaguaaucgccuagggauuaauaaauggcaaagcuaggauucuaaaucagguccucuuuccaaguuuacuuucugcuaaacugcagcugggguugugcaauuguacauaaauguguggaggaaccaaaagacccaugagaauucuuuuuuuuuuaagauggagucuuccucugucgcucaggcuggagugcaguggguucaagcgauucucaugccucaaccuccugaauagcugggauuacaggcgcaugccaccacaccuggcuaauuuuuguauuuuuaguagagauggguuuucaccauguugaccaggcuggucucgaacuccugaccucaagugauccaucugccuuggccucccaaagugcugggauuauagaugugagccaccgcacccagccaagagaauucuuuugacugaauugaguuauaggaggaauauagauaaauuuggugguucuacagucauuuguugguacaacucuguuacagcauuuauccuggucugucuuguauuauuauuacuuguaugugucucucuccacuacuagaucgugaguuacuguagagcagaggccaugauugucucauaugucuugguaacuacuucaaauuuauuuaaaaugacugggcaucccuuuuuuaaaguugucuuuauuucauaguaccugacaugguaucuuguacauaguagauaggugcuuaaaauggagcccaagccucacaggacuaguuguccuugaagaaggugguguuucagcccaugucccagcucuucucuugcugaacuuagcagggauuugggaccuaguaauuaaauagcugagaagccaguauucauccugucauccucugagaagcauguugguagcagagugcauuauauuaauacaugguaggagguacgagcauagcaaugagacuugggauuuggcuuaggcuugccauagcccaagaaaugcugaggggagauucauguugguaaggucgaaauagcauuggacuagaaguaaaaaaaaagucuguguuguacuuggcugugcuacuaucuuugugacuuuugacaaguaacuuaugccccugagccucaaauucuucauuuacauuauggugacaacaaguuucaaggccauuugccaccuauaaucugaagaugggaaauuuacuuuacccaagcucuaaugaauucaguugagauaguuacugaauuuuuuccccugagcuauuugacuaauuauucuugggacaccaggcagacugcgugaucaucuauggcaggugugauugcacccuaggagacacagugaugaaaacaccuggugcuagaaaucugaaacaaugccuaaacaguugagugcauccauucuggagcauauuaaccuuuccuuuugggagaggccaaauuaaggucuauuauauuaccucuaaagaccauaaugugacacuggagcuucaggauugaaaagugagauugucuuaauuuauagcagugaggugaauuuggcucuaacuuccagauuuauuuauuuauuuauucacuuauuuauuuauuuauugacagaaucuugcucugucacccaggcuggagugcaguagcaugaucuuggcucacugcaaccaugaccuccuguguucaaacgauuuucgugccucagcuacccaaguagcugggauuacaggcaugugccgccaugcccagcuaaauuuuguauuuuuaguagagaugggguuucaccauguuggccaggcuggucucgaacuccuggccucaagugauccaccugccucagccucccaaagugcugggauuauaggugugagccacugugccugacccagaugcuacuuuuaaguuuguuggaugauuauguucuuuaauaauguuguuacacaguaugagacuuuucagcccucuuucuagaacuguggaacaaaagccaaagugccuucaguugguccagaaagaagcgauuugcuuuuauuucaauuaaaaauugggagacuuaucuuuauuauguggcccucuuuuacaaagaacaaauugcuuuguaaacucagguaagcacuuuuuaucucugaucucuacguuccucauuugaaacaugguagaacuggaccagcuaaucucugaagucauuucuuuggcucuaccuugccuuaauuuuaagcaucugugugauuguacuguuucuuugggacucucugguuccuaacccagcauaacauguucauuaguauaaaacaugaguuuagaacuuuugguucguaacccauucuucauguuuugucuuggagaguuaauucaagugcuccauccgaugucuccauuaaaaaaugagaaugaaaguuuuuaucuauuuccauccuaacauugaagugaguaaugaugauauuugguuaaguauaaggcacuggacuagggagucaagggaccgagguucuaucccuaacuuuuuuucuuuuuuuuuuuuuuuuuugagaugaaguaucguucuuguugcccaggcuggaguacaauggcgccaucuuggcucacucaaccucugcuucccagguucaagugauuuuucugucucagccucccgaguagcugggauuacagacgcccaccaccagacccagcuaauuuuuguauuuuuauuagagacaggguuucaccauguuggccaggcuggucucgaacuccugaccucaggugauccaccugccucgcccuuucaaagugcuaggauuacaggcaugagccuccgugccuggccucccuaacucucaaguaguugugugccuuccuaccagucacuaaucuuuuugugcuucagugucuuagacuguaaauuauugaaaagcuacacuuuguugaauguccauuaugugcuacauaccuaugucagucacuuuauguacaucauuuguuaucugcagcagcaaagugagaacaaaugggaacuuaggcccugaaaggcaaguugugugcaagauccuacaggugggaaauggcagagcuaggauuagaagccacaucuuucacuccaaagcauguucacuuucuauaccuauacuguuauuuuuuuuuuuuaaagcuuuuuuagagaugggucuugcuauguuauccaggcuggauucaacuccuggccucaggccacgcuccagccucagccucuggaguagcuaggacuacaggcacguugcacagcacccagauacaccuauacuauuccacuucauuugcaacauaaggaucuacuguauaugcuuucuaggauuguugcuaggaauagauaggauaucaaauaccacauugcuuuuggccauuagaauuuuauaguuagaggggaccuaugagcagcucuaguguaauuaagacuccggauucaaaucucagcucugcuacuuauuuagcuuuggaccuccgauauguuacuuaaucucuucaugcaucuuuuugucaucuauuggaugggaauaauaguaccaacucuguacagugacauaaggauuaugcaaagcauuuugaauauuauuuugcauauagugaguauucaguauauauuaguaaauagcagugcagucaggauuguuuuauuuacuccccuuguuuuaguuauggugaagcugaaacagugcucaagaugaagcagcuaauugaagacacugaaaagaauaaaguuuauguauguaagauuauauugaauauuuuacaaauaaucauuuaguguuaaauucagcauauagugacaacauuacccucgauccacagguugggggaugggguaggcuacagggggaagagagagcuagagccuagguuaaugauuuaucuggcaaggguucugggccuuucaucacuaacauuuauugguugccuauuacauagacccaucaagccucuaacuucaucuuagacaacucugcagaagacugaggggacaacucuuucucucugauuagaucuuuucagguucugucagauguguauguauuggcuuuuuaucuaguugucuugaugaaacccaagacucagacuuggaguuaaauguaacaggcuguaugcucugguuugauuugaaguucagguaugaggggaggaaugcccugugugauccaucccaaauuuauuaaaguucucuguauuggguuuggaggccucaguccuagcuaauauaaaauauaacuuuauuaccugguuuuuugcuuuuuguuccuuuuguucaugaaacuccucugguaauaucaauauguucccuuuguucaugaaacucuguuggugauuuuacuagguauaggauuuggguauuccucaguaucaucacaccgugugauaacacucuaaucucccaguguuuuuaauguguacacacauaccugucagucuaaauuucaaaaaaaacccagaaagaauguuugacagagcaucauuuuuaggcaguuuuauagcauacagaggcagucaauaugaaguacagauuuggggagacuagguuaaaugcuacagaagaaagauucucauguaugugacauugauuuuuuucccccaucuuuauagguugcuauggugacagacuauggggccuuuaucaaaaucccaggcugucggaagcaagguaggaguuuauaacuugaaauucagcccucugauucuacucucugcuaacacuccaccaccuccuaauuauaggcuguacauuuuucagacaguaguuuuucauuccuuuguuuucuuuuuaauguauagauaugaauacaagaugacaguucauuuuuagcgggcagagaauuguggucucugacucaggaggaagacugggguauagcuaacuggguuuacuucugaaaccagcuccuccuuagacuucaccugugacccuaggcaaaucacuugacuucuuuagacacaggauuugcgggagggcaagcuaccucugucugaggcugacagugugaguuuucuaguagauagcgcaugaaaugggaauaguauugcaagugauacaaacauauauaauauauauaauguuuuaaguuuuuuucauaaagaggcgucuguugaacauuuuuuugagaauccuguuauaaaucuauaaucuuauuuauuuaccaaaacuauguuaagccgaaaaggcagguuccacagaccgguugucugcccagagugauuuggcuagguaguggcauagccaagacuagaacccaauccuucugauuccuagccccuggaucuuucuacuauaucacacugcugguggauccaaagauucaacuugcuaacuucuuaugcuaaaauaagguuuaauuaaagauuuuaacauuuuaaaaaaaggcaaccauaagaauacuagaagaaaaucuagaagaauauuucacuacaugaaaauuaaaaacuucacugcaaaaaucauuguaaucagaguuaaguuuggaaaaagaauuuguaguacauaugauaaagagcuaauacaaaggggguauuaggaaaaggugccaaggauaugaaaaacaacucacaggauaaaaaaauauuacuugguacuauaguaaaagauacucauucuccguaugacuaaaaaguaacuuagacugguagauucauauaaugggauauuacucaacaauacaaaggaaugagaauaaaauauucauacaugcaacaaccuggaucaucccucuccagaaauuauacugagugaaaaaagcuaaucucaaaagguuauacacuuuaugauuccauuuauauaacauucuuauguuuuacuugagauaugauucacauaccacacauuucaccugcuuaaaguguacaauucagugguuucuuugguauauucagaguuuugugaccaucaccacgaucuacuuugagaacauuguugucaccccaaaaagaaacccuguaccuauuagccaucacuccagauucucucuaugcccccagcuuuaggcaaucauuauucuacuuugucucuguauauuugcuuauuuuguacauuucuuguaaauggaauaaugcaguauauagucuuuugugacugacuucuuucacuuagcacguuuucaagguucaucuguuuuauaauauguacuuaauucuuuuuuauugccauuacaaauuuauugcaguuccaucaguugauggauauuuggguuguuuccacuucuuuaguauuaugaauaauguugcuauaaauauuuguguacaacuuuuuguguggauauuugcuuucauuggguauauaccugugaguggaaauacugggucauaugauaacuccauguucaacuuuuugagaaacugccaaacuguuuuuccaaagugaccacgccauuuuacauuccuaccagcaauguaugaggguucuauuuucuuuacaucuuuguuaacacuuguuauuaucuuucuggguauggccauccuaauggaugugcacggacaucucauugugguuugaauuucccuaauagcuaaugauguuaagucucuuuucuuggguuuauuggccauuuguauaucuuuuuuggggaaaugucuauucaaaucugauauauuuuggcuguguccucacccaaaucucaucuugaauuguaguucucguaauccccaugugcugugguagggaccagguggagauaauugaaucaugggggugguuugccccauccuguucucaucauaguaacacaagaucugaugguuuuauaaggggcuucccuuauaaaaccaucauucgcugggcacuuauucuccuuccugcugcccugugaagaaggauguguuugcuuccccuuuccccaugguuguuaaguuucuugaggcuuccccagccaugcugaacugugagucaguuaaaucucuuuccuugguaaauuacccagucucguaugucuuuauuagcaguguaagaacagacuaauacaaaauccuuuucuuuuuuugagacagagucuugcucuauugcccaggcuagagugcaauggugcaaucuuggcucacugcaaccucugccuccugaguucaagugauuuucaugccucagcuuccugaguagcugggauuacaggcaugugccaccacacccggcuaauuuuuaguagaggcaggguuuugccauguuggccagacuggucuugaacuccuguccuccaguaaucugcccuccucagccucccagagugcugggauuaaaggugugagccaccacaccugccuuuucccuuuuaaaaauaggguuauuuuuguuuuuauuguugaguuagguguuucucauauauucuggauacuagucucauaucaaauauaugauuugcaaagauuuuuauguaacauacuugaaaugacaaaguuauuuaaauggagaacaaauuauuuaaugguucacaaggauuaagaaggggaaggaaguagcaauaugaaggauccuuguggugagggaccuguucuguaucuuaacuguggcaguguauacaugaaucuacacaugugguaaaauuacguggaacuaaauacauacacauacagaaacacaaaugaguacagguaaaacuggggaaaucugaacaagagccagucgauuuuaucugagauguuuuucccuacaccaaccaauucuccaguucucugauucucuaacaucaacuggaugucccaacaauucaauucaauucugacacuaacuaccugggaauuagugucagauuccacaaacuuaagggcucagucccacaugacuacccucacuucagaugccagccccaauauugaauccucagauuaccuacacuuuugucucacuuggcuacaauuuuugggauucccagcacuuccccccaaaguugguaauuugcuagagugacucacagaacucagaaaaaugcuauaguuacuauuaguuuauuuuaaaggauaaaaaugagcagucagaugaagaaguacacagggugagacccaaaguguuccgaguacaaagccucuguccccauggaguuggggugugucacccucuuggcacauggauguguucaccaacucuccaaacuccauugcuuagggguuuauauggaggaucuguuauauagacaugguugauuaaauuauuggccuucagugauagagcucagucuccagccccucuccccuucccggaagucagaggguagggcugaaauuucuuuuuuuuuuuuuugagagggaaucuagcucuguugcccaggcuggaguacaguggugcaauaucagcucaccgcaaccucugccuuccggguucaagcguuucuccugccucagccuccugaguagcugggacuacaggugugcaccaccaugccuggcuaauuuuuguauuuuugguagagacgggguuucacuauguuggcuaggauggucucaaacuccuuuccuugugaccugcccgucuuggccucccaaagugcugggauuacaggugugagccaccaugcccagcccaggcugaaauuucuaacccuaucuaaucacaucguugauuucucuguuucugaagcuaucuagggacccacaguagucaccucauuaagggacuuaaugaauaacaaaagacacuucuaucacucagaauaguccaagcguuuuaggaacucugccaggaacuagggacaaagaucgaauauguauuucuuauaccacaguaucaaugccagcauccugguuguguuaguguacuauaguuuuccaaaaugucaccauuggagaaaacuggauaaaguguacauaaaaccucuguauucuuucuuucuuuuuuuuuuuugagacggagucuugcucuguugcccaggcuggagugcaguggcacaaucucggcuuacugcaagcuccaccuccuggguucacgccauucuccugucucagccucccaaguagcugggacuacaggcacccgccaccaugccuggcuaauuuuuuguauuuuuaguagagucaggguuucaccguguuagccaggauggucucgaucuccugaccucaugaucugccugccucggccucccaaagugcugggauuccaggcgugagccaccgagcccggccuagaccucuguauuauuucuuuugagugcagaugaauguacaauuaucucaaaaauuuuuuuucacauagggcagcaaaguuaucaaauauuuuuaaaaaaugauuuaaaacacuccuaaaaucuuugagauuaauaaauauuuuaaaagauugcuguuaauacccaguguuagaaauggauacuuuuacucucuaucaggagcauaauuucacagacuuuggcaaugccuauuaacaucuuuuaugugcuuauuacccuuuaauccagaaauucuuugaagaauuuaguguaaguagagaauuacauaaauuaugugcaucuguuuuguagacuaugcagaugauugaaagaaugacuguauuucuaagacauaauuaugccucaucuuaccagaaagaugccauggaagguuuucauacaauuccaucacacugcuaccugacugauaacaguuguaaaacaucauugauuaugagaagcacuccaauuucagagagauuaaagugagaggaaaagaaagugcaucuuagaaucaaugaaacacaauaaaugucaguuuacugacaugagccaggagugguggcaugcaccuguaauuccagcuacuugggaggcugaaguaguaagaucacuugaggccaagaguucggggccaggcugggcaacauagcaagaccccacugauggcgauggaggccugucuagaguggcugcugcaaagaugccagccauagugggggcugugcggccagggcugcauguucuauggagcuggcaggagcccugcccccuuaugaguuaguggggugggagcccacccucaugggugcagcugccgccacccagcccuggcugcagacccaggcaucccugcacucuuggagguccgggaagaccccuuucccccauagucucagaagugccugcucccacugccuggacucuccaagcucccggcuccugcucugauuuuggagcaaagucgaagcugagccugggcacuauugcaaccuggcuggguuugcacaccuugggguggugcugccaugccagcuuccuaccaucuuggcccccucuggacuuugggugccagugagcacaggagggaggccaaaggggugcugaggguggcucagcaugggccugcaggugccccugggcacagaacaacugggcgucauggacaacaugauugauggugacaagaggcagacaggcuccuggguggaaaggggcaggucucggugaagccgcaccuucaagccagggauggccuaaagcauaggggccaggcugucaguuccagguggagucuguggcccagagugagaacuuaaggugcuuuuccugggccugcccauggaccagucagcacacacuucugaagacuguaaaaauccuggacucagccagacuugggcagacacugggaggacuugccuguggaaauggguuacccacacugggucuccucuccgucaagggcugcagauguugggaugaccugccugcagauaagagcugcccauucugggucuccucucugcuaagagcugcacucaacagguugaccugccuguggaaaggagcuaccuacuuugggucuccugagagcuguaccaucacucaauaaagcaacucuuugccuugcuuacccuccaguugucugcuuaccucauucuuccuggaugcaagacaagaacuugggacccguugaauggcgggacugaaagagcuguaacagauccaagggcucccugagccagagcugugacaccucuuuggggcuuuaugguuccuggccucuccaagcuucugggcaccaccauguuccccagaguccacaguggaagccgcuugugguaugccugguccauccacagccucacauggagcuggugccugugccagcaccuggagcugccugcccagccacagcagccagugugccuggcugugcacaguggcuggaccccaugcucacucacucaugcaucccucgccacuccgagccuggcucgcccuuggcaggugugggaucugggacggcagcaugagccaagcgcagcccauuagaccaaguggauggaacaggccuaguggccccaagcaaagcugaaugcagccugccaggccaagugggcagaacgagcccagcagguccaagcaaaacucgggcaaaggugcugcuggccacagcagcuucuggcuggaaaagugacaccugaagaaucuugugacaccaucuuuacaaaaaguuagcugggugugguggcagaaggaucacuugggcccagaaguuagaggcugcagugagcuaugauugugccaccgcaccccagccuggguaagaguaagacccugucccuuaaaaaaaaaaaaaaagaaaaaacuaacauggaaagaagucuaagauaauaaaauuuaaaaacauguugcagaagacuuuguauagcaucucucuuccccuuuuaaagcaagugugcauaugccuuuaauaucuuuuuucuuuauauaguuuaaauuacugccuauguuuagaagaaaggcuggaggaauauucaacagauuaacaauggucacuucuggggaguugguuuugcuaaggaagggauguacauggaagagggacuuugacuucuggaaauuuuuuuuaaguuuuuucuguuaaaaaaaaaauccaagaggugaucuuuggauaauaaauccaugccucuaaccuuguagacuacuauucugcaaauugcaucuuugcuuaagaaaugguuuaccagcaguuuucaagcuggcagucagcagucuguaauuaaguuucucauuuuauguugucuggaauuuaaugacaucgaacucuuccccaccccacaggacauucaucucuuucugucugagcacagguuuucuuguuaguauaguugccauagcugccagugccugaaagucccauucuaauuugggcauaugugacacuuuggggacugugugggauuaaaggccugugaccuuccagcagucaaucuucaacucauuuuauccauacccugucaggugaugccucugauuguggcugacagcuuacaagugaaucugucagucugacagcugggcugaggcaagccucagagggagagcucagggagccaaauaauuagguggaaacucugugaguuuuaauccugagaucuauagguuuauuggauaacuugagcaauugacuuccuuacaguguaucuuaguuucucugcccauaaagagggaagauuauuaagucucagccugaaaggacugaguuagaaaauaacucuggucugaucaggucuuaacaucuuuggcucagguagguagauucuaauuugagcugguuucccagaugucauguucucagaauacuucagccaacacugaguugaagaccccuuccuacuauucaaaccuaagcuagauuuucuuuccccucucauaguauuauccaauauaacuuucugugaugaugaaaauauuccuuauguucucugauuuguuuccugacaccaaccaacuccccaauucucuggacaccaacuggguguccagugacucaguucaauucugacauuauuuaucuggagcuuguguuagaucucacaaauuuaagggacucagucccacaaaauuucccccauuucagaugccagcugcaaguccugggccacuuguacuucugaccaaucagcuguaaacagggguuccaugaccaccuacuuagguuugagacuuugccagaauggcuuacagaagucaggaaaacacuuuacaguaguccccacucaucugugccuuuacuuuccacgguuucaguuacccuaggucaacugagguuugaaaauauuaaagggaaaauucuagaaacaauucauaagcuuuaaguugcaguugcagugugaugaaaucuugugcugucuugccacauuccaucugggacuugaaucaucccuuuguccauccacacuguguacgcuacccacccauuagucccuuaguagccuucucagugaucagaucgacugcuguugcagugcuuguguuccaaguaacccuuauuuuacuuaauggccccaaaguguaauacuaaugcuggcaauuuugauaugccagagagaagccauaaagggcuuccuuuaagucaaaagguaaaaguucucaacuuaauaagggaaaaacagggaccccuagaggggggacugaggaagggggagaaugguugaaaaauuuaacuuugaguacuaugcugaguacuacuguaaugggaugauuaauaucccaaaccucagcaucaugcaguguacacagauaacaaacuugaacauauguacccccggaaucuaaaauaaagguuaaaaacaaauuaaggaaagaaaacguaauccuguccugugguugcuaagaucuacccuaagaaugaaucuucugugugugaaauugugaagaaggaaaaauucauacuaguuuugcugucgaauuucuaacugcaaaaguuacagcaacagugugugauaacuguucuuacaguauguuguuauguuauuauuguuaaucuauuucugugcuuaauuuauaaauuaagcuucacagccaggcaugguggcucacacauguaauuucagcacuuugggaggcgagguagguggaucgcuugagcucaggaguuugagaccagccuggguaacauggugaaaccccaucuccacagaaauacaaaaauuuacuggucaugguggugugugccuguaguccaagcuacuugagggggcugaggggguuguuugagccugggaggcagagguugcagugagccgagaucaugccacugcacuccagccugggugacagaacaagacccugucucaaaaauaaauaaauaaauaaauaaaaauuaaacuuuaucuuagguguguauguauaggaaaaacauaguauguauaggauucaguacuauucuuugccaguuuauuauaaaggauacaacuuaggaacagccaaauaauugaagagauacaugggguaggguauggcuggaguggagugggaucggguaaggugugguggggagcuuucaugcucucugguaugccacccucccagcacuaggauguguuugccaacccagaaacuacaaaucucauguaugggaguuuuuauagagcucagucucuagcucccaacccuccucuuucuuccuagaaguaggagauuggugggugggauugaaaauuccaguccucuaagccagcaugguggugagcaccuguaguuccagcuacuugggagacugagacagggggaucaguugagccguccaggaguuugaguccagccugggcaauauggcaagauccugucucaaaauagaaaaaguuccagcccucugaucgcuuggucuuucuggugacuaguccauccugaggcuaucuagggaucccacucugucaccucauuaaaauaaacucagguauaaucaaaaggggcuuacuaugaauaacagaauacacuccuaucacuuaauaaaucccaggaguuuuagaaguucuuugacaggaaaaugaacaaauguauuuuuguauuauacuacaucugugcugauacaugacuuuuucauuuuauuuauuucaacuaauugaaauugaaacuuaaaacagcuacaugacuagugacuaucuauuaggcagugcaacccuauacaauuauaaaguucuuuuuuuuuuccuacugucuucugccauccagcacuaaacuaugaaauuuugagaacagauuuuucaacauuauacuuucagaguuucuugcuuaugauagaagcucaaauauauuuagcaguggauucaguuuagcaaauaauuauugaguucuauuuucugauuagcuuuuuuggugggaacacagagguaagagaaacauaaucccuugcugcccucagauugcuuacagucuagugauguaaacaaauuagaguggcguguaauaaaaaugaguguuguugcacuuaguccauggaauuguggaacgguuaggcuguuuggaugagucagggcauaguacaauacuugagguauaguggguggguguucaguaaaucucacugaaugaaugaaugaauuauagccucaguucuaccauuaacuggcuucuuggcaagucuccuagucuuugagccuuaauuuccuuaucccugaaaugggaaugaugugcauauuuuagggucuugaguuuuuuugacugggaggaccauguuucauuaacgcuuggauauauuuuugccuauaauauaguuuaagcguuuaguaaauguuuuagugaauccuuaaucccaacaagaauaaaggguguuaaaacacuuucacgaaugugcuuauauuauugucauauaccauugauugggagaugaauugacuuaaacuguggagagggaauuaagauuacccaaggguaacagugaccuuuuguuuugacauuuuuuuggcugcagcuguccucuaaugauuugagauuuucacuucuuuccuuuauugccaguggaaguuguggaagaaauuaauguugaaccuaacgcaguugggguaacgguuuuaaggggacuauaaugggcucacucuguuacucucauguggugauugaggagcuagcccuuuccaaguugucagguuucguuuuuuuccuguuuuuaccagcagacacucagaugggacuaauucuguuuaagugucauguuggguuuauugaacuugaugauggacuugauaugccucuugggcauuuauuuauggcuugaugucagaaauccaugcacagguugcucugaagagcucccuuugguguagcgugggaagcaaagcauuuuuguuuguuuguuucuguuugauuuuggagcauaugcuagaacagaauuagauguacuuuccucuauuuguagguaaguucaucuuucuccuuuuuuuaauuguaaggauaauauagauuaauaauaaaaauggggaaaauauugguaugauguaggagaccugauaaacucauauuugaauugcacuucuguuauuuaucagccuugugauccuggauaauuuauaugauuucuagaugauuuuuucccaugaaccuuugucaaagaggauuaaaugaauggauggauguaguauauauagugagguacucagcacaaagggaaggggccucaaauauuuuauaugguguccucuacugcauacacgucaucugacuuuuggugguguguccauguuaacaaugaagucucucccaagaauucagacugcuuucugagaaugaaucuagucaugaaucccucccauacagaguauaguuucagccauagauagaaauaaaccagguaauugccuauaaaacagacugaagagaugggagcacucaagaugcaaacaagauaaucuggguguaauuccagggaaaagggauuggaaugaaauuguaauuuaggagacugaaaucuaguugauuguaucauaauauucuuuuuuuuuuuucucuugagacggagucuugcucugucgcccuggcuggagugcauuugcaugauuaucagcucacugcaaccuccaucuccgguucaagugauuccugugccucagccucccuaguaguugggacuacaggcaagugccaccaugccuggcuaauuuuuguauuuuuuuuuuaguagagacgggguuucaccauguuggucaggcuggucuagaacuccugacuucaagugauccgcccaccucagccucccaaagugcugggauuacaggcgugagccagcgugcccguccuguaucauaauauucuaccgagggagagauuaugggaacaagcaggggguugucagcuuaaaacaugguaaacauaguaaaagacaggcugagugcuugaaguuggcagaguuuaucuugccuuauuuauggcagaaaugaaucuaaugauaggaacuguagagauggauuuuuuuuuuuucuuugagauggagucucgcucuguugccgggcuggaaugcaauggcucgaucucgggucacugcaaccucugccucccagguucaggcaauucuccugccuuagccucccgaauagcugggacuacaggugugcgccaccaugcccaacuaauuuuuguauuuuuaguagagaugggguuucaccauguugggcaggaugcucucgaucucuugaccuccugauccgccugccucagccucccaaagugcugggauuacaagcguaagccaccaugcccggccgagauggauuuuuuuaugaggaagugauaguacacuaaaccuucauggacaaaaaaaguaucucaaaauaguugucucccuuuuguucugauuccauguggaagcaauuucugaucacuaaugaucacuaauguaauuguucagguauuuaaucugaaggcagcagcuaguuuaccuagaugaggacugagaaccuuccagguauaaggaaaguauaucuuguauuguaaauuaauaaacuggugugugucucucucugaaccagucacuaaacugacagucugguuaauguauuuuaguauauaagcaucugcaugcuaaagacuccugcacuuauaucuacaguucauacccuuccccugagcuacagacuuggauaugcaacugccuaccugacauuugcauucaagaucgagggcgagggcuagacugugucuuuuguuuaauucacugcauaagcuaaggccuuuugguaauaagccauuaaugucucaacuuuaauaauccuguaccccguuauaacuauuuuuauguuuccuuuuggucuauguccauaugaggcauaguuucacauuauuucauaguguauauauuauuuaauuauaaaaauauauaaauuuuuaugauuggaaauaaugcaugcucaucauagaaaaauagagggaaaaacacacaauggaaaaugaucauuaugugcuauuacuaccauacagagauaggcacuguuaacauuuugguguauuucuuuuuuuuuugagauggagucuugcuuugucaccaggcuggaguguaguggcaugauccuggguucaggcaauucuccugccuuagcuucccaaguagcugagacuacaggugccugccaccacaccuggcuaauuuuuguauuuuuaguagagauggaguuucaccauguuggccaggcuggucuugaacuccugaccucaagugauccacccggcucagccuccgaaggugcugggaucacaagcaugagccaccgcgcuuggccaacauuuugguguauuucuguauauucacauauguguacacaauuuaauauguugagauuaagauuauacuguauauuuaaaauguguaguuuuuugcacguaauggaccuuaaacauuuccccauuaaaaaaauauuuucuauaaacauuuaauggcuuuauucugucauucagauguaccacauaaucauuuuaaguuguuuccaguuuuucacugcuaacgcuucuagacuggucauguuuauccaggagagagcuaccuguaccaaaaauaaaauaaaauaaguacaauaaaauaauaaaauagaauuuaaaaaaaugccgggugcaguggcucacaccuguaaucccagcacuuugggaggccagggcggguggaucaagagaucaggaguucaagaccagccuggccaacauagugaaacccugucucuacuaaaaauacaaaaaauuagccgggcgugguggcaggcaccuguaaucgcagcuacucgggaggcugaggcaggagaaucacuugaacccaggagguggagguugcagugagcagagauugugccacugcacuccagccugggugacagagugagacuccaucucaaaaaaauaaaaaauaaaauacauauguguguguguauguguguguauauauauaguuuacucucacugacucuuagauauacucuaaagacccauggaaauucaguuguagcauaaaauaaauacauuuauagcguaaaagagcaaaauauuucaaauuaacuugcuuaagcuacuuaaagacaaaaaaaguucauuugaaaucuuuugucauuuuuucacugguuauauggaaucaggugagagaaggacaaguuuugaugccauuauuucuaugugguacuccaguaaauagacuuucuguuuuagggaagaagaauaguguucccucaaguauauuagguucaacauuaauuuccaucauaacuuucauuagcaauagaggaaagagaugaauuuuaaccaguagaggacaguugcagccaaaaacaagucaagaugaagggcuuccccuuuaugggaucugaauuuccucuucaaacuuuaaaauuaggcuaguuggcucauuacaucauaggggaaaaaaauaaaccccauuugcaugaauuucaccaaauuuggagauuguguguugaucuaaaauuaaaaacauaauguauauaaaacauuuuagaggccccagaguuguuuagauagguaggcuaucaaccuccagaaucagcuuauguagguaugugggauguagugaugauggauagagaaaguaguggcucccaguaggagcucuaaacagaaagggcagguauuuugaguuucaggcaucugcaggcauccaugugcaucucucucucucucucucucucucucucucucucugugugugugugugugugugugugugugugugugugugugugugugugugugaaagagagagugggagaaugagaauagagguggauaaauuucccaagcaacuucagggagggcaguuauuuuagacaggaugacugauuuuuauucauucagaguaauuauuuauguucauuuucuccagaauugaaguaauccucuauuauuauuuauuaucgaaaauaaaugaaaagguuaacuuguaauacuauaaccacuguuggcauuucaagucauuucuuucuaauuuuuaaaauguuuuuaaagcauuuguaaucauacuguauaauuuugcauuaugcuuuuguuauuuaguaugggaaaaugcuagauaccuacaguacuugauacauaauaggcacucaauaacuauuuacuaaagaaggaauuauugacuuguuuaaaaaucuuuugaauggaccaucaagcgacuauaccauaauugaccuaauuguuauccuuuguuguuucuaaauuuuccugucuuaaaaauacauugaauauuuugauguaaaucacuuuuccugaagcauauaguuuuuccuauguauaaaguuauuuucuuaggacagguucccagaagcaauuaggggucaaauaaaguauuagaacucuugguugcaaggggcagaaacuuaauugggaaacauuuuggccaaucuugucaggggcuuccaggauaacucucaguuauguuucucaguuauguuucugccccuugucucuuuccucuauugcugggacuucagccuuugcuguauugggugcucaguuuauacucccagggcuuugcuucuuguuuaccagugcucuucuuugcuuuucucuggcagacucuugccaucuggugguaaagauuggcuuuggcaauuuuuuguaguuuacaauccugauuuguauauguaaaauguaauaagcaaggugguucucccaaggaaaggauuuuggacagacaggaaaaggauguuugcuauaaguguuuuauuaaauguuauuaaaauauuauuugauuuauuuuugagacaaagucucgcucugucaccuaggcuggagugcaguggugccaucacagcuuacuguagccuugacuuccugggcucaagccauccucccaccucagccuccugaguaucuaggacuacaagcaugcaccaccacauccuauuaauuuuucuguaauuuuucuagagauggggucucacuguauugcccaggcuagucuugaauaccugggcucaagcaguccucccaaagugcugggauuacaggccugagcuuccaugcccagcaauuauuucauuuuaaauuauuuuuauuaaauguguaauaguuuauuaguauuuuaucauucuugauagccauugauagugacuuccaaaaguuuauucuagccuuaguaauaguucuuauuuuacuauccuuucaccacauugaauauuauuuucuaaauacuuugcuaauuuaauggauuaaaaauaguagcuuguuuauauuuccuuuuuuaacuuaacgucuaucauaaauauuuuuuguaauuaauuuaaauggcuguuuacuuuuuuauuccacagauuuacuauguuugccaugcuguuuuccaguuauuguucauuaggguuguuuuaugguucuuauauauuuuuuaaccucuguagguaauaauaccgcaaguuauuuauguauuuauguauguauguauguauuuauuuauuugugagaugggggucuugcucugucacccaggcuggagugcaguggcgcaaucucagcucacuccaaccucugccuccugggcucaagcagugcucccaccucagccucuugaguagcugggaucacagguuugcaccaccacgcccagguaauuuuuguauuuuugguagagaugggguuuuaucauguugcccaggcuagacugcaaguuauuucagcucuguaaguuuuuuggcucuugugaguuuuuccuuugaaaaaauucuauugaugauauucuugcaucaaagauaaacaucuuuaucuuuuugcuuucaaauaauuuuaccaacuuauauuucuaucaguauuguguaacuacagauauuuuaucacaucuuuacuaauauggagcauuacauuuuuuaaauuuuuuguuuuuuauuuuuaaaauaagauuuacaauauuuaaaaaauagagauggggucucguuauguugaccaggcuggucucaaacuccuugccucaagguauucucccaucuuggccuugcaaaguguugggauuacaggcgugagccacugugccuggccuauuuuauuuacuuauuuuuuugaaccaaggucucacucugucaccugggcuggagugcaguggugcaguugcagcucacugcaguuucagccuccugggcucaugcgauccucccaucucagccuccuaaguagcuagagcuacagacacgugccaccaugccuggccagguuuuuuuuuuuuuguauuuuuuguagagacuggguuuuggcauguuucccaggcuggucuugaacuccugagcucaggcaaucugcccgccucagccuuccaaaguucugggauuacaggcaugagccacugugcccggccacuuugagcauuauuuuaagaauguuuguugguugauuggguauaaaaagcagucucaauuugcaguuuuaaguuucacgcuuuucaguaaaaauuuucauuuuucccuugcauuccccaacucuuaccuucuuauccaguuuagaguauaaauaccagauaugcccucugcuuuacguuauuucuucuucuugugcccaggucugguccaucgaacucauaugucauccugucggguggauaagcccucugagauaguagauguuggagauaaagugugggugaagcuuauuggccgagagguaaaguucugugcggcucccuugugguuagaaaggauuaggaagagcugggauuuuugauauuuuaugauagugaguguguaaauuuuguuaauugugcugauaaucuuauuuuuaaauccugccauuagaaucuauucugaauucaaaccuucugguagacuguccugcaaacucagaaggaaugauaugagcuauaaaaguguggugcaauaagugcacguuuguaaaacuucccucccugaaguuuacccauagggugggccggaggagagaaaaaagaaccaaaaagagagaaggaaaguugaccuaugggacaaguguuuaucacagacuucaaagaauaccugccagauacacuucaguuugggacaaaacaaaaagaacacagauaguuuacagucauuuucccuaauaucuggcaccaugcaaugugcagaaagugaaaaaaaucugaaggacccuguuacucacuugaggguaugagggcugugggugugggccgaccacaggagaaauaagagcauacacugaguccuguucuaccagagacagcacaggagauaggcaugaaagaacuauuauucaacaauauuuaagugcuuaauaugugcuagguuugggagauauaagagcgaaccagacaaaaaugaucccagcuauuauggaguuaauauagaauauaaguagagacaauuuuucuuucuuuuuugagacagggucucucuuugucacccaggcuggaguacaguggugccaucacggcucacugcaaccucagccuccugggcucaacugaucuugccaccucagccuccugaguaucugggacuacaggcacgcaccacuaaaccuggccuuuuuuuuuuuuuuuuuuuuaauuuuuuugucaagauggggucucacuguguuacuacccaggcugguucaaacuccugggcucaagugauccuccugccuuugccuccccaagugcuggaauuacaggcaugaauuuccaugccugaccaagacaaauauacauaaaauaauugcaaguuauauuaagugcuauauuggguucaaacacuauuggaagaagauuucuaguugucaggaaaggacucuuugaggagauagaauaugagcugagaccuuaaagaaaaggaacuagucauggaagacuugggauaggaacauuccaggcagagagaauaacugaugcaaagacccugaagugaagaagugcuucaugugcugcgggaagcaaaagaagaccaaugugacaaaugucuucaugcuuaaagaagcucuagaccaaguccagaaggagaucuagucucuugaaguauucaaaaaccuauucuggacuuagggauaucucaacaaaucacuaugcugaacuuaccuggaagaaaaacuuuuauuuucugccugguuacuuccacaagccauggauuuuuugagcuaccauuuuugucuuucccucagagggacaagaaugagauuaagacuguuuccuaaaauucuucugccacagggucuaccuguuaugcuuauuuguaucugcaauguuccuagcacaguaccugguccauuaaagaagcucaauguuaugaugaaaacguugacucuuaauuuuagacuggccaucuaaaugauguauuuaaaguuuuuggugacuuuuuuuggucucuuucagaugaaaaaugauagaauaaaaguaucccucuccaugaagguugucaaucaagggacugggaaagaccuugaucccaacaauguuaucauugaguaaguaaaagguuuggaaaggugaaaauucuucugccucccaaaucauaaaaugguuuaguaaaucagacugaacugguaacucuaccauuuauggacuuugugauauugauaaguuacguaaccuuugcaaucuuugguuuuuagaaauguaaaaugaaguuagaccaggcgugguggcucacgccuguaaucccaacacuuugggaagccgaggugggcggaucaccuaagaggucaggaguuugagaccagccuggccaacauggcgaaaccccgucucuacuaaaaauacaaaacuagaaauuugcuggaugugguagugcgugccucuagucccagcuacucgggagacugagucaugcacuagagucucuugaacccaggaggcagagguugcagugagcugagaucaugccacugcacuccagccuggaugacagagugagacucggucucaaaaaauaaaauaaaguaauaaaauaaaaauaguuaacaccuugcugcauagaguucuaagaugaaacguuaacguaccaagcuccuggcauuggagugcuccaucaaugguuuuguuuccuuucccuuaaucucuuucuguuucugcccuuuaacgaguuagcuaauaagcauucaugaagaacuauucuuuaccucucucccagugauuucugcaggugggguuacgugggucucuuccacauagagaccacguggaaggguagaguaauccaggaacaacuccagcgggguuuagacucccacaucuugggauacacugugcucugaaaacaacaucuuacuuucguuggcucuucugaccuuucauuuaggaaugggaaauuaucuauguaggacaaugucuggcaauacaaggaauguucugucugucucaagucuuucuuggauuucuuuuuuuuuuuuuuuuuuuuuuuugagauggggucgcccagguuggagugcagugccauaaucacggcuuacugcagucuugaccucccaagcccaagcuauccucccaccucagccuaccgaguagcugggacuacaggcaugcgccaccacaccuaauuuuuauuuuguagagacagggucucccuauguugcccagguuguucuuggacaccuaggcucaagcgauccucccaccuuggucuccuaagugcugggauuacaauuguuagccaccaugcccaggcuucuuucuuaaauuucucaucggagguucuuggaucccuaaagucucuuaaagggggaucuuggaggguuuuuuuuuuuuuuuuuuuugagacaaguuucacucuuguugcccaggccggagugcaauggcacaaucucggcucaccgcaaccuccgccucccagguucaagugauucuccugccucagccuccacaguagcugggauuacaggcaugugccaccaugcccggcuaauuuuguauuuuuaguagagaugggguuucucuauguuggucgggcuggucuugaacucccgaccucaggugaucugcccgucucggccucccaaagugcugggauuacaggcgcgagccaccgcgcccggcccuuggaggguuuauuaacuguuuuuaguguuuuagaaagccauccaaaauucuauguguguccucagguuaaccaugcuguuauuuuguugcuuuugaugauaaaauaucacauuguuugucuuauguuaauuagguacgcucaaugacaauuaugucauugaugaauuuaaaagacaagaaaaaugauagaauguuauuugagugggaucuuauuggugaaaaguuuggaaagccuuauguuuauaguucugagcaaaaucacuuugaauuugaaggaauuuuaucuggaaguaagggaaauguuauugaauacauacugcagugccaggcauuuuauguacauucuuggguacauaacaaccugcaaaguggauguuaucuccauuuuaccuuauauuccuacuuuauagcuuggugccuggugauaaguaacuuaccugugguuacauagaaaauuaucagggacucaaaacucagucucucugaccuuaaagcuaaugcccuuuucaccacaaaaugcuucucacucuugcaugugacuuacagaacuuuucauauuucugugguuuagucucuaaauauuaacauguuuguaaggcugauuauugacaaaauacugucaguaauaguaggaaucuuuuauaacucagagugcagaaguguuuaaaucuggcugugguucaaguuaguguugggaaaaggaaaaagaaaaaauucugaugauugcauuguaauaaauagcuucugcuccaaaaaauccaaugcuauauggacucauuaaaaaauagugaaauuucccaaagccacccuuacagugauaaaauauaaaacauguaagauaaaagagcuaacccuguuucucagaaaauggguagggaagggaaagggcucccugguuuugggcugucucuguguagaacuauuuuuaguaauaaucaaguggcugaaacaguaacuuuuguuguaaauuaugucuauagcugcauccaggaaggaagcauggcauaauggaaugauuagaggauuuagagcuagacuugaaucagaaagaguacugguucugcuccaaacuaauauaugacuuugagcagauuaauuagucuaucugaaucuuagcuucuuuacuauaaaaggagacaguaacauauaucuaaggaaugcuugagugauuuaaguaaaaucuuauuuguaaggagccagcuucaugucuagucuaugguagacauacauguagcuacuuguaguuauuguuuuaaaugccgcuuuguuuuauccucuaauaucugagauuauagcaccuuuucuuuuuuccucauacuaugguguacggaaccacaccuuugcuuuugaaagaguguguguguaagacccacaaaaacagagaccaugacuugucugccauugugccugauguauagcauccauaguauucauuuaguuuuuuugagauggagucucacucuguuacccaggcuggaguguagugguacaaucguggcucacugcaacucugccuccuggguucaagcaauucucauuccucagccucccgaguagcugggauuacaggcauaguccaccaugccuggcuaauuuuuguauuuuuaguagagacgggguuucaccauguugaccaggcaggugucaaacuccugaccucaagugaucccccgccucagccucccaaagugcugggauuacaggcaugagccacuaccgcucagcccuaguuaguacuuucauuuacucauuuguucaacaaauauaaggcaacuuguaauaaauacuaaaagaguaguuuaaagcaguuguccccgaccuuuuugucaccaaggacuacuuuuguggaagaccaauuuuuccauggauagggggcuggaaugguuuugggaugaaaccguuccaccuuagaucaucaggcauuaaauucucauagggggugcgcaaccuagaucccucacaugugcaggucacaauaggguuugcacuccuaugagaaucuaaugcugcugcugaucugauaggaggcggagcucaggugguaaugcuccuucaccugcugcucaccuccugcuaugcagcuugguuccuaacaggccauggaccaguagcagucuguggccuggggguuagggacucccuguuuaaagaaaggguucuaggaauucacuugaggaggaauaguuuacuucaggccuugauggucagagaauaggugguauuugaguuagguuuugaagaacagauaagaucuugucagacagcaggggaaggaaugguauuucaggcaaaagaaaugguuugaggaaaggaaugaggcagaaaagcacauaguacauuugggaaccuuguuuaaggaaagaagaggauauggucaaguacuagaauggaaggcuugaaagauaauuuagggucagauuguggagagccaugaauaucaguuaaagaauaugaauuuuuauuuauuuauuuuuugagauggacucuugcucuguuacccaggcuggaguacaguggcaugaucucugccucccagguucaagcaauucuccugccucagccuccugaguagcugggauuacaggugcccaccacugcgcccggcuaauuuuuguauuuuuaguagagacgggguuucaccauguuggccaggcuggucuugaacuccuggccucaaguaauccgccugccuuggccucccaaagugcugggauuacaggcgugagccaucacacccagcccaugaauuuuuuuaaaaaagccuuuggacagagaggcuucucgucagauuaaccuccccaggaaucccauugucuggccuugcccuguuaugcucaguauucucauccugucuucagccauccauaguuuguuagccaccuuucauuuuccauaaaaaucuaacucuuauauucauccccucaggucccaaaguguuaaugagauaaucuaauaagugacucuguaaauggaaaggggcuaaaagcaguuuccaauuaggcauagccugcaaaguacagucuuuuucuuuuuuauuaugaucaagaucagaauugaguguaguauauaauuuuuuuuuuuuuuuuuugagacagggucuuugucucccaggcuggaguguagugaucauagcucacuacaaccucaaauuccuaggcucaagugauccuccuccuucagccucccaaguagccaagacuauagguccaugccagcaugccccacuaauuuuuuuuuuuuuuuuuuuuuuuuugagacaagaguuucacucuuguugcccaggcuggaggcaguggcacgaucucggcucacugcaaccuccaccuccuggguucaagcaauucuccugccucagccucccgaguagcugggauuacaggcauguaccacuaugcucggcuaauuuuuguuuuuuuaguagagacgggguuucuccauguuggucagguuggucuugaacuccuaacuucgggugaucuuccugucucggccucccaaagugcuaggauuacagaugugagccaccaugccuggccuaauuuuuaaauuuuuuguagagaugacgucuugcuguguugcccaggcugaucuugaacuccuggucucaagugauacucccaccuuggccuuccaaagugcugagagauuauaggugugagccacaacugcugguccauaggguagucuuuagaaaaagcacauaugacuuaacucuguuaaaauuuuucauuuguaugucucccuccauugccagacuauuaguucuuuccagaaaagaaucauguuuuguucguuuugguauacauaauuauuacuaucacuaguauuagcacuggcguuauccacuuacuagcuguacugaaaaaaugagauuaaucucagaaucugugcugggauggauuggaggaagaaaacuggaggcagggagaccagugagggaguuauuacucuagaugaaacaugaugggagccuaaacuagaaugauggcaaugaggacaaaaagagagacgugggugacugacacauuuguugaauugaguguuaagugggaaguaugauuugguuuguagucugguagaagccacagaguauuggaauugauugucauggggguugcuuaagcugcaacucacagccacuugaaacucaucucuacaaauagauaggugaaagcaaaaaccauguuugugaguuccuugaguuauguccucaaguuucugccuuuguuauggguuuuuuuuuguuguuuguuuguuuuggagacagggucuugcucugucacccaggcuggaguacaguggugcaguccgcucacugcaaccucaaucuugcaggcuuaagugauccuccugccucagccucucgaguugcugggacuacaaacacaagccaccaugccuggcuauuuuuuuuuuuuuuuuaaguaaaaggaaucuguacuguuagaaauuagaauugugauuacccuugggggaggcagguaacuagaagggagcaugagaugggcuucugagaugcuggcaauguucuguuuguuuguuuguuuguuuguuuugagacagagucucgcucugucgcccaggcuggagugcaguggcgcaaucucggcucacugcaagcucugcuucccagguucaugccauucuccugccucagccucccaaguugcugggacuacaggcgcccgccaccucgcccggcuaauuuuuuguauuuuuaguagagacaggguuucaccuuguuagccaggauggucucgaucuccugaccuuaugauccacccgccuuggccucccaaagugcugggauuacaggcauaagccaccacacccagccuuaauguucuguuuuuugaucugaguacugguuacuuugguauguucaaauuaugaaaaaucaagugagcuguauacuuaugacagacauuuauauauauauauauaauauaauauauauauauauauuaguucucacacugcuauaagaacuaccugagacuggguaauuuauaaagaaaagagguuuaauugacuuauaguuccacugccuguauaggaggcauggcuggggaggccucaggaaacuuacagucauggcugaagggugaaggggaagcaagcauaucuucauauggcggcaggagagaaagagagagagagcaaaggggaaagugccacacacuuuuaaaccaucagaucucaugagaacucccucacuaucacaugggggaaauccgaccccauuauccaaucaccucccacaaggucccucccccaacacugggaauuacaauguaacaugagauuuuugugugugggggaacacagagccaaaucacaucaacauauauauuauauuuugguaagaagucuaaaaauguuuuaaaaggcuaugagaaaugcaacaaagagauuaauucugucugaggggcucagaggaaaagacuugauagaaggagagcuaguaacugaacugagccaugaaaugucuagguauagugaaguggugaggugagagucaaguggggaaacagagcauuucagagagggggagaacugccugagcaaaagcacugagccacauggauaagagaaaauagacuucuuuggccagagcauauugugugaguaaagaugaggcuggaaaaguaguuuagagacaaacugugaaagaccuugaaugccaagguaaagaauuuggagcugauuuucuagaaagccuuugaaggucuuuuaaaccuaugagugaccugguaaggguuguaggguguuuagcauguugaguaauuauauauuuucauccucugugcauuagugagaugaagguuagucucauucguaauuguuaauuuagggcuauuucacaucauugcauuuacugccugucucguucugucaaaaacuuucuuucuuucuccccuuucccugccaaaaacaaaaaaccaacauacaaccuuaccuuguaguaucucuggccauaucucuuaagggggccggcagucgguaucuuuuucauuauaggcaagaagagaggcggaggcgauccuuccaggauuacacugggcagaagaucacccuugaggcugucuugaacacuaccugcaagaaguguggcuguaaagguagggugaagccucugcccuuuccacguuucucuccuuguggauggacccuuuucuggaagaaggaggcagcccagugugaguuuaguuuacccuguuuuuuagccaagugauggccuuugcuguuuuuuccaccagacucacaucagaguucauggggugauacauuuucuguuuucuuuucugagugcuggcccuaccagauacuauaccacuaccaccacuccucccaccccacccacagcauaugccuugucugggcaagacccccaugaacuaugccaggaggaguaagaguguuggauuaugauuaacacucuaauuuuaucuccaaggaugaugauucugcaaaaauuaagcaacuuagacauauauaacuuaaagauccaagucagacucucaucuuuaucucuuuaaugucagaguucugaauacaauaucuuuuuacaggauauugaauaaagaauacaggauagucacuucuuuuuagcucuauuuccucagguuuccucuacucuuacucaaauuuuaaaaggucuuucagccugaucccuaguuggagcuauaaugagagagauugccagcuucucauuuucagguugaccucaauugucaccccuucucccuagucuuccgucuacccuacugugugauuuuucuacaauaacugguagcagauuugugcccugguugaaguugugggguuuuaagccccuauuuaucauuagcauagaggggagaaggaaaaaauaaaauugagagaaagaauaccuccucaggaaaacugugggaacauuccagguauuuggaaaacucugcuauauuucccugccaggugccacccagcuguuggacccagagguacagaguacuuuacagauagcuuuuuuuguuguuuuuaagguagggucacccaggcuggaguguaguguuaugaucauggcucacugcaucuuugaccuccugggcucaagcaauccuaccucagccuccugaguagcugggaccacagguguguaccaccauguccagcuaauuuuuaaaaauuuuuuguagagacgggguuucccuguguugcccaggcuggucucccugggcuccagugauccuccugccucagccucccaaaguacugagauuauaggcauaagccacugugcccagcccacacauagcuuuuugauuaucucauacaauuccucugugccccuaagacaggaucuaccacaaacucagacacaacuagcaguguagagcauagcaucuguuaaagggccccucaguaccacuauaggcucagugaaggugggggucuuuuaaccuuaaccguguccaacaggcauuacauaaagaagagaagaauaaugagagguggaauuugucccaguuaguaaaggucaggucaaagguaguugguuuuggugcagcagaaagcacagggcagggaggcaugagacccaggauaaguuugaacucugcuucugucuauaugaccuugagcuacuucucaaaucugggcuuucaucuucuacaaauguaggauggauuuaaugauuuccaaggugcuugccagaccugacagucuguaaauguucagugccccuaggugacugugccuauuucucuguguguuagcuuagaugugagugcccacuugcuaccagcuaccuacaagcuauauuccuuuagggcuuggccugccacucagcuccuucugcuaaacauccugcucucuggagcagucuuugauugucaggaauauguuccaaaauagaucuuaaaaaauuaauaagccccauuguuaauggagggcaguaaaaaccugcauccucauauccuuugccauuucgagaacaguaccaguguuccccacagcccugagaccagcugcuagucuggcugugguugagugagcagugucauguugaggugguagaaaaucuacccugaaucaaacagcugcuuugaaugaacucaacaauauuuccugagccagcuagcccauuucaggagacuuggggaaagauucacuugcugagaagagagacuacuuccuuuuucuauaccuuuucuacuuuucuucugcaggccacuuugcaaaagauuguuucaugcaaccaggugggacuaaauacucucugauaccugaugaggaagaggaaaaggaagaggcaaagucagcagaguuugagaagccugacccuacaaggaauccuucuagaaaaagaaagaaggugaaugcuacuuugcuuuuauuuuaucaugucuuuuucaaguuuuaagaugaaaaucugaaaagccucaugcagcaguacacaccuguagucccagcuacuugggaggauaaggugggaggauugcucgaggccagaaguuuaaggcugcggugcgcuaugauuaugccugugaauagccacugcauuccacucugaacaacauagugagacccaaucucuaaaaagaaauuuuuuuuguuaaaaaaaaaagaaaaaugaaaaugugcuuuuugcagaaauuuuagaaauacugaaaaacauaaugaagcaaaccaagaucuucuguaaccuuucuacccaaagagacucuuauuggcauuuugugguauauucuaaucuuuuuucuuuuuuugagacagggucucuugcagugguaugaucuuggcucaguguaaccucugccucccagguucaagcgauucucaugccucagccaacugaguagcuggaacuacaggcaugcgccaccaugcccggcuaauuuuuguauuuuuaguagagaugggggguuuugccuugugggccaggcugaucucaaacuccuggccucaagugaucuacccaccucggccucugaaagugcugggauuacaggcaugagccacgacacccguccacuuuuuucuagguaauaauaaauacagauauauauagcuacacauacauguaaauacaaaauuguggucauacuagcuauaguuuauaccuuuuuuucauuucacuuaucaaaagcauuuccuaguauccuuaaguguucaaaaacuugauuuaagagcaacauaauauucuacccuauggcuguaugaugauauauuuaauuauuuuuguauuacuggauauuuuuuauuacuuccaaccuaaauuuuuggccacaucucuuauuguuuucuuggauaaauuccuaaguaagauuacugaguuagggcuuuaacgcucuugauacauuuuaucaaauugccuuccagaaaauacuuaucugucccuagcaguguaucagagcaccugucucacugaauuccaucuccuauaucuacuauuuauggcagagcaauucauaaaacagauauuauugugguccagaaagaaacagugcauuuguagcaugcuacacagacaauaaaaacuauucuguagguugaucaggaaauauuucuucuaucguguaggauuuuucuaacuauggccaguauauugacuuuuguuucguuuuuaaaucuuuggcaaacuuuuguugaggggucauuuuguaccaggcauuguaacucuaggaauacaaaaacugaugagguccuugcccucagugguuauuaucuauagauuaaguauuaucuuaauuuucugggugaggaaaaguucucuauaccauuacaagaauuagccaaguauaugaauaauaauuucccaaucuauauauucucuuucucggugauccuaucccuccugagacuuuagcugcauuauugacuuccacauucuuaacuaggaugccauggguaccucaaacuuuggcuggagucagucaaauccagacuugaggcucuucugugcuauuuacuagcuguuaauuuggggcuuuauuuuugauuuucuuuuuguuuuuugagauggagugucauucugucucccaagcuggagugcaguggugugaucucggcucauugcagcuuccgccucccagguuccagcaauucuccugccucagccuccugaguagcugggacuacaggcgcaagccaccaugcccggcuaauuuuuguauuuuuuuaguagagacaggguuucaccauguuggccaggguggucucaaacuccugaccucaagugauccgccugccuucgccucccaaaguguugggauuacaggcgugagccuccgcgccuggcaaacuuccguuuuuucauuuucgaagugggauuguugugaucuuugaugacaauguucuugcagagggaugccugacucccaaaaauaagauauaaagcacugacaaguaaguuccuaauuagaguuggcuguuaugacagcccuaauuaucuuuuuuaguccuccuuccuaaacauacacacacacacuaccaccaucaccaguaccaccaaaacccuuguuucuaccuuucuaucauauauuauuaccuauuaaugucagcaauacucucccagucucccaagaaagaaaccaaugucauuuauuuuccucuccuuuuccaucccacaucuagucagucaccaaguccuggcaguggugccuuuuaagugcauaucucaaaauuguuuaucccauucccauucccacugcuacuguacaguuuauccccucacuucucuuacagucagacuauugaacgcuguggccuagggaguuuuaaaaaauacauauuugcccucuaccucuuagguaccauguuuacagggccuaggucugggcauuuuuuuuuuuuuuaaagcaccuuuuuuggcugggcaugguggcucaugccuguaaucccagcugaggcuggaggauagcccaaguccaggaguuugagaccaaccuaagcaacauagggagacccugucucuauaaaacauagagaaaauuagcugggcaugguggggcacggacuguggucucagcuacucaggaggcugaggugggaggaucucuugggcccaggggucaaggcagcagugagcugugauuaugccacugcgcuccuguccgggcaacagagcgagacccugccucaaaacaacaacaacaaaaccaccuacuuuaugucacugcccacuucuguucauuguugauuucucacccuaugcuuuaacucugaauguuggaguguuccaagggaaucucauccuguccuaugguuuuaaauaucaucccuauacucauaacccccaaauuaagugcuugugucuguauuuuauccaaaucugcauugcuauucuugacuuuuucucuggaacuccaaauuuaguuaauagacugccuacuugacgucuacaucugguugucuaguuagcaucaaguuuaacauaccuccaaaacuuaauuuuccuagccaaagcuguucuuuccacauuuggcccugucucagugauuggaacucauugacccauuugauaagccaaaaucugcagccuuuuuguauaguguuuuuuguuuguuuuuaugguaaaauacacauaacauaaaauuuaccauuauagaaguguacuguucauuggcauuaaauacauucauauuguuguacaaccaucacugucuuugaucucgagaacucucuauacucauuaaacaauaacgccccccauucacccuuccucccugcacuugcaaccacuguucuacuuucugucuugaaaccaugugguauuuguuuuugugacuggcuuauuucacuuagcauaauguccuuaaaguucaucugcaucauagcauauguuagaauuuucuuccuuuuuaagcccaaauaauauucuguucuauguauuuauuuuuugaagcagggucuugugcuguugcccgggcuggagugcaguggcacaauuaugucucacugcagccucaaccuccugggcucaagugauccaggagugugccaccacacccagcuaauuuaguuuuuguagagauggaguccugcuauguugcucaggcugaucuugaacuccuggccucaagcagucuucccaccuuggccuccuaaagugcugggauuacaggcaugagccaccacaucgagccccauuuuauguauauaccacauuuugcuuauccauuuauuuuuggugaacacuugggcugcuuccauauucuggcuauuguaaauaaugcugcugugaacauggauguauaaauaucucugagaccccacucuucuuucuuuuugguauauaccuaauaguagaauugcuggaucauauauucuguuuuuaauauuuugaggaagcacucuguuucccauuguacguucccaucaauaaugcacaaggguucaagugucacuacauccuugccaacacuuauuuucuggguuuuguguuuuuuggagaguagccauccuaaugcguguaaagugacaucucauugugguuuugauuugcauuucccuaaugauuagugauauugaauaucuuuucaugugcuuauuggccauauguauauuuucuuuggagaaauggcuauuuaaguucuuugccuauuuugcauaagcuuguuuauuuuguuguuguuguugauauguaggaauuuuuuauauguucuggauaucaaucccaucagauauaugguuugcaaauacuuucuucuaaucuguggauuguuuuuuuacucuguugauagugucccuuuuuucccuaucagauuuagacuuuuuaaaauagugguaaagaacauauaacauuuaccaucuuaacuauuuuuaaguguacaguucaguaauguugaguauguucaugauaguauucauugcacaaaaaaauuuuaaucuugguuaaguuaaacuuaccuuuuuuucucuuauugcugaugcuuuuaaugucauacucaagaaaucauugccaaauccaaugucaugaagcuuuucccuuauauuuuucuaagaguuuuguagcuuuagcucuuacguuuaggucuuugauccauuuugaguuuauuuuuguauaugguguacagaaaggguccaaaauuucuuugcauguagaucucuaguuuuuaaaacaccauagguugaaaagacuguccuuuuccccacugaauggucuuggccccuguugaaaaucauuugaccaaauaagugaggauuuauucuaucacuggucuauaugucuuuaugucaguaccacacuguuuugacuacuguagcuuuuuaguaagcuuugaaguugggaauuguggauccuccagcuuuguucuuuuucaagauuguuugggcuauuugggguccuuugaaagauuucauaugaauuuuaagauagauuuuuauauuuuugcaaauucugauagagauugcauuuaaucuguagauugcuuuggauaguauggacauuucaacuguauuaaaucuuccaauccaugaaaauuggauaucuauuuguaucuucuuuaauuucagcaacauuuuguaauuuucuguauacaugucuuucaucuccuugguuaaguuucuuccuaaguauuuuuuucuuuuugaugcuacugugugaauuguuuucuuaauuuuuuuucugauugcuccuugcuacuguauagaaacacaacugauuuuagcauguucguuuuguauucugcaacuuugcuaaauucacuuacucguucuaacaggauuuuuuuguggacucuuuaggguuuucuacauagaagaucaugccaucuguaaacagaaauaauuuucuugcagauuuaguuuuuuuuuucuuuugaggcagagucuugcuguaucacccaggcuggaguacagucacaugaucguggcucacugcugccuugacguccugggcucaagccagaucuagauuuuuaacugugauucuauuuguauguuccaagcauuauucuuucucuuuuaaccuuuuagagguaaaugguacuuguuacauuccuaaagaggguauauggauaucucacuucuguggaucuuugguugaguucuuuuugcugaauauauugaguauaauuuguuauuccuuuguuucuaaagcugcuuugagauauguauuucaguucacaaaaccaauuacugaggcucuaucugcuagguaugaggcucuuuaugaccugcuuagucaaccuacuacccagcccuccauugccuuucacuuaguagaggaauggucugaugaacaauggcaguaauaaucauuauacauuauuauuucuuaaaaguaucuuuggccgggcacgguggcucaugccuguaaucccagcacuuugggaggccaaggcggguggaucacuugagaucaggaguuugagaccagccuggccaacguggcaaaaccccgucucuacuaaaaauacagaaauuagccaggcgugguggcgagggccuguaauccuagcuacuugggaggcugaggcaggagaauugcuugaacccaggaggcggagggugcagugagccgagauugcgccacugcacuccagccugggcgacagagugagacuccaucucaauuaaaaaaaaaaaaaaaaaaaaaguaucuuuguguauaugaacuucuaacucaugaguccucuuugauuaaaaaguguucuagggaguguagaaggguaaaacuuuccucuugaugcccacuauuucuaccaagauagcauuuagcaucguugucuuuucaccucauuguuaaucccgucauuaccuuuuaugccucauauuuguuuagugcuuacaguuuauaaaauacauugcuguuuuuguuucuuuuuaucauuauacaauucuaugagauagccagaacaggaauuauuaucccaccauuuuacacaugaguaaaauggagcuucagagaaauugacguaacucaccggaagucacacaaauauaagagauaaugcugaaaaaauaacccaugucuucagauuacuaacaauauucuuuucuguauaucacacuucaaccauuuauuuaacucuucaauuauucauuuacugaacaaauauguauuaucugcuucauagguaucuagcauuguguuagguacuugacauaucaggacucaucaagucaguuuuugguggguuuuuguuuuguucccagcuaccguuagccaucaugugauguuaucuauugauuuguuucugcucacaacuguaaaucaagauuccagcccuccuguuuccuuuuacccucuaaaucuuggauuccagcaggagguugguuuuccuuaacaguaaaaucuucugucugagauggcuuuuuuggugugugaguggcagauuuggacacuuguuucaggacuagucagcucugggagccaaauauggaacugaguagauuugugaaggaacaugccuuuagcaguccaugcuccugaguuggacaguggagaguaggaaugccuggcguguggaagggcauauaugauaguaacucauguaaguucaguuaaugcauuucuaacaguuaaaaaaguaacucaugaaauaaagaucauaugguaccuacacucaagcggcuaaucauauaaggagaaagauaagcagccaagcuauguauggugguaaaggauagaaacacauuccaaggagguuauuugauuuuauggacauccaaggacaggaaaugcaguguagucaggccaccuaggacuagaacuggaaagucucauuagguucucaucuccguuucuucacaagucuguuucauuaccucacuuuuuauagucuaguggaagacaaugcaaagccucuaagaagacagaaaaugguagaccuguugaggaaccaccagaaauagcccaggauaaggaaaggaugucaccuuuuacaaauaaugccugguacuuaauaggaauacaugcacuaacuaccugugaauagauagacuucauaaucugugcucucugucauuccuugggugucuucacucagugaaaccugcccucagauugcagaguaauagguauugacuccugcugcuggcagugggcgauaaugaaaggagcaggggcaggaguaagaauaacagaucuuccuaaccuugagccuucccacgucuuuucauuaaaacauacauguauugaaugccuuuucccacaaguccaggaugcauugauuuaguugugugcaucuggcaccaugaacaauuuuugucccagugacugaauguuauaaauaauuuuuguugggcauaauuagaauaaaaggaaacuguguguugcaauuggaaaugggcuaugaagugguugguaaaauaggaauggagguuuuguagugaaucccuggauaaucuucugaugaacuuguggucugugcuuuacuggccucuuucauuaaucauaugccaucguaggucuuucugaaucgguguuauguuaugaagaaguaagugccuuggggaccaagcugcccacugauuauaguaaacuuuagauauguuugauucagaauauaauuuucuuuugauuuuaccauaugauuuucugcuguaccauauauagaagaacaagaaauaggaaugucauucuuuggcugcaguguuggcucuguccugcuguccagagaacuucuucuggugccuauauagagaaagguugccaguccugagcccacucagggacacauucucugccuauucagauacagcagagagcguugcccaguguugccuacucagaagccuucagugguucgcuuucuucuaugacauaaagucuaaguuccuuuaagacucuucacaaucugcccagcuuccuagcaucauuucccaccagucucuucccacacacuauacuccagcuucauucauuaauagagcuucuacugugugcuaagcucuguucuggccauugcagguaaaguagugaacaaaacagguaaaaucccuaucuucauggcacuuagauucuaauggauggggucgauugacacagauaauaaacugguaaacaaauacaaaauaguaaaaauaauguaucaaguagugauaagugcuauagagaaaaauuaauuugauuaagggagauagggaguccuagaaugaggauguggggagcaggugacuuucauuuuagauaggaugguaaggccaggccuuucuuuuuuuuuuuuugagacggaguuucacucuuguugcccaggcuggagugcaauggugcgaucucagcucacugcaaccucugccuccuggguucaagcaauucuuaugccucagccucccgaguagcugggauuacaggcaugcaccaccacgcccagcugauuuucuauuuuuaguagagacggguuucuccauguuguucaggcuggucuugaacucccgaccucgggugauccacacaccucggccucccaaaaugcugggauuacaggcgugagccaccgcgccuggccugggccaggccuuucucauaaaguguuguuugaguggauaucagaaggaagugaggacacaagcuauucagguaaguggagagagagcauuucagcaaauguaacagcugauguugggaaagaguguggcaugauuaaagaacauuaaggacgccaguguggcuacagugaaaugaaugaaaagagagugguaggagaggaaguuagaucagaaggaacccagaucacuggggccuuauaggugauugggaggauuucaucuuucacuugagugagauggauguuauuagagguuuugagcagaggaaugacaugaucugacuuccuuuuaagagaauuauucuggcugcuauguagaaacuuagauggucagaaagcaagaguagaagcagugaguugauagauaauccagaugaugguggcuuggacuagaaugacaguggcaaaaaugaugagaaaggaguugaaguguguauauauuuugaagauauaagagcaggugaggauggcaucaaaauuuuuggacuguguaacuggaagauuugaguuaagagaaggaaugcaggagaaguaagugugggaguagggagcagucaggaguuuaguuugaguugcugucuacacagauggaaagauagcugggagagucuagguuugggagggggcggggcauagaaauugaguugccuaucagauauucaaguagaccauagaguagacaguggauauauaguuuggaguucaagggagaggcccagguaagauauauaaauuugggagucaucuacauauagaugguauuuauguucaugagaucaccugcagaguaaauauagggaagagacugagccccagagugcucaacacuuagagguuauggagaugaggaugaacuaacaaagaagacaggaaaggaacagccaaggaaguuuguagaaaaguaagagaauguaaaaugugguagaaauaccaugaauguguucuagguaagauggucuguauccaucuugacugaccaaguaaauaagacccaauaauugaccacuagauuuggccacguggagguuacugguaauuuuguuuguuuguuuuuguagagacagggucucacuauguuuuccaggcuggucuugaacuccuaggcucaagagauccaccugccuuuagaaaauuaaguacuggcugggugugguggcucaugccuguaaucccagcacuuugggaggaugaggcagguggaucacuugaggucaggaguuugagaccagccuggcuaauauggugaaaccccgacucuaguuaaaaaaaaauacaaaacuuagcugggugugguggcaugcgccuguagucccagcuacuugggacuacaagcgauucaaggagaauugccugaacccaggagccagaugcuccagugagccgagaucacaccacugcacuccagccugagugacaaagcaagacuccauccuaaaaauaaguaaauaaauaaaauagaaaauuaaguacucaauaaauguucacugcuauauucucuuuuuucaguuuuugcuuuuauuuuuguuuuucugucacacugggcugcugcuauccuguuucagaacuauagugaaaauggguagacuagcugcucuaacaagggauaugugcuuuuccuagagagcagucuuugagauguuugaccaguggcuuccuuccagugcccccuugaccugcgccaugggcucacacuccuaugccauuuaaaaacuguuuuauguuuaauuuucuauuuccaucugauacuugaauccaugucauuuuuuuuuaacccauuaucuucuguuucccuucucacuugaaugaaguugagagagcagaagcuugguucaucuucuggcucucagucuucccccaccccaacucccaacuuugcuuuugaacuacaaccuuuuuuuuuuuuuugagacggaguuuccaucuuguugcccaggcuggagugcaauggcacaaucuuggcugaccccaaccucugccuccggguucaagcaauucuccugccucagccucccgaguagcugggauuacaggcaugugccaccacgcccggcuaauuuuguuuuugugugugcguguuuuguuuuguuuuguuuugagacagaguuucgcucuuguugcccaggcuggagugcaguggcgcgaucuuggcucaccaaaaccuccgccucccacgcucaagcgauucuccugccucagccucccgaguagcugggauuacaggcaugugccaccacgcccagcuaauuuuguauuuuuaguagagaugggguuucuucauguuggucaggcuagucucgaccuccugaccucaggugauccacccaccuuggccucccaaagugcugggaucacaggcgugagccaccgcaaccaggcgaacuacaacuucggaugugauuguucuuuuguucuguagcucaaggcuagacacguagggaaaaugacgccauuugcuggaggauuggauugucuuuguucaggcugcaaaacagcuuuugcaucaaaguugaggucuaggagaaggccaccuccuugagcccuucuugcuagcuagaguccauguuccagcaugccaggacucuccagugauuuguuuuuaucuucccuccuccugagccuucaucuuugagagagaacaaaguggaaauagugccaaacucuguguuauaaaguauagugguuuugccgcuuuagccuuggucgacucacuuuacauuucugaguugcaguuuuuccaucuguaaaaugggaauaauaacucaugaaguuugacucuacagacuauuauuguaagauaaggaugcaaaaagcuugauaaacuaaagcacuguuuagguguaaggcaguauuauuacucuccucacuucuuuauccaggcuggaccaggcuugcagggaacuggugccagacucuguauuuucauuuuuacuuucccaggauauucaccuauauaaggggcagaacccagugaggcuccugaccccauaauaucuugugauggacuuccauggucuugccauccaggaagguucagcaacauagcuaaacuauugauuugccaacucucagcuccucccagccaugguuguuauagcucgguaaugugggucugagaagcuuuguugccuucucucuacuccauuggagaugccaaggaagaauuguuauuucaucuucucuuaaaacuuugacuugucuccuguagaugcuuggccaggcugucagaacauccugggaguuaaugagagaaaaauacauauagcucccacuaagugccuauaaugugucaggcacuauaguuagugcuuaucuuguuuaaaccucauagcauccuuugaaauagguacuuauuauuuccaguuuacugaaaagaaaacugagguucaaaaaaguuaaaucccuuguucuaagucacauagugaguuaaguugcagagcuagaauuugaacuuaauucuaucuuauuccaaaauuuguuguucuaaugaccauaccaugaggccuccuguuaccauacagaaagaggggccaugugcuacauaggaaaacucaggagauuuccauucauaugaucuacaugaagaucccaacugcgccuaugcgaucugggacaaguggcuuucaacuuguccaagccuuagauacuaucucauuaacuugucaccauagguguuuuuuuuggggagagggggagauuauuuauuuauuuauuuauuuauuuauuuauuuauuuauuuugagacagggucuugcucaguugcccagccuggagugcaguggcaggauuauggcucacugcaacuuccagcucuugggcucaagcgauccucccaccucagcuuccugaguagcugggacuacaggcccgcguaaccacacccggccaauuuuuguauuuuuaguagagacaggguuucaccauguuggccaggauggucucgaucuccugaccucaugauccaccugccuuggccucccagagugcugggauuacaggcaugagccaccgcgcccagccaguagauguuauucuuaucuccaguuuacauuugaagggaacaggccucagugaguucagaugacuugcccacggaugcagaauaguaaauggcagagccagaacucagguccaggucuaucuaacaccugcuucaguguucuuuccaccauuuuucacagccagcuucuaagaccugguguaucauucagcuagauuuauagcucugaggcugcugguuggaagcuggcauccuuuucugcucucuuucuccucccauacuuucucccucuucuuagaaaccuuacagaggcaauauagguauuugaaauucaaagaagagauuuaugccgugcuuaaaaucugcucauacugccccauuagacaccugggaaucugccucucgucuuuuguauggguuuguacuguuacuuugguagcaugaugugguggguauaguuuugggaauguucuuucucagcucuuuucuuuaugaguauaaucuugugagguggcuguaaaguuagagaugaugaauauucaaggguagcaaguacaggcuuauuauuugauggcaguuauuuccccuggcaccaggaucuaauagaaaccagaauagcagucaggaguucuaaaucuuuuacuccuauucuuugaccuuggauaugugagucacuguuucuagauagacuggcuagucuuuaggggcgccuuucagcuuuaauguccugcacuuuaaaaaaugaaaguaauaagauacuuguuuaaaaaaaaucaaauuagacagaaguauuugaaggaaaaagugaaagacccauauccuuucccccauucaguucauucccaauguguaacacuuauuaccaguuugauguauccuuuucaguguucucuguguauacuaaauauacacaaguauguguaacauacacaguuuauaucaugugcauauauauauaaauacacauguauauguuauacgcacuggaaccuacaauacauauuaugucuugguucuuuuacuuaacauguuuuagcuauuuuuuucuuguuggcacuuaaagauuuacuuuauuguuugcaaugucuuauacuuuuuuuuuuuuuuuuuuugagacggagucucgcucugucgccaaggcuggagugcaguggcacaaucuuagcucacugcaagcuccgccuccuggguucacaccauucuccugucucagccucccgaguagcugggacuacaagcaccugccaccacgccuggcuaauauuuuguauuuuuaguagagacgggguuucaccauguuagccaggauggucucgaucuccugaccucgugauccaccugccucggccucccaaagugcugggauuacaggcgugagccaccgcaccuggccacaaugucuuauacuuuauuaaguguuggcuggacauggugucucacaccuguaaucacagcacuucgggaggccaaggugggcagauugcuugagcuuaggaguuugaggccagccugggcaacauggagaaacccaacuccauaaaaauuagcagggugugguggugcauaccuguggucccagcuacuugggaggcugaggugggaggauugcuugagcccaagagguugagguugcagugagcugugaucgugccacugcacugcacucuagccugggcaacagagcgagacugucuaaaagaaaauuaagugguccccuauugauugugugcuauaauuuuucuuuuuuucucuuuuuagagaugagaucuugcuauguuagccagguugaucuugaacuccuggccucaagcauuccucccaccucggcuucccaaaguacuaggauuacaggugugagccacugcaccuggccaauuaugugcuaugauuguuaaaagcaaauauacacauacaguguugauuuuuaaaauuuucuuuucaggagaagaagaaaaagaaacauagagauaggaagucaucugacucugacagcucagacucugagagugauacaggcaagagggcaaggcacacaucaaaagacagcaaggcagcaaagaagaagaaaaagaagaagaagcacaagaagaagcacaaggagugagaguauaaagaguguagggggugguugagaguaagaaaccaggagccuugugccuugagacuccuggaaagacucaauagugagaauauagccucccaccccauuaacuucgcucccaugggagauggcuuccccucaugcaacaggcagguuugggaguuagaggucaaaagcagcugccugaaugaguuguuguuuccuuaucacuccuggucccuuugcaagugaacccugcagcucacccauucauucacccaacuuccuucauucagcaggagguccuauuacccucuccagcugccacugccagagcuggauuccuguaaaggaguccaggcuagagccacagagacuguuguggaggugaguucggcuguaguuagagugauuggacccuuccuauuggucuguccugggccaacuggugggugaucucugcugcauccaacaugggagcagagacuggcagcaggaggggggaacauggugagaaguggugcucacuuuucccauuccuccuaacauaguucuacuaugcuagaaguggcauccagcggccacagcuagaaaacagucugcagugugacuuaacuuguguauugcauuccagcagaccacugaaccagacagcgaagccaagaucauuguucuacuuuguauuuacuacugugugaaucaguugauucuacuucagguccuugcuuaaauuccugucacuaaauggaaauguguuugguuuu

SEQ ID NO: 191416 - RNA, 37230 nt, Homo sapiens
uuggaaguuuaaaugaauuguauucuguggccacaucaugcucuauucugauuuauagcaaucaagccucaaaaaaaagacagcaauaaauccaauccacauggcucuuguaaaaaggcaucuauuuggcuuuuaauacaaaaugauauagagaaauacagaaagaaaauaucauacaagccaguuacaaaaaaaaaaaaaaaaucccaaccaacaaauuugucacauugggccugcauuagaaaacaggaaaaaagaaaaagaaaaaaaaaaacagucccugaaaucuggcaggugguuuuuagaggccacagggagcuugccuuagucauccuggugaaaugggacagaagugguuuuuggaauauggccaccgccuccuguuucuugcuagcaauggucaucugaagggagggugcuagccuggacauccaacauuuggcaucacuuaugcagucugaggucucaaagacaagcggccuuggagucuuccaguccauaucuucacugaaucucucccauauacagucucuugucacucgaugcugagauaacugagguaaaaagaacagauaacuagaaauaaugaaggcucaaggagacuuggugcucaagggcucuugugucaagagccaauucugguauaaaagagcaauuggacuuagcuuaaauuccccuccuaaacaccauccacaggaaauuguagccuggcuuuucaauccaaguccucuaauaucaugaggaugacuguacuaugggaaauacauuaucagacacuaaauacugacaucccuugucagucaaaccccaagaaaaagacuuucccagucauucuagaagagaggaaucuauggcugugccagucauuuuguaaaugugcuucugcuuguuauacuuagcccuggagaaaguuacaguuucuccuuuaauucaaggcugaaauuauuugguuuagccagccaaaaaauuuuaagcugaaauuuauaucuaaauauuaaaaaguaucauucuuggccgggcgcaguggcucacaucuguaaucccagcacuuugggaagcugaggcggguggauuaccagaggucaggaguuugagaccagccuggccaacauggugaaaccucgucucuacuaaaaacacaaaaauuaggcaggugugguggugggugccuguagucccagcuacuugggaggcugaggcaggagaaucgcuugaaccugggaaggcagagguugcagugagccgagaucgugccacugcacuccagccugggcgacaagagugagacucugucucaaaaaaaaaaaaaaaaaguaucuuucuuuuaaucaaauacaucauugaaacagacuugauggaaguaaauuuaaaaaaaaauuagacuuaccaacuucccuuugagaucaagaagaaaauggagcauugcucuuacucucaccacuuaugagcaauggugagacugacauugauacccacauaaagacuguuugcagcugggcacaguggcucacaccuguaaucccagcacuuugggaggcugaggcggguggauuacuggacgucaggaguucgugaccacccugaccaaugcggugaaaccccgucucuacuaaaaauacaaaaaaaaaaaaaaauuagcugggcaugguggugggugccuguaaucccagcugcuugggaggcugaggcaggagaacugcuugaacccaggaggcagagguugcagugagccaagauugcaccauugcuccaaccugggcaaaacagcgagacacugucucaaaaacaaaacaaaacaaaacccaacaacaaaaaaaccaacaacaacaacaacaaaaacacccaaaggcuguuugcauggaaauucguauaaaacagauacccgcuuuugacucucuauucccaggaucccuacggggagauuuccaguuucccuuucccccucguugggacagacuuacugaugggcucaucaggguggaaagccacuucauugauggagccagcauggccgggcagcuuauacaauauucuccugcuugugguaucccacacauaaacaaaccuguaagguaucaugaaaagcaaggguaaguccucuuagagcuggggguaggacagaggcauggcuuuuuaaaggaaauggaagcaacaauuauuuacuuaccuuacauuuacugaaccauguucuggcuuuuagaaacuaggaacacagaguuugaauaagacauggacucaccucuugagcaaugggguggagaaauaagaauaacuaaaaauauaagcaugacuggcauguuugaauacaagcuucugaaaugggaaacaccacagggaagaaaagaaaguuuuuccugcagacaucacacaaaaaccuuuuucagagugucuaguauaauuaggcuacaguuaacuucauacucauccaggaaaucuaaaagguaacccaacucauggcagggugggagccuaggcugcugauccagaugaacuuuuuaguacuguauucaaacagagaccugagaagggacaggaagugucugguauauaaaauauuuauaguguuugcuaaccuaauacucacuugagccaacuuuuccauugaauuaacaggcagaaggaauacugaauucuagaaugggaaggggccaagagaaaucagcuugucuaggcugggagugguggcucaugccuguacucccaacacuuugggaggccgaggugcguggaucgucuuaggucuggaguuugagaccagccuggccaacaaggugaaacccagucucuacuaaaaauacaaaaaauuagccaggagugguagcgugugccuguaaucccaacuacucgggaggcugaggcaggagaauugccugaaccugggagguggagguugcagugagcugagaccguggcacugcccucuagccugggugacagagugagacuccaucuccaaaaaaaaaaaaaaaaaaaaaaagaggagaaaaaagaaaucagcuucucuaaacuccuuauuuuagagauaagaaaacuggggcacagugacguuuccaaggcaauacaguucaucaacggcguaacuaaaauuagaacucuucaaaaaaaaagagcuuauuagagaauguucuuaggaagacaaaauuuuuauuugucauuaaaaaaaauuaugaggcugggcaugguggcucacaucuguaauccuagcacuuuggggggccaaggcuugagcucaggagcuugagaccagcuuggacaacaugguaaaaccccaucucuacaaaaaaauuagccagguguaguggugcaugccuguggucccagcuacuugggaggccaaggugggaggacugauugaguccagcacguagaggcugcagugagcugagauggcaccacugcaccccagccugggugacagagugagauccugucucaagaaaaaaaaaauuauguuuuuuuucaugcuguauaauaaagguaauguaagaggcuauagaguuuuaagcuucuuucuacugaaauacucugaauacuacugaaauacuacugaaauacugaaauaacacaauguacuuucugcaaugcuagaauaaauaaaaaaaaacuucuacauuucucuucaaaagugaugaauaauaacagaagaugucauaaaaaugugauuuuuuccuuauucauucuauaguauuagagccaguauuuuuaucaucacaggccauaauuuucacaaaagucuacauauuaucacagaaucuuuuuguuuuucucaauuaauuuuuuuuuuuuuuuuuuguagagacagugucuuccuauguuguuaaggcuggucuugaacuccucgcgucaagcaauccuccugccuucaccucccaaagugcugggaugacgggcaugagccaccaugcguggcauauggcacaaucuguauguauuuagagagccccugaaaucaacucuguuccuaauccucugagccaaugaugacuuuauagccuuaucaaacugaaguaaaacuugaagggcaaguugagugaacugcugagauuuuaugagcucaucuaggcucuccugaagacugugucccaaaguaguacuucuguauaacugauaugauauggcuuaggaagaagaaauuguuuuucuuauucaagcuugccuugauguccugugcugaagguuuccugccauggagcagacagaagugaccaggagcccagcaggggguuccuauguuccugaccaccucuucaguagccacagaaacuacagagcugaacccaagacucuggagcucuuaauauacucucguauuuuacuuucacuuacccuccauaaauguacuggcuaaaaaaaaaaaaaaaaaaaaaaguuccuuugacccucaaucuugcuuaagucauuaaaggguaaaguauagagcuauuaucuuaaucugaugauguaaaauucaucuguugguaaauauaaagggcugguaguuuugaagcagguauuuaaaauuauuuacauauuuuguuuugugcaaucaacaacucaccaguacuugaucauaaaaaugguacauucaccaguacuggauuauaaaaugccuaguucuaauccaacuuacacuuuuggucaaaaaugcaaauaaacaagagcuucuuaauuauacuauuuagcugucaucagcuaggcuccauagaaaguaaguucugaacaagauggaagagaagcaggaacuccaucugucuagacuccauggcucugauacucaugcccuuccuacugucuucuuucuugucaugcacaaaaagcugguccucauuaauucaauaaagggcaguauggcauagugaaagaguaugagcucuggagucagaaagacugggguucaagucucagugcagcuauuuacuagcuaaguaagcuuagcucagagaaguuaaauaauugcagaucauuuaacuucucuaagcuucuuaguuacaaugauggagaaaauauugaucucauaacuuuguugagaaaaauaaugagguaauauaugcaaagugccuggcacacagaauuaauuauagcuauuguuauuauaaguacacucaucaucaaaacagaaucucaugaagucaaugggcugaauaaaucacucuuggccgagagacuggucagccuucccguagccuauaggacuauucagaguuucaaguuugaauaugaggaggugaucuguaaguuauuaguuaguagaaaggagaaguuugccaaauccaggccaagcugaaaaggaguuuucugaggauacauuucccaggcacauaaaagacagaaucccagaucuccaaggguuuacacuucaaggucucacucuugauggcugccaauuagaugcuaaauuuagagggguuccuugcccucuccuuacuuuggcauggcaacauuuggcaggaaccagaagccuuauguaacacagcugcuucuugacuuggggccaauuggugagguggccugucaaaucuugccaacccccagcagguagagagggauaggcuuuccucauaccacgcuuucacaugugauuuuguuuuuuuuuaaagagauggggucuugcucuguugcccaggcuggagagcaguggcaugauugcagcucacuauauccucaaacuccugggcucaugggguccuucugccucagccuaccaaguagcugggacuacaggugcacacuacuaugccuggcuaauuuuuuaaauauuuuuuuuauagagacaggguccugccaucuugcccaggcuggucuugaacucuuggguucaagccauccuuccaccucagccucucagaguguugggauuaaaggugugcaccauugaccacauguaaaguuuaaaggaacaguggagaggaaaagagaaaaaaaggacauugcaauucagaaagggccaaugccagaaacaaacugcucaucagaaaaaaaaaguauguaaauauaauuuaaaaauuuaauuacagcugggugcagugguucaugacuguaaucccagcacuuugggaggccgaggcaggcggaucaugaggucaggagauugagaucauucuggcuaacacggugaaacuccaucucuacuaaaaauacaaaaaacuagccaggcgugguagcgggcaccuguagucccagcuacucgggagucugaggcaggagaaugguguaaacccaggagguggagcuuguagugagcagagauugcaccacugcacuccagccugggcgacagagugagacuacaucucaaaaacaaacaaaaauuuaauuacaaaagauacacucuuucugcugaaaauuauguaaaaauacuuaggauaguucuuacuauaucagaauaugagacaccuuagucuguuucuugaagucuucucuagcaacuugauaacuuaaaauucuuuagauuucccucuucuaggcagcucucuaaaccacuugcacucaaaugaucaaugugacacuuucaccuggacccuuucuuuuuccuccagaaaauaccugaauacuuguccauuuuucuuggcauuaaacuugucaggaaaaaaaaaaguagacucuggaauuuaaauauguucagaauuauucauuaauagaaagguaugggacagaucacagugcagcuucuguguggcagcguuagggccccaaauagaggaaaacccuggaauaugcugaaagcccuggcuagcccaagaaagucuuccuauuuauaggauggugcuuguuucaguaggauugaaagagaaacucuaaaggggaggauaggauuaagcuaaaaagggucaagacacugcccaaugagagcuaaacacaggauuugcugucagagggucuuauuguucuuuaccaggccucauuugcagcccaucagacucgacaccuggacaucccuauucaaccucugauucucccccaagcacagguuaccacagacaugccaaauacaacagcaucugacagaagaauucucucccuucuguuucucauucagcacauaaugccugagccaguuuagauucguauuucauaaagccuuagccgauuaauucagcaugggguggaaaauaccuaguucacauuuuguuacacccugcaccuagcaaucauugcacuucccacuaacccagacacagcucugaaucaucuccaacacaggcaggcauuaccaauagcugagcugcuaugcaggguaaaauuggacugccauucuucagcuaggaauucauucauguaauauaaacuaauugguuagaaaagcucaagcacugacaacagugccauggguucacagaaaugacuaagauucauucccuaaucucuaggagaaaauaacuuaguggagguaccucacuuugucugucugauuguaagauguaauaaaugcuaccaaaguuuagauguaugaaaugggauuacagcacaaagaacaauuaguuaucuccaagagguaauagagagaggggaccagggacaguuuauggauguaacauagaggugguuacuagagagauauaggaguuuagauaaugaagagggaaugugagagagaaccuagaggugagaacgcaaaaggagguuagaauaugaaaauuccaugugcgcagcauuguggugauggugggggagguggguauuuaauauguguucaaaugaacugaagcauggaauaagaaauguggugagggaaacuagagacagauuaugagacugaauuuuauucugauggcaaagggaacccaacagaaucaaacaaauuguugauccucuaggucuaaaaugucuccaaaguggguagaaaugaucuguuugucgaacacgguuuugaaacccuucauacugcacagagcuucaucuucaagcacagucauaacucuaugucugcucuagcuccauauccacgcuuuauguauaaaacacaagaagacauccugcauagcuauaucauuguuuuuuuuuuggagauggagucucgcucuugcugcccgggcuggagcagugcaacggcgugaucucggcucaccgcaaccucugccucccagguucaagucauucucuugccuaagccuccugaguagcugggauuacaggcaugugccgccacgcccggcuaauuuuguauuuuuaguagggaugggguuucuccauguuggucaggcuggucucgaacugaccucaggugaucugcccgccucggccucccaaagugcugggauugcaggcacgagccaccgcauccggccagcuacaucauucuuuacuuugcacccacuaauccuuaccugucggcugagccagcugcuauuuugcuuccaucaggugaccaagaacaucucagaagguucuaugauaaacaagaauccacugaauaguaauauaccaaacuccucuuugcaaggcuaccgaaucacuaagaggcuuuaaauuuccuaacuagaguuuuaauuacucuucucaggaagauggucuguaauuaucuuauauucuauggcccaaaacagcauacuuuguuauuuuacaccauauaaaaacuguagaaaauacuuaacuuacaguuaauuagauugaaccuggcaacaaaauuuuguucuacuuauaaauggaggcucccuuugcuccauuuaucuugauacucauuuuuuuuccuauuuaucuugaagaaaaauacacgcaaacccaacaaauaauaaauuuuggguuuuuuuuuuuuuugagacagggucucgcucucuuguccaagcuggaguacaguggcacaaucauagcucacuguaguuuugaccuccugggcccaagugauccucccacuucagccucccaagcagcugagacugcaggcacaugccaccacacccagauuuuuuaucuuuuguagagacagggucuuacuauguugcccuggcuggucucuaacuccuggccucccaccuuggcuucccaaagugcugggauuacagcugugagccaccaugccaggucuaaaaaacaaaauuugauuuauacagugaaacugaaucucaaugagcucucaaaaaaaaaaaucucuauuaacaaauucucugaggggaaaagcuucuuucaauagagcugaccuugaaauuugaggcuuugaaaaaaauuuucucucucagaacuugggccgugguaguuacugagggaagagauguauucuuaggguucuaacacacauggucacgggaugcggaggcagguagggagaccauccagguuacagcuaugggagcuuggguuccauauggaaaacugauuuaggaggguaaaauucccaaguaauuaaaaaggccaggagucucuuguugaggcuggugucaagucagaugcccucaguuugagggcuggcuccauuccuuuugggcuauaugacuggcuucuccccagucacuauuauuucuauccguuuuauuuuuggcaacaaguuuuaauuaagagcaguguuauuggaaugaaguccauucuuagcagagcuacugcucucuauccuuaguaccaccuuaaauguuucucugaaguaaaugaacaguaaaacuccucugccaugcagaacucaccuuuucaaaguugugcacauuuccuugaaauaucuuuacacaucucucuuugggggcaaauggccggacaucccagacacgaacugcaaaacaaauccaaauaaacaaaccaaccaaaacaacuaucggccagaggccuccugggcacccagcugaaauuaguaucaugucaaucaauggcagaugcuguuuccucggugggcaaaguccaacuugacauacugcuaccuguuaaggcucuuuucuuuuucaagcaggaaaacacaucuaaaucccaauaacuggggcuagcugagggggcaggaaggaaaaaugucacacacaauguugguaauuugcaacagaaugcaguugggugugauacuaauuucaaaaagauauuuugcaagauuucucugccagcuuagucacauccagcaaagcuucaaugugacaaacuaaauaccaggaacuacugugacaaugaacuuauaaaagccaaacuuacaucgcccuuuccuaauuucccucauaugggcaccugauagucuaagacuggacaaggucagauauauauaaaauauauaaaaggucaaauaaaucaaaaaagcacuguaccauaccaaaaaucagaaaaaguaaacauugauucuaucucuguuacauauuugggugaugucagguaaacagugagauuguuugugucuugguuuuucuguucuguaaaaugaagagaaaauuaucugucuucuuuuuaaaauaauauuauugacugauaugauugagauggaguuucgcucuuguugccuagccuggagugcaguggcgugaucucggcucacugcaaccuccgccucccagauucaagugauucuccugccucagccucccaaguagcugggauuacaggugcccaccaccacaccuggcuaauuuuuguauuuuuaguagagaugggguuucaccacauuggccaggcuggucucaaacuccugaccucaggugaucuacccugcccagccaauaacacuauuuuaaagauccaaugagaugauauaugugcaaagguucuaaaauuuguaggcaacaaacaaaaauaaagaauuuguaauuguauuaugcagccacaagaaauuauucuauuauuuuuuccuuauuuuaguaucaaucuaggaaaccucauuguuccucauaaagaacgcuagaauuagcuaggcaugguacuugggaggcuugccugggcccaggaguuugagaccagccugggcaacacagcaagauccugucuuaucaaaaaaauuaaggaaaaaauauuuuuuuaaugcuagauuaaauguguauaaacaucuauuguaagcaguagcuauagccguuguaacugaagcuauaccuauaguggaauuucagugaugucauuuuauuugaguaugaaaaaaguauuaucaauccuuggagucagacaggcauaaaaaggcaaagcuaugcgugaaaguuugccauugagaauauaguuaaaagguaaagauguccauuaauucaacaaauauuuauuaaguacccaaugaaugucagguauuguuuuuguuacaaaaugucagggaauacauuuuaguuccugacaagccuauaauuuuguauaccagggccauuuccaaacucccucaacauuaagcauauaauccagcaagucaccuuacuuuuuuucuguaguaacccauccucccacccuacaacucaaaaacaaguaaagagaaagagcaagaguguguucguguaaauccagaauguuuuaaugaagaccucuucccacaccaaugcuuucagaguggggagggaagacagacuggcaggaaagagcagaagagaucauccaagcuuggugcucucugaaaacgcacaagaacugccuugaauagacuucuagauucacaucuuuuucauuaaacucaucaccuagaguuucuaauauccuguuggauacacagcauaccagagcugagaugggucuuaaagguaaaguccaaucuucuuaucaauguagaaacugaugccuagagagaagaaaugcugugugcaaaguuguucagggacaagacagagaucugagacuacaguccuagauucuugacuaucucaccuaaagcuuuccccauuacaacacauucuaaucgucugauggaaucugugagcaaucuuugacuuuuuccuuggauccugggagagauuuccuuuccaaaguuaccuguauuguccauugcauuggacaaaagauaagagccuucagaacuuaaacucaggccagucacugaaucugcauggccucucaugguguagguuagcuuguucuggcgcaggucccagaccugcaaaaacagaaaggugcccccagaaaucaaauuaauaaaagcagagaaagagaaugacacaagagacaagagucaauugcccagagacacugauauuacucuacuauaaaacacaggauuucugucaaagagaaaaacaccuuuuuuuaauuuucauuuuuuuuuugagacagcgucucacucuguugcccagugcaguggcacuaucauggcucgcuguagccuugacuucccgggcucaggugauucucccaucuaagccuccccaguagcugggacuacaggagcaugcuacuauacccagcuaauuuuucugaagagacagguuucaccauguugcccaggcuagucuugaacucccgagcucaagcaauccucccaccucauccucucaguauuuggauuaacacgcaugagccacuaugccuggccaaucucugucuuucuaaaaagguagcucaggcuaccacguuugacuagauaaauauaaacgaaugcauaucaaauguuaagauaaaguuuuacacacaaaaaaauagaauucagaaagguuauuuucaaaucauagcaaagaaaaacuauuauagaaaaaaacuaaaaauggcuaugauucuuagccauuaaaaauuauuauaaauacauaaaacgaacaugucauuuaaaaaaggcauuaugauuacauguuuguguaacaauaugaaaaauacagaugcuuaaaauuuuucuuuuaauguaacaauaugugacaauaaauguauauauauguacauguauggauauguacaugcacauacacuauggaaaagcacauuuauuaaaauaaaaauaaauuacagguucacuauugcuuguauaggaaacguaagauacagaaaauaaccuaaacgucaagcaggaaaaauaggugguuuauuaaauuaugguucauaagcacauugcaaaacugaauucucauacaggagauagcaugacagaguagaaagaguggugacuuaggguaagaauaaacuguuccuugccacuuagaguuaugugucauugggucacuaauucuuucugggccuguuuccuggucuguaagauuagggauaacaauagcuacuucuuacggcuguuguaaggauuauaagaaugcuuagcauaugccgggcacaagacagguccucaauaauguguagcuauuguuaagcaguuccuaaaaauaacucagaagaccaaauguaaaaauauuuacauaauaagcuauuaagcaaaaaaggaaaauacaaaacaguauuuaucuuuacacagacuacagcuauguaaaauaaauauuuucaagcuaacagaaauagucuggaaagucacauggcaaaaagaacaguaauuuuguuaaggucacugguauuacauaaaauacaaauuuucccccaauuuuauuucauauugcaauguaguuuuuuucuaagugaauaaaacuuuugcuguuccuuaaaucaagacacuuuuccuuaucuagaaaugaguuagguguuacacagcagagcaauacauagggcagacaacuccacuuucuccaucaguaacucacucauguguggagcccaacacauuuucuauacgaucauuuuuuuauaucaagauguuugcugcuucaguaaucaggaaagccugaaguaucugacauuuuguucaagcuguuguuccuucucuucugagaaggcacuguugaaaucuagcuuuguaacaacuaggagagaaugcauuuugccaaccccucacagaacuuguguguuauuuccaaacuucccccuugaggccuguacaccuuguuugugcagggccaaaaaaguauccaggauuugccacaaaaaaaaucuacagcagggguggcucacuccuguaauuccagcacuuugggaggccaaggugguuggaucaccugaggucaggaguucaagaccagccuggccauggugaaaccccgucucuacuaaaaauacaaaaaauuagccgggcaugguggugcacaccuguaaucccagcuacucgggaggcugaggcagaagaaucacuugaacccgggaggcggaggcugcagugagccgagaucacacaacugcauuccagccugggcaacaagaauaaaacucugucucaaaaaaaaaaaucuacagcaggaauuuaagcaaaacauuuugcaaguauccuacucagcuguucaaugaaaaaucugggcaucugauuaguggcagguacugcuggagauuaaaaaaagacauggcccugcucacaaggaguguucaguauaacaaggaaaacuuaagacguuuaaacaaguaaugacaggccuaugcaagguacaguugcauacgggucagaggguuuagcucugguggaacagagaugagagugagaaagggaagcuuucacagaaaaugaagcaccugagcagggucuggaagaaggaaguuuuuuuuuguuuuuguuuuuuuuuuaacuuagacaaaguggaaggguauuuacuaggacaagauaauuuauggaaguagaggggcaugaaaaacacugcuggauuguaggagauuaggcacccagaggcagcagaugaugagguagacaggcagaggccagcucaugaaagguuuugaaugccuggcuugcacuuuauuuccuucacuggggggucaaagaaggguucaaaauagaaaaaugagacauucaguuguauauucuggaaagauccuucugacccauugauuaacugauugauugagaccgagucucccucuguugccaggcuggagugcaguggugcaaucucggcucacugcaaccucugccucccggguucaagugauucuccucccucagccuccagaguagcugggacuacaggcgcgcaccaccacacccagcuaauuuuuguauuuucagcagagaugggguuucaccauguuggccauggccaggauggucucgaucucuugaccuugugauccgcccaccucagccucccgaagugcugggauuacaggcuugagucaccgcgccuggccuggccuauauauuuaauaacugaagggaugagaccuccuaaagugcagggauuacaaacaugagccacuacaccuggccuaaucuauccuuuuaaccauuacauuaaaaaaaaaaaaaaaaaaaaccaaacugaacucccauccuaacuagaguucaggauuacaagaaacgccagauugccagccagaccaucaggcucucaagugacacauuuucuucuuucuucauuuuccucugacuccccaauccuauuaccagguaggaaguuccaagagauuggugggaacagcauuaucugcucacaaauauacacagaauuuguuuaacucagauuuuaaaaaggguucccacuccuuauuuguuucucuuucuuagaacaggcagugcuaccuaagauagacugagaaacaaauaaaaaccaggcucucugaggagcaucuccuaauauagugaggcaguauggugauuugucacacaagggcucaagacugguaagccucuaggugcuuaaaaggugcuuguuaauugacuagagguaacaagacagaguggcaagacuauuagcccucuagagauagagcucuggucccgucucuaccacugacugagugaugacuauuugaucuuggccagaucacuuaaccucuuagggccucacuucagucaccuauaaagugagggauggaggugaugucuacgguucuuuucagguuugacauuuccugagucuuucugauugaaaaggagccucuccuuugcauguuuaaagaaauuuaugaggucuuuuaggacaacuaagagucuuccugaguucgagagagcaauuacucuccccucugcauguaacaacaggguauuuuuuuuucuaaucaggacagagucucacucugucaucuggagugcaguggugcaaucuuggcuagcugcaaccuccaccucccggguucaagcgauucucgugccucaggcucccaaguagcugggacuacaggugugugccaccacgcgcagcuaauuuuuguauuuuuaguagagacgggguuuugccacguuggccaggcuggucuggaacucccggccucaagugaucugcccgccuuggccucccaaaguacuaggauaacaggcaugagccacagugccuggccaucagcaggguauuuuuaauagggaaaagacuaccuucuaaguaaauucuaacacauauacaacucucuccaguccaucucuguuauacaagagcaaaaauaaagaaauaauucuagcaaccugguuucaaacauuguauuaacugcuccugccagaaaacaauauggcagccuguaucccaaauaugaaacauccuuauacuuauuaaaacacauuaauuuucaucuggaaaucuauucuaagaaaacaaauacagaaaaaguuucaugcacaaauauguccauagcagcauaaucugugauaaugauucacaugaaacagccuaaauguccaaugacaugguugucacuaaauuauuuaauacuguaauaauaaaaaaaugaugaugauaauggcagcugacauauauugaacacacuaugucccugccacggugcuaggaauauuauauccuuacuucauuuaauuaauguaacaauuauaugaggugagcugacaauucccauuuagacacaagaaauggagaugagguuaaaacaacuuuuuuaagaucacaaagcuagcaauuaauuggcaaauugcaaaaugaucccaacuucgcuuaagcacaggaauucaagguuacagugagcuaugauuccaccaccacauugcagccugggcaacacgagugagaccucaaaauaaagcaaaaaaauggaaaggaaaaugauucuaacuacaauucuaagaaaauaagaaugauuugauagagagcaacuagaggugggcuuaguuaaggauauacuuuccagaagagauaucuaugcugugaucugaagauaagaggcaagucacagcaaugcaucaaaggugggggugggggauuccugacaaaggagcagcuaugugauaauaagugaaaagagaucauggcugggcacaguggcucaugccuguaaucccaacacuuugggaggccaaggagggaggacugcuugaggccaggaguucgagaccagccugggcaauguguugagaacccauuucuaaaaaaacaaaaacgaaaacgaaccaaacuggccaggcgugguggcucacuccuguaaucccagcacuuugggaggcugaggugggcggaucaccugaggucaggaguucuagaacagucuggucaacauggugaaaccaugucucuacuaaaaauacaaaauauuagugggacgugguggcggcugccuguaaucccagcuacucgggaggcugaggcaggagaaucacuugaguccgggagguggagguugcagugagcugagauugugccauugcgcuccagccugggcaacaagagugaaacuccgucucaaaaaaaaaaaauuuagcugggcauaguggcauguaccuauagucccagcuacuugggaggcugaggugagagaauugcuugagcccagaaggucauggcagcagugagccaugauugcaccacugcacuccagccucggcagagcgagacucucucuugaaaaaagaaaaaaagcaucaucuaaagaaugaauauuauaauguuuacauacaaaacauuguaguacagaaaagacuugaaggaaguacacugugaaauaguaagagugacugaauuuggaugaugaaacuacagugacuuaucuauuuuuauaauucuuuuacauuuucugcacuuuaauauacaaaguaucacuuuuauuacuaaaucuauuuuaauuguaauuaauuguuaauaauguuauucccaauaaaguugauuuguuaaacauauauuugaaugcaaauuuuauaucugcauaaaacauuuaagguaaauaagcagacaaauuaggaaaagucuauacugauuuuuuguuuagaaaagagaauacaauauauacaguacacaaacaaggagacugucucagugcugggugcacuucuaauuaaaaaaauuccccgaaaaugaagcauuggcagaaaaauuugaauguuuguggacggauuaaacgcuuuuuagcuuuuuuuuaaugcuuugagacagggucucucucugucgucuaggcuggagugcaguggcacgaucuuggcucaccacaacccccaccacccugguucaagccagucuugugccucagccucuugaguagcugggauuacaggcgcaugccaccaugccugguuaauuuuuguauuuuuaguagagacgggguuuugccauguuggccaggcuggucuagaacuccugaccuuaagugauccgccugccuuggccucucaaaguguuuggauuacaggcgugagccaacacgcccagcaaacacuuuuuaguuuacuaucaccaacagaguacugaacaauuuucaucaccccaaaaauuuccuaauuuuucuccuuugugucaaaccucuucaucccuaacauuugcugauuauugaucucuucuuugcccuaugauuuuuuuugagaauauaaggaauccuauacauauauauaaaaccuuuugaggcuagcuucuuuuauuuaagcugugagaauuugugcuguauagcacuauugucuuuagaaggcccaggaacaguccagauaaagagcccaaaguaagccauacuauugacaguaaguagacuuuacuagcacaagaguauuauuguuagguuagucuauccucacaguggagacgagggcaucaaucaaauuugguacucuguuggugguagugaaucuaugcaaacauuaaaauucuuauaacuguacaccaaaaauguuuauuucacuguauguaaauuuacaugucuugaaaaguauaaaaguuaucauagcuugaugacauuaaucuauuuucauguguacaagaagucuucuagugauucugacgccagugagcucccaacuccauucugggaaauauugugcacagcuauuaaaguugaucuaaguuuccauguucugauucuucauucuccaaguauuuauaugauggaaaagggaugggaaguucaauuuuggaaaaccugaauucuuagguaccuaugagacauucaaaugggggauacuguacagcuaguuguacacaaggaccugaugcuuaagaucuggggugggaaaauugucuucggcagagggaugauggaguuguggaaguagacgagaucugucuuggggaauguacacagcgagaaaagcaaaggcccuuggcgaauaaugauguuuaaagacuccacagacagaguagcucauaaugguauguagagaaggagaagaaacuaccagauggauaggacaguuuguugucacagaacucagggaagagagaagaccaggucuaugguacagagcgauuauguuaaaaaacaaaaacacauacaaaaaacaaaaaaaaaaaccagacuauuaggaaugaagaaugaaugguaugugaggaacugaagacagugagugcagaaaaaucuccaggguauuccucuaaguauuaagaguauaauucuagaaugaaacucugggauuugaacugagguuccaucacguauuagcuguguaaccuggguuuaagcuguugugccucuuuuagcucaguuuccucaucuguacaaucgcaucaguaggauuuauuucaugagguuguaaggucaaagucuuuaagauccgugaggaggucaauagcaaagcuuaaaugaauuaaugauguaaagcucugagaacaacaacuggcagaaaguaagcacuauguguuagauaaugaugauaacaauauuaucaccaccaccaucaucauccuuuuuaagaaguuuugggccaggcaugguggcucaugccuguaaucccacuuugggaggccaaggcggguggaucaccugaggucaggaguucgagaccagccugaccaacacagagaaacccugucucuaccaaaaauacaaaauuagccaggcaugguggcacacgccuguagucccagcuacucaggaggcugaggcaagagaauugcuugaacccaggaggcagaaguugcagugagccaagaucacgccacugcauucaagucugggcgacagagugagacucugucucaaaaaaaagaaaaguagaaaagaagagguugaaagaagugacgaaggauugaaacccucacauuuaaaggacuaccuuuaggccgggcacgguggcucacacccguaaucccagcacuuugggaggccgaggcagguggaucacaaggucaggaguucgagauaagccugcccaacauggugaaacccugucucuacuaaaaaauacaaaaauuagcugggcaugguggcacgugccuguaaucccagcuacucaggaggcugaggcaggagaauugcuugaacugggacccaggaggcagagguugcagugagcugagauagcaccacugcacuccagccugggcuacagaggaagacucugacucaaaaaaaaaaaaaaaaaaaaaggacuaccuuuagacaaaagcaaggauauuccuuucuuuuuuuuuuuggagauggagucuugcuccguggccaggcuggagugcaguggcgugaucucagcucaccgcaacuucugacucccagguucaaguaaucuccugccuuagccuccugaguagcugggauuacaggcacaccaccaucacauccagcuaauuuuuguauuuucaguagagacgagguuucaccacauuggccaggacggucucggucuccugaccuugugauccacccgccucggccucccaaagugcagggauuucaggugugagccaccacaccuggccaaaagcaaggauauuucauccaaaguaacagcaaaggaaacaaugagggauggaaauacaguacaacuucuagguaaggacaacacagaaaguugaguaucugacaguuacucuucuuacuauaaagcagaagguaaggucaaagucguuaagauccccaaggaagccaagaggaaaggaagacagaagcugugcaggcccaaaauaauacauuuccuggcacuuguuauguccaggaauucugcuaagugcucuaaugaaucaggcucauuuaauccccacaaugguaugugguagaugcuacuguuuuuuuuuuuuuuuaucauuacccccucaccauucacacaagaaaaagaggcuuaaagaaggugcuugaagucacaaaacuagaaaauggugaaacugggauuagaacccaagucaauuacuugaaaguuugagcuacacucuacugccauauggucuauugccucuuuaauaucauuaccuucucucauucuuagagaaacuuagaaaacucucuuuccauagugucaaaaagaaaaacacagugagagaugaggauacagaaucacaaacugauucacugcucucuuuaaaccaagaugguuaaaaaaagauuuugaaugucuuuaaaaggaaaugcacucuuuauuuuuuacauagucccccuacagagacuucacacuucacauuaagugccuggucccugacagcauuuauaagaucugcaaugcaaacuuuaauuuaggaagucaaugaagacaggagaaaaagaaaauaaguuccaaguuacuauuuuccuuucaguugguauuaagugcaaagcuaccacaaucucagaaguuugaaaaaauucguuucuaagugcagauagaugaaauggaaauauaucauaaacaucaaacauaccuugauaucauugucuauuccaccagaaauaaucugaucacuugugucauugaaggucacagcuaacaccugguacguguucugaaaugucuggauggcugcuuucuuccggaugucccaaagcugaagcaaaggacaagacagucuaucagcaacaucauucuaagaagcaauugcacaguacaaauaucccuuaaguacgaggacuuuguggacaugaacacaucuauaauugggauccuauaucacuaacuccuggauauccuaauaacacacaugguaagcagugugcucaauuuugccaagacauuugaaggcuggugaaacaaaacuucgguuauauuuucagacuucuuuguugaagugaacagaguuaaaucaacauacucuuagaauggaauuccccuaacuacuuaguucauauauuuuuuagaacaacaaggauaucagacaauuuuuucaaaccguagagacuaauucauuaguaggcugcaacccacauuuaaaaaaauagaggguaugucagugaaaauaguauaauaaacaaugacaaaagcuugucccuccacgaaagcagcaaauuaaccagcaaaaucugucagaaucaacuguuggaacucucaaaacuaaucaaaaguuuauaguaacccggcaaacccuuaaugaggaaaaaggaaacaaaaaacucccugagucccaguaaaagggcuuuguaguguuuuaacuugugcuggcucugucuccugcucagcaacagcuuugaagauaacccauauucccaguaugguuuccuaguacugaggaagcaaagggggccuauuucuuauugucaaagaauaaacaauaaaaauuguuuauuuuuaccugucugguggcucucugaaggaugagcccaaaggacuuacauuuauuuugccuaacuuggaacuucccuugaaaacauuuaaaggaaaggacauuauuagccucugguuccugggggcaaggaaaaacaguuggggcaaaaauacaaaccaaaaaccuugggaggaagggcuggggaaggagacaauuuggggaauaagagcuucgaaaagcaccgacauauuccuggcuaucuaucuaucuauguaucuaucuaucuaucuaucuaucuaucuaucuaucuaucuaaucuggggacacacucucccucugucgccuaggcuaucuaucuaucuaucuaucuaucuaucuaucuaucuaucuaucuaucuaucuaucuuucuaucaucuauaucuaucuaucuauguaucuaugugucuaucuaucuaucuaaucucuaucuaucuaucuaucuagggacagacucucccucugucacccaggccggagugcgguggugcgaucuuggcucacugcaaccuccaccucacgggcucaagcaauucucaugucucagccucccgaguaggugggauuacaggcgugugccacuaugcccagcuaauuuuuguauuuuuaguagagacaggguuucgccacguugaccaggcuggucucaaacuccuggccucaagugaucugucugccucacccucccaaagugcuaagauuacaggcaugagccaccacgccuggcccauuccuggcaaucuagaccacuugcauguccagggcugggcacauacuuagaaaagaucugagaaggccguaagcucucugguucaccuucaggcucugcacaagcaggaagugaaagcuaaggagagauguaaacugcauggcaaggaguugaaggcaggcuccaacauacaaaaagacaaucugcaaagacugggagaauuuuuguucuuguuguuguagguaauuuaggaaacuugugucauucacuagcugaccacuaagcuaacgaaaaaaagaauucaguggucacacaggacaaagaauacaaacuuuacaaaauuaguucaaaaauucacuaaacaggccgggcaugguggcuuacaccuguaaucccagcauuuugggaggccgagguggauggaucacuugaggucaggaguucaagaccagcguggcuaacaugguaaaaccuuguuucuacuaaaaauacaaaaauuagcuggucaugguggugugccccuguaaccccagcuacucaggaagcugaggugcaagaaucacuugaacccggggaguggagguugcagugagccaagaucgcacuacugcacuccagccugggcuacagagcgagacuucgucucaaaaaccaaccaaccaaccacucucaccuuaccccaacccacagaaagucacuaaacaaacaacuacaauaagcagcucuggggaccuaauuuccagagucaccacgcuauaauauuuaaaugccuaguuuucaacaaaauauaaggcaugcaaagaagcaaguaacuaugguccauauagaaggaaaaaguagucuucucaacaaauugugcuaagacaacuggcuaaccacaugccaaagaaugaagguaagccccugccuaacaugauacacaaaaauuaauucaacauggaucaaggaccuaaauguaagagcuaaaacuauaaaauucuuagagggccagguaugguggcucaugccuguaaccccagcacuuucggaggccgaggccaggaggauggcuuuagcccagaguuagcgaccagccugagcaacauggugauuccucaucucuacaaaauaaaaacaaaaaguuggguguggugguauaugccuauagucccagcuacuugggaggcugagaugggaggaucgcuugggccagagagguugaggcugcagugagccgugauugcggaucuguacuccagccugggugagaguggcggcaucucggcucacugcaaccucugcuuccguguuccagcaauucuccugcuuuagccuccuggauagcugggauuacaggcaugcgccaccacgcccagcuaauuuuucuauuuuuagaagagacggggguuucaccauguuggccaggcuggucucgaacuccugaccucaggugauccacccaccuuggccucccaaaguggugggauuacaggcgugagccacugcacccggccaagaccccaucucuuaaacaaacaaacccuuauagcucuacuuuuuuaaagcguggauaacacagagagggcucagagauguuucaauaaaugaaugacacacuugagaagaugaaccacaaguaaaugauuuaaaaguaugggucguuucauucagaagaaagagacuuugggaugacuguuccaaguuuuaaagggcuggcaucaaaaagaaaggaaucagccauggaacuuuagggaaggucauaggcuuaacuucaauccuguagucaacaaggagagucugaguaggaucugugccaagaugccucuuccucccaauucucaugguuuaggaugaaaaguaguuucuucuuuguucauguaaauacgaacuaaaaauuaguucauuacucagauaaauggucuaaaaagaacgcuucacuccucuccuacaugcccaacaucuccuacucccccaacuccugugguuacagaaucaaguccaaacuucuuaaccuggaauucaaggccuuaauaauuuagauccuauauauuuuauaaacuguacuauaaucuuugucucaauagauacuucacucaggucaaaucuaucuuugucuuucuccuaaaagucaugguagucaaaguuuguuuaaaauaauuuagaauuuuaguuccagauaacuaccacuuuuaauaauuauuuuacuuugaagcaaucauaaauuuauagaaaacuuggaaguaaaaagaacacuuuuuuuggucuaaaucauuugagaguaaguugcuuacccaaugccuuaucaccuuuuuuuuuuuuuugagaugggagucucacucugucuguugcucauucuggagugcaguggcgugaucuccgcucacugcaaccuccaccucccggguucaagcaauucuuccucagccuccugaguagcugguauuacaggcaucugccaccaugcccggcuuuuuuguauuuuuaguagagacaggguuucuucaaguuggccaggcugguuucaaacucccgaccucaagugauccaccugccuaggccucccaaagugcuaggauuacaggcauaagccacugcaccuggccccuuaucacuccuaaauagugucuguccuacaaagauguucuccuacaucaucucaacauaaccaucaaaaucaagaaauacagauacacuaucaccauuuuauccucaaaucccacucaaguuuuaccaguuaucccaaaugucuuauugcacaaggauucagucuggaaucauauguuaaauuuagacuccagucugcaagacucucucaaacuuuccuugaguuuuaugaacucaacacuucugaaaguuacaggucaucauccccaauuuagguuugucuuauguuuccucuugauuagauuuaaguuauacaucuuugguaggaauaucacagaaaugaugcugcaucuuuguuguauccuagcaaaugguucaugauuuugucuugucccauuacuaauuaggucgauuugauaauuuaguuaggauguucuuuugacaaaauaagccuugacaaguacaaggcuuaucuuguacuuucacugccccugggcugaaauaggagcccugguuccuuuuaauggaaaacaguaccugugcaguaaggggugcuauugcuauuggggucuuguugcuccuaaaccuuuucaguggacagucaggcaauauauguacauuuagguacacacacacacacacucacacauuuaugucuauuuuuuucuauauguuucuauauugaauauugugaguucacacuuauaccucacacaagauucauuuuagucuucucuuuuguacugguaacucuguucuuggacagagaaaucagccucccauuaaauucaauauauucacuuauuugauuaugcuuccugcaugcaaccaguuucccauauucucuuccacccuucccuacuugaauugugauucccauucuugguugaagccaugugugacucuuccuuaaccaacuugggucauuccucugugugaacacccucaucacucugcuacggcucuuuuccagucugcacuucuccaagcaugcagucaucaucuugcucagucucagacucccuacaccaaaucauuucuacccuguguggaugcccucaguucaggcuuugacauccacauucuccccguacugcuucacguacaggcgacccuuucaccccauuagggcacuguugggcugcugccccucccucacccucaaauuccccacacugguuaccuacccuguguuguauggaugccuuccucacucucugacuacucccuacaauguacugcccugcccaguguggaugcucuccuuaccacacuugugcucugacacucuacucugggccaccuuggcccaucucuaacuagagcaccuucccugcuuuggccuauauaacuggcuuuaggacugaacugcucaugaaagggaaauuuauauauauaugaguacauacacacauacacgcaguauuucacuuaauuuuauuagaagaaugcacuugauaaaaaguuugaaaacgaucuguaugaauaaugcccagaaugcuuuuagacuaaaaaugcaagugcuguuggaaaccuuugcuuucuguuaagaacucugacauguaaaaagcaacaugacuuuuuuuccucuuaaacugaaguuauucaauuccuguacuugcaaccuaguaacaaaaauacaagaacacaaagcauuccaacuucacaaguaacugaaaaguacauugcaaaaagcuguuuaaugaugccuuaaauauaaauauacugacauuaaaaauaggagcugguuaaaaagcagucaucuuuaggugaugugacauacugcuuauuaaaaaaaguauuaacuugaguaauaagguaaaaauaacuauuccaaaucauguuuaauuaaggcagaagagaagcaaaaaaccaaaagaaggcagacagaaaggacauauacucuuuuucuacuaccuaaauaguuccuagauauuuauuacagcaggcccucaauaauaauguuaacaaaauucacuggggcauuuccaccucuuacuaucuucugaaaugacaauuaguaaaucagcuacuguuaagacucuccaacuacagugacaucuaggucagagcucugguuuagaaaccaaucuuaaacaacagacucuccucccauccaaccaucaaggggccccaagugauuagguauaagaaaaccacucaguagaaaaacgucucagccaagugugguggcucacgccuguaaucccagcacuuugggaggccgaggggggcggaucacaaggucaggaguuugagaccagccuggccaauaugaugaaccccugccucuacugaaaauacaaaaacuagcugggcgugguaugggucccuguagucccagcuacuagggaggcugaggcaggggaacugcuugaacccaggagguagagguugcagugagcugagauugcgccacugcacuccagccugggcaacauggugaaaccccaucucuaccaaaaauagaaaaauuaggcagguaugguggugugcaccuguaaucccagcuacucaagaggcugaggcuggggaaucacuugaacccgggagguggaggcuacagugagccaagauugugccacugcacuccagccugggcgauagagcaagacccugucucaaagaaaaaaaaaaaaaagcaaauucauuaauucauuuaaaaagcaauaagaaguauggggguguaguuucccagauguacucuuuugaagucccucacuguuuaacaauuaaaauauaaaccagagcccaaaauucgugucaaagagagaaucaaaugguugguacuaugauguacuguguccuugugugccucugagauaaauuauuauuucuaggccucaguuuccuuauuuauaaaaugaggaugcucagugagaucaguggcucccagaaugugagacuggcuacacugaaucacuugaaggacacauuaaaauaucugauucccauugcagauccacugaaccagauucuuuggguauuuuuaacagguucuucaggugaugaugauauaaagauaggcuggcaaccaucugacuaaacgauguuuaaguucccaucuugugccauacuaaaacuauucacugaacuuuuuauauauugucuauaaucucagaacagccuuuuuuuuuuuuuugcuaccucccuguugguggagauacucauaacagccuugaaagacacguauauuacugucacaguucuuuuuuuugagacagagucucgcucugucgcccaggcuggagugcaguggugcaaucucugcaagcuccaccucccgggugcacaccauucuccugccucagccucccaagcaacuggaacuacaggugcccgccaucacgcccggcuuauuuuuuguauuuuuaguagagacgggguuucaccguguuagccaggauggucuugaucucuugaccucgugauccacccgccucggccucccaaagugcugggauuacaggcguaagccacagcacccggccuauuucaaguaacaauuuauucuaugguucuauuauuauucuguaggguaauuaaaacuuguauuaaauguuuuauuuuaaauggggaaaaauuucaaguguguuaugggagaugacugcuaaaauuaaguuuugcacaggaagcuagaguacaaguggcaaggcaagauaagguucacaucacaucaccucagaaacuggaacacggagagacaauacccaccuuaacugugccaucgucacugccagugcagacaagcugagggccucuccuggcuggauaacaggaauucacaaaggaaguaugucccuuuagccuuuuaacccucucaccuguuucacuaucccacacagccacgguuuuaucuguggaugcugagaaaagcauacuagaaaguaagagaaagaauaaaaaagaaauaagugaagauaaacaguaacaaucuaucuuuccuacuugacaaaaggugccaaauuuuucaagaucacugaccugcugugcuacgccaguuugcccaugaugcuggaaugccucacccuaccaaaauccuauuuguccucuaggcccagauggcccagauaaaagaucuaccccugugaaguuuaaaaaauuccccuucuuugaguccccaugacauacaucuaauguagcaguuugcucuaucuuuuccucuuuugugauagcuaacauuuuaaacauaagacacccucucacuuggaaauguuuaauaacucccuggugcugcagagaucagacagacugugguaccgaccugacagcugagugacuccaaucuuuucucuuuaccaaaguuuuucuuuugucucugaggacaauuucuuucuuucauuuuuuuuuugagaugagaucuugcucugucacccggguuggaaucauggcucacugcagccucgaccuccugggcucaagugauccucccaccucagccuccugaguagcugggaccacaggucugugccaccaugcucaguuaauuuuuaaaaaucauuuguagaggcaaggucucacuauguugcccaggcuggucuugaacugggcucaagcaaucuuccugccucagccuccuacagugcuaggguuauaggcguaagcaaccacgcccagccucugaggaugauuucuaaguuauaacugaucuuauaaugcuuucuuuuuucauuuuuuuugagauggagucucacuguguugcccaggcugguuuugaacucuugggcuccaggaauccuccugccucagccucccaaauagcugggauuauaagcacaugccaccaggcccagcuuucuaaugcuuuauuuaaaauguauacaaugcuauguaucaauugauggagcacccuaagauuuuagaggucagaaauguaaaacaaugaauguuuaccagacuaccuaacaauguaauuacuuuuguauagccagauuucuauauuaucuauaauauauucuaaaauaauauagucauuaaaaugacguuuaugacaucagauguuggcugagcaauguuaagagaaaaaaggagcaaauaagauuguacacacaguucuggccaggugcgguggcucacacuuguaaucccagcauuuugggaggccaaggcgggcggaucacaaggucaggagaucgagaccauccuggcuaacacggugaaaccccaucucuauuaaaaauacaaaaaaauuagccgggcaugguggcgggcaccuguaaucccagcuacucaggaggcugaggcaggagaauggugugaaccccggagacggagcuugcagugagccgagaucgcaccacugcacuccagacugggcgacagagcaagacuccgucucaaaaaaauaaaauaaaauaaauaaauaaauaaaaaagauuguacacauaguucuaacaaauaugcaacaacuaaacaguucugaguagaaaaaaaggcauuagaaaaauguauaaaauuaacagugauuggccaggcacgguggcucaugccuguaaucccagcacuuugggaggcugaggugggcggaucaccugcgguugggaguucaagaccagccugaccaacauggagaaacccagucucuacaaaaaauacaaaauuagccaggcacggugaugcaucccuguaaucccagcuauucuggaggcugaggcaagagaaacacgugaaccugggaggcggagguugcagugagccgagaucgugccauugcacuccagccugggcaacaagagugaaauuccgucucaaaaaaaaaaaauuaacacugauuaucuuuggagugguagaaauauagacuauuuuuucaucuuucugcuuuuuuugguuucucaaaagaaaugauuuuuauaauagaaauagcugauuucaggccaggcauggugguuaauuauuguaaucacagcauuuuugggaggcugaggcagguggacugcuugagcucaggagcaauauagcaagaccaugucuccacaaaugauuuuuaaaaauuagcugggcauggaggcgugggcuuguggccccagcuauuugggaggcugaagugggaggaucccucgagcaagagguugaggcugcagugagccauguuugugucacugcacuccagccuacauauaaaaaucacauuuauuuuaugucuuaaaaaaagaaaaauuugucuggguuguugaaaugaccgauguaacaucuuuauauuugcauacacagacuauaaacaccucacuuggggugacagugauaaaucggauacuaaaguagcuacccaaaauuaguaguuuuugauagcagggucuccugagaaaggaugaaaggugaaaggacgccaagaauuaguaugagaagcuguccuuccauuaugcagaauacucaccugccaucuguguuguaaugcaauuccaucacugcuccacugugucccuucaguguggcauaguuaucacagucaccauagacauuccacaguacuguuagggagauggguucugugagcauuacuaggcaaaggguacuuauaaauuuaucagaacaacaguucucaggucaggcacgguggcucacaccuguaaucccagcacuuugggaggccgagacggguggaucacuugaggucaggaguucgagaccagcguggcugauacggcgaaaccccaucuuuaauaaaaauaaaaaaaucagccagguguaguggcagacgccuacaaucccagcucuugggagacugaggcaggagaaucacuugaacccaggagacggaggaugcagugagccgagaucgcgccacggcacuccaaccugggugacagagugagacuccgucucuaaaaagccaaccgaccaaccaaacaaaaaaaacuauguaguuugucugaugaaauuaagccuaucaauaauucauauauguucugcaaagaucccuaagcaauccagacguuuggccacuaguaagcuuaaggaucauagagccggaacauccaaaucaaaaugggcagugaagacggguaucauccacccggcaccgaggaaaagaguuaacagaaaagagccaaauaacucauuucaucucauaaucuggcaagaaaguagcaacagaagcaucugauuuuuuuuccuucuggcuucauuugcuggaguauaaauaaaacgacuuuuucuacuuacuucucaaaaauggguaugagaaauucuuauuucucaaaaauggaaaucugguaguagauccuaaugauguacagguagauuauuuaagggaguuaccacuuuaggauuccuuccuucccauaugcuagcuaggauucugggugugaauuaagaggaccuuauaccuuugggaaaauaaaaguuauuucucuccucauuacugccauuaaccuguuaugucuagauugcuaagugccuugguaaauuagcuggagauuugccucuaugaggaagacauucucaaaccagaacaacucacuuuccaacuaguaaaauaauggcuucuguauuuaccccauggacuccaaguucuacacccaagaucauucagcauguucaugccccaauuuuagcauauuagccaugcagccuguuauguugccaacauagagugauaccuucuguggcacccaagauuuaaaaaaaaaaaucacuaucuggcaggaaaaauuauuccagauucaaaaacuaugccucacauaucagucggucaaauccugcagaugcuaagguggauccguugggguggaacuugcagcaguagacuuccccuucauguccagagagcagcaugauuggggcuugaagggaggaacaucuuggaggucccuaaacaaaagagaagcacaagguaacuacugcauacagacaaaggaggcuacaaaauuaggggguggggaguggagggaaaagaccaagaaaacaaugauuaaguggguuucaucugacuuacagaaugguagcucuucucauaugaaugccuccaacuugacacucucugaaacuuuccauuaucuaccuguuauaaugacucucuuguucacucucucagcucuuguuguacgaccaacuuuuuuuuggagauagggucucacucugucaccuaggcuggacugcaguagugugaucaugguucacugcagcuucaaacuccuuggcucaagugauccuccugccucagccuccugaguagccaggacuacaggcaugaacuagcaugccaugcuaauuuuuuuaguuuuuguggagaugaggucuugcuacguugccuaggcuggucucaaaauccuggccucccuccuuggccucccaaagcacuaagauuauaggaaugagccaccacauuuggccuggcucauuuaacaaaugauggaacugacuuucccaacaacucugcuugguauggaguacugggugaaauaguuuuguuuuauuuuuaauuuuuuuuguguguuuugagacagaguuuugcucugucacccaggcuggagugcaguggugugaucucggcucacugcaaccuaugcuuucuggguucaagggaucuggugccucagccucccgagcagccaagauuacaggcaugcacaaccacgcccggcuaauuuuuguauuuuuaguagagaugggguuucaccauguuggccaggcuggucucaaacuccuggccucaugugaucugccugccuuggccucccagagugcugggauuauaggcaugagccacugcaccuggccuauuuuuauuucuuauuuuuucauagcaaacggauccucagcaugggugaaguaguuuugauuauggucuuggacaccaagaugacacuugggcaauucaucuaaacaugggcugauaugcucacuugucaaaugggagaaguauacuacccauaauccccaaaucucuucaguacuucccagcauuuucauauuuauuuauuuauuuauuuauuuuuuggggaaggagucuugcucuguugcccaggcuggaguacaauggcgugaucucgucucaucgcaaacuccgccuccuggguucaagcgauucuccugcaucagccucccgaguggcugggauuacaggcacccaccaccaagcccggccagauucauuuaguuuuaaaaaauguuaugugcaggcugggcgcgguggcucacaccuguaaucccagcacuuugggaggcugaggugggcggaucacuugaggucaaaaguuugagaccagccugaccaacauggugaaacuccgucucuacuaaaaauauacaaaaauuagccaggcaugguggcgggcgccuguaauuccagccacucaggaggcugaggcaggagaaucgcuugaacccggguggcggagguugcggugcaccgagauugcgccacuccacuccagccugggugacaagagcaaaauuccaucuuaaaaaaaaaaaaaagaaguuacgugcuaggcacugggcaaacagcaaugaacaaaauaaacaauggagcucgcuguuccagugggaaagggggaagggagaagggaaggugagagaaaacaagcaaacuauauauguggugucaugugcuauagagcaaaagaagggauggggaugguggcucaugccuguaaucucagcauuuugggaggccaaggugugcggauugcuugagcucaggagugaaauccugucucuacaaaaaaauacaauuaguuagaugugguggugugugucuguggucccagcuacucaggaggcugaggcaggaggaucacuugagcccaggugguggaggcuguacugagccaguggucaacacagagagauugucuaaaaacaaaaaaacaaaaaaagagagagagagaagcaauguggguuccacaguaugugguacugcaauuuaaaauaggguggucaggaaaauccucacugaaaaaauuacauuugggcaaauauucgcaggagcugaauaguaaaccauguaaacauuugugaagagcaaucccacagagaggacagcaaaugcaaagguccugaagcagaggcuuggaagagagaguaacugaagccaggugagcaauaagaaauuggucagagagguaaagggaaagagggcaaauaauuacaagaauuuugguuuuuacucuggaugaaguacaaagccaccagaaaguuuucugcagaguguaaugugaucugauguuuagaaggauuccuuugguuauuggcuugguaacaggugcugauacaaagguagaaaguggaagaccaguuagggucccacuacaaaaaugccagaugagauaauaauggcuuaggccaugaggcaaugauggagaugguagaaguagcaauucuagaccuauuuugaggacggugccagcaggauuuauugaggagaugugaggacacucguauuuccucgucugagccuaaacaggacauuagaagugugaucacuauuucuaucuuacaaaaaauguaguuaggagcaugguuucucaguucgaaaucugcuucuaucacguacuugguaagucuguuuuuccaucugcaaaauggguuaauaacguuccuaacaggcugcuaccaagaucaauggaaauuucauauacgaaacacuuuaguacaagagucaaugaauguuagcugcuauuuaguuguuaauaauacuagugcagagaaauaaagggaaaagcaacuugcccaaagucccaaaacgagccaacacaaaucauuucccuuuuuucuucccucccucauucauucauucuacacacucuucggaauuuuuguucuaugccagauccauguuagagucaggaugcuuaaacccgggucaggguuuugagcccaagguccucaacucuaauucuaaugcuaucucagggcagucgagaggcugaaaacgggcgccaaacgggggaacacguacgcagcauucgcaggcuauggggagcuuuuacaguguuuaugugcuuuaacucugcguagaaacucucguucugcccccgcaaugcgggaaagggucagggaucaccagauacagcgcucugaggggaggaagaugagcugagggccaaaggccgccugcuucuucacuuaccgcuugcagcaaggcucccggcgucgccugcugcugcccggcuccugggccagaccccgcucccaacagcaacucaugccgcugccgcuugacuggaaccagcggcaacucugggcccuuacgcuucugcuguucuaucauggcggcaaccggucucuucagcgccgccacugaccgcgcugccgcu

SEQ ID NO: 191417 - RNA, 134212 nt, Homo sapiens
cagauuccaaaguucuguauuuuucaaaauaaagaucacacauuguuuagagacaaucuacacaagaguuacaaaaaauaguugcccaggcauaagcauacacagguuuguuaauuauacacauaugguuacaagugugcuugcaaaaaaguucauuggaaauauacacaaggcucuggaaauguacaccguguaguguuacaauucuauauucaaacaaggaaaauugacaguauguuacauucacuuacaaguagacaaaaugcaaaauacaguucaucuucuguacaaaagggaagggcgauucacacuuuacaaggugagaggggcucugauuguaaggaaagcucgggcaaggcuagacuuuugcacguccuuuugacugucacaaaaucaaaacauuacuuuuuuaggauuaaaaaaacacuagugagaacucaaucuugaauaacauuuagaaagaaucucgcuauacuugagacuagaugacaaauaaaaccaagcuauuuuuuucuuuuuaaacauuaacuaggcuguauaaagaacauuuauuccuucaaaagaaaaaaauuuacuucugguugaaauuacaauuuacaauauacaacacuauaugcuacgaccauaaaaggugagaauauacacugaaugcacagggcuggcuaauucucuuuucuuaccaaaaaacguguuuauguugauucaaacuucuccacauuuacauuacagguauacaaauguacaauuguacaaucaaaaguauguucgacuacuaggguacauuauagauacagauuagacaucaaaacaagaaaauacuacaaauuuguauauaugcaaagucuacaccaaguauacacuauauauuuauagaagcaagaccaaaagcagaguuggauuuuuuuuucucaugcuaaauaaucagauuuuaccuuucaauguuaauagaaaaaaauccaguaggcaguaaacaaucacacccgcccagccucaaaagacguucugggugcucgcaucuccuccucacgaacagccuucuucagcauaauauagucuccaaaaaaggcauuuuuuagaauuucauaaacuuaaugucacaaacugaagcuuuagcaacucugaaaccuuuuucauuauauauauauauauauauauauauauuuuuuauaaacaguguuaaaugccaguuuggggucauuuaacuacaauucaaacuucucagguuuuuuuguuuuuguuuguuuuuuacuaaaaugaggagguggggaagagcuauuugcaaaacuugccggccaggcaaaugagcuaaaaaccuuuuccuuuuuuucuuuuuuuuuuaaagcuuuuuuuuuuuguuaaaccaaccacccugaaaguuuccacaugugaaauauagauacaacagugaacaaaauauguggccucccauguacauugguuaccuauguacaaguauccuauacaccaguaaaacagcagggcaauuagucaauuaaaaaaaauaguacauguuauguguaauaaaauuaaauuuacaaaggcuuuuccacucguggauuugauuccuuuuuuggaggagggaguaauccuggagcaaccacuugcccgucucagacucuacacuagaacauuucugguugcugguuggauuugccagugggccagugaggucagcgggaaugagggaacagcgggugacacugccucagaugauaccauuaggggggccacagaugggcccuaagucaacaccguucuucauguaguacuucuccagcuuggccagaaugugcuugccauagguguacuuacgaagaguugcgauguggggccggaucuggggaggaaagacagucuguguuacauggccugagaugagacuugggggcaggcuucccggacaugcauuugcaugucaugcaucacacacacauacacacacacacacacacacacacacacacacacacacacacacaccccuacagcaauaccuuucacuggcucagcccaguccccugacuucuagcacuuuggcaacccaucagaugaggagaggagcuccuacccugaguggugccacagggccugaggacccuggaggcuggguggccaugggccacucccaggacaacacauggagaaagugcauccuagcugggaaaauacacugcccacuacccgccagcugcacagugcuucccugcaagcaugagcacaggccccucuggccccaugcacggcauccaggcucuccugagcaguggggguuauuucgggucaccagaauccugagcucaccacuugacccugucucuccaggucacaguggaucacagaaagcuaaucaaugacaagaagagaaaugaugaacaucaugagcuggugugauuauccccaucuuacugacagaaaacaugaaggcacagaguaguuaagucacucagccaagguugaauggcuaacaaaggacagcacagauagcugagcccaaacuguguggcuccuccacgaaucagguuucuccccacugugcucucaaggcacgcccgccacaccagccucaucccucaggcucuccgaccuaugcucugagucacuucuccaagcauuccuuucuguucuuccuucccugggcugaucauuucaagaaguccuacauuccagaaaacuugagaggugcuucuucucuggaagccccuuuucuuuucugugagcucagggagcauucuacauaccucagcugugucugcuaucuuuugcuuaauuaucaaucuuuccauauaaacaguaaaggaccacaguuuauucaucagauuccccauccaaaccugcaccugcauacauaaacgcacuggauaaauguaccgcaguagacagaggcucuccagguugagagcuccaugagggcaccaauuuuugucuguuuagcuguguccucaaagcaaggaaggguugauccggucuagaaaucaccugcgcaugcuucccaggacacagagcugcaucgggugucacauucccacuuuggagccuacaggggaaacuggcugguggcaaacaguccuugguuccaguuucaccucccuuaaacucaccuguaaaacggcguaugcaauaaugcuauacuuuccuuucaguuguaauacuauguuacuaauguuucugucaugagaacuugagguucaagauccccuugcuuuugguagcuuuccuuuuagaaaauaacugaaauccaauccauuccucugucccuggaacuggcugcugacaaguccaggcacuucaccuuuguacuuccccagaacaaaacaaaacaaaaaaccccuaacaagccacacacacacauguugaacuccauuuuuuauuggauuuaacaagaagugaaacguuaauuaccugcuucucuccuuaugucccuuuugcugaaaaggauaccacuuaguaauggaagagcugaaaaacuaagagggcuucucaggacucuccccgucaacucccucagccaaccaacugcuaagcccuaccaauucuagcacccuauucuguccacuucucuucaaucccaaaccaccaccaucuggugccuugacggccucccauguggucucaucacugccucccuccucuaaacuacaaaggccacauggcagccaggacaauuauuugaaauauacgugugauuuugucaccacacuccuccuccacugaacuuguuuuacuucuucagauacaacacggucuggucucuggcguccaagucuucacacaccacguucccucuucuggaaagggucaucacucuauuaaguaucacuccguuagagagccuccucuguacccacacguuauagaagacacccugcccauuccuggacaacccuuuccccuguauuucuccagugucccaguaacuaucugugcacagcacuaucacguuuaccaauacaacccugcugagaauacgaccugcuguacaacagguguuuagcacugaaugaaugaaugaauagacaugucuuaagcuccuacuuaccuccaacauucccucugccuucaccagcauccugaaaacuuacaacuuuaagaaccugggacucccccagccuucaacugccacugccaacaccagugcagugguuuggauugguuuagcuugacucagggguggugggugucuugucuggcucagaacuugaguccauuaacaaagauucucauuaccgaacuuuguucucagugagggcaagugggucaucauugccagacaauggccaaccaaccccucaauugagaagggcucagugaguucagagcccaaaagcugcaggcucagaugagaagcaccggaggcuggaggcacugcccagcacaaacacaacuguagcacacccugccugugggucuguuuugccuccugggcccuguggugucugcagugcucacuggacccacgccgugacuugucaagaagcugugggccuguucaggugacuucucuuucaguuccccacucacagcaccuaagcauucucauuucuguuccuucuucccugucuaacucuucuuuagccuugccuucuccugcaaagccggcccucagggacucugggaagggugagggguccuucucauguccucaccacugcucaccaccauggcucuuccccaccagaauguacucugugggcagggaucagguguuagucaucucugugcugaugaagucuggcacagagugggcuucaggucaauguaccaggcuaugcaccaugcugggcaggccuuuguucaauagauguuggugggaugaaagaacagaagggaggagugagaaaaggaaaugaggcaaguugauuuguuggacucauaagcugauucucuagagaucagggauggaaauauuucaaaaaauguagcuuaagauucucauaccaguguggcuauugauaagggaggguuggcaaauguguaaggacaauggugacuccacauaaaagaaaaacagaacacagcaugggacagaggucagugacaaacucuucaaaaacagcagggcacccacccuccuuuguguuucagaaaggaagccaaggccuugcacacuuucucugagacccugcccagcccggccuaccuuaugcaugacgaucuuccgcuggccuggcuccgccacgucaaucaucuucuggaccacguaguuggcauacugguccuucaucaugguguauaaggcacuguggggaccgucguucauggugcacaccucaucgaugagcacagcgcgcuccguacgugaggcgugaguaacacacuucuccacaacauugcuguaaugagauaaaaccagggacaacucuuacaagagaggccccuguuagugaggcugugcuugccuagcuucugcccugaccuccggaccagcagggagagagagcuauuuaacauuugaggaagaugagucgccaacugucugacucucucagucucugacucuccaccugugccaucuguggcauccaaucguaggaaagggggaacguggcauuaaaucagauuuuuucuccaauccacggggacuauagagggugaucaaauuauacacugccauacuacugcauacugaccacccagagagaccaggucuucaaggacaugggacccggcccucuaacggguaaggguaaggagcccagguaggugaggagacuuaagcacaagguucaggacacugguucaccaccagcugguuauuauuuuaacacuuaccaaaaucuguccauucuuuccucgccuuugucaguucaccaaggccaggaacaaaccuuacuuaugccuaucucccugcugccaagcagggcaugguggugcaugccuguaaucccagcuacuugggagguugaggcaggagaauugcuugaaucgggaggcggagguugcagugagccgagauugugccacugcacuccagccugagcgacagagcaagacuccaucucgaacuccugaccucguuaucugcccaccucagccucccaaagugcugagauuacaggcaugagccaccaugccuggccucaaauaaguaauuuuuuuuuaaguaaaaauagaaauuuuagaaaaggaaaauauaacaucagaaauaaaauuuacuguauggcuuuaauaguggauuagagaugacagaagagucaaugaacuugaaaauagaucaauagaaguaaacaaaaaaauacaucaguggcuuucagacauuuauuuuuuauuuuauuuucauuuuugagacagggucucacucugucacccaggcuggagugcaauggcaugaucucggcucacugcaacuucugccucccggauucaaauaauucuucuccugccucagccucccgagcaccugggauuacagauguccgccaugacaccgggcuaauuuuuguauuuuuaguagagacgggguuucaccauguuggucaggcugggcucaaacucccaaccucaagcaaucugcccgccucagccucccaaagugcugggauuauaggcauaagccaccgcacccggcccuauuuuuauuuuuguagaggcaggaucuugcuguguugcccaggcuagucuugaacucuuggccucaagcaauccuucugccucggccuuccaacaugcugggguuacaggcaugagccacuguuccugcuuucagacauuuuugauggugacccagaguacaaaguaaauuuuuccaccauuugaaaaaauuuuuguuugagacagucucgcucugucaccuaggcuggcgugcaguggcacgaucucgacucacugcaaccuccaccuccuagguucaagccauucuccugacucagccucccaaguagcugggacuauaggcgugugccaccacgcccagcuaauuuuuguuauuuucaguagagauggguuuccgcauguugaccaagcuggucuggaacuccuggccucaagugauuugccugccuuggccucccaaaguguugggauuacagguaugagcuaccgucuccagccccuauuuuuucuuuuuaaaauaagauucucagccgggcacgguggcugacaccuguaaucccagcacuuugggaggccaaggcagauggaucaugaggucaggagaucgagaccauccuggcuaacauggugaaacccugucucuacuaaaaauacaaaaaaauuagccgggagugguggcggacaccuguagucccagcuacucgggaggcugaggcaggagaauggugugaacccaggaggcagagcuugcaguaagccaagauugcgccaccguacuccagccugggcgacagagcgagacuccaucucauucauagauagagauagauagauagauagauagauagauagacagacagacagacagacagacagacagacagacagacagauagacagauagacagauacauacauacauacauaauuuucuacuaaaaucuccuaucuuuucauucacuacagcauauuuuccuuuacaaccugaguauauuuaaacagcugcuguauaauccuucuuuacuaauuccaauaacugggucauuuuagacuacccacugauuuuuauuucuuuuuucuugaguauaggucacauuuuccuauuauccagauagacacugcgaauaacaggcuacagaaacucagacuucugcuauguuccaccaaagagaagugcccuccacuccuguuuuagugcaguuaacuuggcuauagucaaacuacaaacuucucccauacaguaagcagcagcugaaaucccaguucaauucuuucagccuuagcuggaaaugugguucaggggucagccggacuugggggaagguuaaaacugggcccccccgaaccccuuccggcucucucccuuucuaggauuucucuuuguuguggcugcccugaggauugccuauuccagcuuuagcugcccagcauggaaaagacugggaagugaccacaggcuaacagccaucagaaauaagaaauuuccccagugcaauucucuucuuccaaaugccagcccccaccucucuggucuccaccugcccuuugguuacucucuagugucuucagguaguucuuguauuuuuguccacaguuuacacauguuaucaaugggaggacugggcccacaguagcuacucaguuauuaauuguuguagcuggacaugguggugugcaccuacagucccagcuacuuaggagguugaggugggaggacugcuugagcccaggaauccuaggcugcagugagcuaggagugcaccacugcacuccagccagggcaacagacucugucccuuaaaaaaauaaaaacuucuuuuuuuuuaaauuguuuuugaauuuguuguaauauuaauuaaugcuuaggcuauauccaagggugagaaauuaaauacugugaacaaaaauguaaacaggagacugacccgaagaagagaacccaagagauucugauccccauuccucaguccuggcaaccggucaaaaggaaccccccaaaacaaaacaauauaaagucguaagagauaacccugauagggcuaggcuauggagacacuggaucuacagguacuuucauuucuuuucucuguuuuuccaugcugugacauguuauaaaauuucacaaauuuaaaaugaaugaggccagguacugguggcucgugcugguaaucccagcacuuugggaggccuaagugggaggauuaaguccaggaguucaagaccagccccuggccaauauggugaaacccugucucuacaaaaauaaaaaaaaguagcugggcgugguggcgugcgccugcagucccagcuacuugaaagccugagguaggaggaucgcuugagccugagagguggagcuugcagugagccgacacugugccacugcacucaagccugggcgacagagcgugacccugucucaaaaaauaacauaaauuaaaaacaucaagguuguaugaguccuguccugccuugcaauuuauucuaaaaaccagggaagaauauauuccaaaaauaaaaaauaguauguuaugugggcaguaggacauauacaguaucuucucagaagacuauaccacuauccacauggaagggccauugauuccuucuccaaccucugcuacuuauaagugaccuaagacaccuuucacaaccugggaauaacuacugcauuucauucuugagcuugcacaauaugaagacuggaaaagagauccuaagaauacuaaggccuauauauagauaugcauaugguaaacugccuuucuuucaggugcuaaaaagggaaacugaauaaacaacauuucacaauuccaaacaaacaaguuaauaaaauauucaguucaucaaaguguaacacucacauucuuuaguaacauauuccccagauuucaaaguggcugacucuaucagaguaagaagcccacuaagggaccucucagaguuuauacuuuguaauaaaacuauuugacuuuuaagcuauauauacuuugaaaacaacaacaacaacaacaacauuaaaaaauaagauaauuauaguucaauacuacuaauccucucuucugggaaauaguccuuguaacucaaagcacguaccuugcaaauuugugcugacucaauacaaguacauugccucggauuucugcuacaauuuugcuuuuauccucaggacgaccgugcuccaguacauguuggauuacauaauuuccauauugauccuguuugagaaacaguaagagaaauaaaauguaugugaaagccaguucugcagguuacuuaaguccuuauaucuaauuaaaaccugucuuucuuuuaccaccauaacgguuuauaugaauacuaaugaacacacaauuuuuaagacagguaguaacguucuucucuauuauuacaaaacaggaacauauuauuacuagacaauagaauauacauauucauuuuuaaaaggggagggaguguuauggcaguaaauauucauuuuucucaaacacauauacaaaugguucacugcaccuaucuauaacagagaaaaacuggaaauauuuauguccaacaaaaaacaagggcauaccuaauuauuuaaucagugguauaagcagagaauguaucaaagcuaaaaacaagaaaucaacaaaucaacuuauuucauuuaacgauuaugaaacagagacccagagggauuaaaugucuaccuaaggugacaccacaaguacaugacagaguucuggaagucagaucuccugacuccagggcuagggcucaauucacuacccauauucauaaaacacaaaccaagcugcucugaauacaaauacaaccacaagauucaaggguauuuaaaacacauuaaccucuucuggaaccuacacugacaaaacacacaaacucuggcccugcacaagcccacagguguucgcaguuccucuacuggcaacuccacuaccuguacaagcugcucugugugcuggugaagcuccucuaaaauagggagugucuggucagggagacagugcuccaggauucucugaaucacucggcagccauaaggauguguggauaaggcaaauaccuaaggguagacaaacacaaaugagaagcaaaaaugacagucaccaccuucaaugcuucaguauuguuuauauauauauauauauauauauauauauauauauauauauauauguauuaucccacuaaucuucacaaaugaacuuaauggcauuuaaguucucucuacauauaauaagguguguguguaucaauaaacucaucgcuuaucuauuuuaggaauucauagaugugcacaauucagagcugaaaaggacuuuuccaagccgccaagaaacagauagcuagucaaagucaugaaaaacacacuuaguuaagagucaagugugucaacugacaaccucuccaaaagacagcgcuaacaacagaaaagggaaggacugggaccaaauccugaaugcuuucacaccgccagaacaaccagaaugcaauguucugauuuaacugugauguuuuucagcaauaagaaaagauucuuuugcuggguuuggagcaauagaaaagcacacuacccuugagauucugcccuuccuagcuuaguggcauacaucucacaacuguaaucaagaacaauaauaagagcaauaauagcagcuaacacuuacuggaugcuugccaaguguaagucaucacacccagugcuuucuguaugauuuuguuuuguuuuggagacaaggcuggagcgcaauggugaucacagcucacugcagccuugagcucuugcacucaggucauccuccugccucagcuucccaaguugcugggacuacaggcacuugccaccacaucuggcuacuuuaaaaaaaaauuguguguagagacggagauucgcuauguugcccaggcuguuccuguacuccuagccuuaagcaauccucccaccuuggccucccaaagugccuggauuacaggugugagccacugcaccuagccuuaugugugacuuuauacauguagcuuuauauuuacaaucguaaagauaaauaguauacuguaugguucuccuugaauuuagcuuuauaaaaaugcuacacuuguagucuggagcaacuugauuuauuucacucaacauuaugauucccauguucauuuacaauacugugaguuucuguaguuuauucugcaugguauauacaaagaauuuuuuuuuuuuuuauuagacagaguuucacucuuguugccuaggcuggagugcaauggcaccaucucggcucacugcaaccuccgccucccgggcucaagcaauucuccugcuucagccucccaaguagcugggauuacaggcacccggcuaauuuuuuguauuucuaguagagacgggguuucaccguguuggccaggcuggucucgaacuccugaccucaggugauccacccgucucagccucccaaagugcugggauuacaggugugaaccaccgugcccggccauguauaugacauuuuuaaaaaaugcaauccccugcucauggucuucuggguuccuuaagucuuuuaagagaauaaugguguuuaaacaugucuaaaaggucucaugguauacauguacagauauuucaacaggaucacagaaauuaugaagguugaaauuugaaagacaauacuaaauuauuuuccaaaaugguugugccaaugucuauucccaccagcaguguaccucauuccugucagcacauagcaacugauggguaaauaauagucuauuauuuguggcuuaauuuugcauuuuccuuguuccuaauggaacugaguauuuuuucaugucuacuggcaauuuguguuucuucuaugaaaugucaacuuguguucugggcucacuuuuacaucauguuguauuguuuucuuucauuagagagguucuuuauacauucuaguuaucaauccuuugaccgucgcaucuugaaaauauucucuccugguggauuuaucguuuuaucuuuuuuguuguauaauuccauaaauguaacaucuuaauguuaagguaaacagaucuacccuuuuuucuuuaacucagaaacucccaauaaccacguggguugcugucagugaucaaccauuguggucauugagcaaacagcaaaaccuaaagauuacuacacaucacauaucacucuauacucagcaguacauaaauuauaccugaaaaucuaugugcuuuuucucauuuuucccccuucccuaaagaaagaccaauuucacacacccaaaggggagcugaguuuuacuguccugucccacccaccuuaggagacuguaaggacuuuguguuuuggaaaaaaacaaaacaaacaaacaaacaaaaaaacacaaaacuauagccaauucagaagcaauucuggaaaaagguauuuacauauaaaaguaacaaucuuacuuggaagcugaagcuaagaagagauuuuugauauacaggaaaacaggagaaacuagaaguuaucucugguuauuuggccauuuaauacaauucaaaccaaccuggacugcaucccuuccaaaaaaauuuaagcaaaaagcaccuuguuauuuuaaagauauauucacacaugaccuacaacauuaguaccguaaauuaccugaauuuuaaaccaaauuuaaaacgaaagcacugaaauaucagaauaaauaguacuuaaccaagggaaauaauuuauucuucaaauaugagauuucaucuuaaaaacucuuaugaugguguuucaucccaaugugagcagacaacugcauuaaugacggaaagaagaccgagacccagacacuuggcaacacacagacagguaccugacaguacuauacaggacugcuuuuuacugcagucuaaaguacauuaagaucaggcacaguggcucaugccuguaaucccagcaacuucgggaggcugaggcagguggauugcuugagugcaggaauucaagaccagccugggcaacauggugaggccacugucucuacaaaaaauuuaaaaaugagccagguguggugguaugugccuguaauuccagcuacuugggaggcugaggggggaggauugcuugaaccuggcaguucaaggcuguagugagccgugauggugccacugcacuccagccugggcaacagagugggauccagucucaaaaaaaauaaaguacauuaagcauauugagaacaugccacaaauccuacucuguuuucugcucacaaaggaaauaaauuuguuuccauuauuucucuccugggucacuuaccugucccuuaaacgcaucgaugauaaauugcaaagacuggggcuguacacauucaaugcauuucugaaccacgugauugccauucugaucuuucacacacuucaagacauggccaucuaguucccgaaccaucucauucuaauggagacaaagaaagcaccaccagaaucacagcaagcaaacauguggacaaauaauauucuuuucaccaaacaugaaagcacuacugaacagagaaucugugaugaugaaaguggaauagcagcuguggaacaaugacaacagggaaacaaaugaggaccugagucuuuucagacauuagccaauuuacaguaaaauuuccaacaauaaauuuacuguaacaauaaccaguaaccaaaaagaucucacaccuguaaaaacaaaaaacaaagaaaagccucuuaagagugcuuuuguguuuuuauuuuauuuuuuuugagacggagucuugcucuguuacccaggcuagaguacagugguacaaucucagcucacugcaaccuccgccucccagguucaagcaauucuccugucucagccucccgaguagcugggauuacagguguguaccaccacaccuggcuaauuuuuguauuuuuacuagagacggggucuugccauguuggccaggcugucucgaacuccugaccucaggagaucugcccucuuuggccuccccaagugcuggaauuacaggcaugagccaccacacccggccaacuccuagagcuuaaaaaaaaauaaaggguagacaucuucaaauacaaagaagccuacaucaggaacagauacuccuuaacuuagaaaagaauuacauuccaauuauaaguugaaaauaucauuaacuaaaaaaugcauuuaaauaucccuaauuuacagaacaucauagcuaauccuaggcccucagaagugcucagagcauuuacaguacccuagaguuggacaaaauuauuuaucacagagccuauaauuaaaaaaaaaaaaaucauaggccaggugcaguggcucaugccuguaaccccagcaauuugggaggccuaggugggcagaucacaaggucaggaguucgagaccagccuagccaagauggugaaaccccaucucuacuaaaaauacaaaaauuagcugggcaugguggugcgcgccuguaaucucagcuacucgggaggcugaggcaggagaauuucuugaaccguggaggcggagguugcagugaggcaagauugugccacugcacuccagccugagcgacagagcgagacucugucucaaaaaaaaaaaaaaaauuauuuuauauauauacuuauauacauauauauaauaaaaacaauaaaaaagauucaaaguacaguuuugaaaaaucauaagucaggggcuauuugcacacuguauuaaagaauuucuacauggcacacagccauaaucccagcuacucuggaggcugaggugggaggaucaccugagcccaggaguuugaggcugcagugagcuacgguaacaccaccagaagccugggugacagagcaacacccugucucuaaaaauaaaacuaaaccaaacuaaagaauuucacauacaauuaaucguguuuuuauuaugauaacucuguaaaguaugacuaguaaugauacuaauuaagcuagaguuuaccccugguuaggcauaccucuaaccguguaacauguuuuaauuaaauuuuccuaacagucuuacggaguggacaccaccauagauggagacaccaaggaagaggcaaauuaaaagacuuacaaaacuauagaccuagauucccaacauucaaacccaagcaaucuggcugaacuguaugguaaaccacuauaucaguaaaccaaacugucaacaauacauuauccugaacaccccaccucugcugguauauaaaagaaacugagacagaggggcuuaagucacauauuucaaacuauggauagaaagugacagaauuagaauucuagccuaagcugugacuccaacaccuaugaucuuacuacuaggucacagugacugcagagucagcaggaaugguucucaauuaaugaaaagugugcaaacaaaggaaguaaaugaaauggccagaaacugagucugugaguaggaaaugggugauggugacaggauauauagaaagagagacacugggauuuugacuggagcccuucccccaaacucauugccccaggucuuagguaucuugaaauuaaaugccugcaccauggcuauaccuggugccuccugcccaguuucccugcugucuccaaucucuguacauuggcuaaacugugcugccaguggauuuauguuagaagacugcaagucacaucaaaauagugauguuaaugaauacaaugucuuaaaugcccaaaauguugaguaccucaaagcaacuaagauaucaucuaauuaaauuaaagauuacacuggcaggggcuaaagaagcaaaaggcaagagacacagugauuaaccaagugucagaagggaauaaauuuuuuuuuuuuuuuuuuuugaaacagggucucuuaggaucugucacccaggcugcucacugcagccucaaccucccgggcucaagcgauccuccugccuuagcaccccaagcagcugagacuauaggagugcaccaccaugcccagccaacuuuuuauagagaugggguuucacuaugcugcccaggcuggucucaaacuccugggcccuagcaaucuacccaccuuggccucccaaagugcugggauuacaggcauaagccacugugcugggcccagaagagaauaauuuacucugaaaauacaauuauaggaaugaugggaauugugggaauaauuaugacaaugaagcuuauacaaaaauaaagucaaagaauacuuauaaacaaaaugaaggagagauggcuucccuggauauuuuugugauccagaagaaauaaaaauuccaacaaagaugaguuaauuuuacccaaaauggcaaauuugcaucuagagaagaguaaaauaauaaaggguaggaagcauaagucaggcccagaacaagacaccacagagaaacaugaccagaaaaaauaugugcaaaaauauaacacaggaaacaacgacagcuggguaugguaucucacaccuguaaucccagcacuuugggaggccaaaucaauugaacccagggguucaagaccagccugggcaacguggugaaaccccaucucuaccaaaaauacacacauuaaccaggggaaguggcguaugccuguaguuccagcuacucaggaggcuaagaugggaggaccacuugagcucaggagguugaggcugcaacaaggacaauugugccacugcacuccagccugggugacagagugagaccuugucuccaaaaagaaagaaagaaaaacaagaaaauuaaagaagaacaauucaacuaucuaugaaaauccaagaaaaauuaaaauuggcaaugaucugaacauuaaaagaaaauuuaaaauagcuucacacuugcuucuaauuacuuauacuuucuuauuaaugcuacaucucuaguacuaagcacugaauaaaugaacuccagaccugcucuaucuccaacauuccuuucucccuucaccagcaucguggcacauaccuuugaaacuuaucacuuuaaaaacuuuggacuucuucagccuucaacugccacugccaacaccagugcagugguuuggauugguuuagcuugacucagggguggugggugucuugucuggcucagaacuugaguccauuaacaaagauucucauuaccgaacuuuguucucagugagggcaagugggucaucauugccagacaauggccaaccaaccccucaauugagaagggcucagugaguucagagcccaaaagcugcaggcucagaugagaagcaccggaggcuggaggcacugcccagcacaaacacaacuguagcacacccugccugugggucuguuuugccuccugggcccuguggugucugcagugcucacuggacccacgccgugacuugucaagaagcugugggccuguucaggugacuucucuuucaguuccccacucacagcaccuaagcauucucauuucuguuccuucuucccugucuaacucuucuuuagccuugccuucuccugcaaagccggcccucagggacucugggaagggugagggguccuucucauguccucaccacugcucaccaccauggcucuuccccaccagaaugcacucugugggcagggaucagguguuagucaucucugugcugaugaagucuggcacagagugggcuucaggucaauguaccaggcuaugcaccaugcugggcaggccuuuguucaauagauguuggugggaugaaagaacaggagagaaggaguaaaaaaauauggaagguggguuggaugaaaguuugacuuguuggagaaaaugauggcuuauuaguauuuuaccugcuuuauucauggaaaaaaaaaccaccuauaaaauugaaccuauuaaaggcuaaguucuagccaauggaagaguauuggauaccacagguuuuaauacaagauacuugaucugcaacaaguuuaaauuauuugcacaguucaugcuugccaugcacaaaaaggcagccauaagcaacaaugcaaaaccauaaaagaaaacugaaaauugacagaauuacaggguucacuacauguaccauggagaaacaucaaacaccaagagaaaaguuaaaggggaaacuuacaauuaccugcuggucugaaggaauaaacucaagagcuuucuggauaacacggcagccauacaucuguagugccaaugacaggacguggccucgaauccguucugccaaagccagcuucuguucaagacugccaaacuagacauaauguguggguaaacaccauuacuuaaguagaaggaaauaaaccagagaaagcaaagcauucauuauucugcaucaaccacuggcauaaccucuuuuagcccugauacccaugauuaacuaaaccuuuuauuuaaagagccauugcuucuucaagccaguaguucucgaucucuuaauuaugaguaacccuuuuuaauguuaagaaguuucucggauacccaacaauagguaguuucacuauuaauaucugcuaagcaaacacauaauuccucaaagcugucauuaauucauacuauuaaaugaaucuggccaggugcaguggcucacaccgguaaacccagcacuuugggaggccaaggaggguggaucaccugaggucaggaguuugagaccagccucgccaacauggcaaaauccugccucuacuaaaaacacaaaaauuggcugggcaugguggcacgcuccuguuaacuccagcuacuccggaggcugaggcaggagaaucgcuugaacccaggcggcagagguuacagugagcugagauagcaccacuacacuccagccugcccaauggagcaagacugugugucaaaaaaaagaauccuacacucuuacugccaaagcacacauggacacacuguuuugaaauaguauucuacaucauuaagagaauugauuuuuuuuucuccuauuuacacaagguaacagaguugggaggggaaaaaucaguagaaucaagaagugaggcuacacaauguuaaaauucuacuuagaaugauuuuccauccuuggcuuauuauuuucauuucaaucacauaaucgugagauuggaggagacuuuaugaauucucagcccauccaaccuccucauucucccaagggaaacuaagauccagagaaguucucaagcuugguccaaaucauauggcuauaauccauuguacauuuugucaccccaaggugcaucagccuccagaacuagaaagcucaguauuuuuauauaugugacaaaacggcagugcaaagucauucuaaaaucaaaaauacaaaagucauguuuagauugguuucuuaguccaaagcugaagaauucagggugaaaaaacauaagucuucaugaaaaaacuugggaagguaaaacuugaguacgucaguuuuucaucuucauacaaaucaaacaggaugagauguuaagacauuuacaaauuuguuuugugguagguaaugugcagaauuccagcauuuuccuccccauaccagacuccuccucaucucgaaguuuugugccauucugcaucuacaccuuaggguugccaauaccagauaauaagggcuacaaugguaagcaaaaaagucccugccucucugaaauuuuaccucacuagagggaaaagacaucaaccuaacaaucucauucuuuccaaagacaaugauacaacaagugaacauuauucaaauuaacagaaguaaaacaagaaaucaaggccaaacgaucagccaagaagcagcauuuaacaauucuugugacccuagcugauaaugaaacauacuggagucgguguccaaagacaauucucuaagaaccuuagaaaaauuuguuuuuggcaauauuuuauugugauccugcuaaaacuacuuuacaaggauuauuuccuccuuaagugacacguuuugugaaacuauuauaacaaucugaaauaaugugcuggguccuaaauggggacaccaguuuucgaaacacauuuccaaaauagauuggcauuaucugcucggauauuuaaaccauacagaauagauagacugcugcuaaugaauuggaaaaacacuaaaaaccucuucaaaaagaccacacacccuucauucugaggacuggaaugggacugcuaugcuuaaaaaggcuaaugaaaaucaaaaugcucugcagauucucuuaagucaaaggauagaaagaacaaaggcuuacuucaaagaacuucugaaugacguaauuaccaaacacauccaccaugaguugguaggcagccuggaggauuucauugaagacaagcuggcgcucagcugguguggcacgcuccaguuucagcugaaugaaucugaaguacaaaguaaaaagggcaaucacagcacugaaggaagaccuggagauacaucaguguaccucgguuuauagacugcauccguucugaaacaugugagugagcaugugugcacacacaugcacacaauaaaccaaacuuuauuugaaugaaucacuugaacucccuugaagaguuuuuaaauagaggaagaagguccuaacuuaauugagcuuugaaaauuacauauaaauguuggcacauuucauuccaguagggcaugcauacugaaucuuauuuaugugcaaggugggagggaagaugaaagcggggggggcggggggggggcgggaggggcaggggugcaggaagagaggagggguggagggagacauaacacaacauguacccuacuugacuuuuuuccuuuagaaaccagccucacaucaaugaacucaaagcuuacaguccuuacuauauucuuuaacuuauuuucauauaaaacaguacucaucagcuacucgggaggcugaagcaggagaauggcgugaacccgggaggcagagcuugcaaugagccaagauugcgccacugcacuccagccugggcgacagagcaagacucugucucaaaaaaacaaaacaaaacaaaacaaaacaaaaaaacaaaaacaaaacaguauucauuaucuucugaaguaguaacagucugccuuuuuuuaguccaaaugaccacuaucaggaaaaucauguugccucugaaucuagccuauagaauucaaauaugagaaauuuuggcccaguagcaagcuggcagaacuuaaggaggagguagcuucuguagaaacuguuucacuggacacaguaucagagaaagaaacagaaacagaaaugggaaagaaggauggguguugucaccauaauuaugcucuauccccaggaccagauucgcuuucugugaagcccacugcagcagcccaacaggaagggguaaaccaaaccaaauucugucuucuauaauaguuucuucucucgucucuacauagacugucacuucuacagaguggaacaacaaagaaaggugguagagcugucuuacuccucagcacccuagaucaaacuuguauuugaauagcaacucuuugagagcaaaagauucuucauaaugcuuaaagcagccgaaguguauguaugucuuuguguucauguuuguuucuuaaaucccuaugaaauaaugugaugcaaacuaagaggcacgcuuuuaaaaaauuacuauauggcaauuuauuuaaguagauacccaucugagccaagacaguuaaggcauuacaauuucggguaccuuaaagugccaaagccaaguacucaccuggacccaugcuggucuugggaaaauuccauuauauguccagcaaucucccgcaguuguaaauugggguaccgguuguuucgaaaaucuuccaaaagccugcuccugccagaaggcaugacaucagacauuccauaucgcaaacgagaggaagagaaaagagugcugcucgggcugaagaggcuggaggcgcugcuugcacugcgguacuuggcuucagcgccuggagcagcagagauguaucuuccacugccauucgugaguccuccuguugguuacagaacaggauaacuuaagaccacucuucagcaacuucauucaagagagaaaaaagcauucccacacccgaaagccugcaccauuucugauuucuucaaugcuguuguuuuugugucaagacaauucuauuagcgucaugacuuucgugggucaacucaacaaccuggaaggaaacuuuugcacaaagauugagaagggaaugcuuuuaccguugaugguagacugcuaguaaggcuggagcaacaguuagcauggccccuaguaaaugaaaugaggaagaaaugugccgaccaggugaaccuagcaccugagcaccagcaauaaaaacucagaaaaugcaaaacaaacucagacuggagugguuuuccauucugagaucugcggagauuccuuucauucuugaauaacccccauuuccaucugaaacccacucuaaaaaaucaggcauccagauuggucuguuuuauacaggggaucccaugaaaaagcugucuuugaaggaaugauuuugccacuaaauagaagugugaaaaucgcuaagacauuccaggccauggaugagacauaaugaguacaagacaggagaugccuuaaaaaugaaaaauuuucgaguuuucauuacaaauggacagcucuuaacaauuucuauugugacacagccugaaaugacuguaguuccaacaaccuucaugccacugauaaugcuguuuugaugggugacaagggaauaauugugaaucacagauaaaacaaacauaugaccaaaaggcguaucaaaacauauagcaggccaggcgugguggcugaugucuguaaacccaacacuuugggaagucgaagcaggaggauggcuugagccuaagaguucgagaccagccuggacaacagagagagaccccaucucuaaaaaaaaauaaaaaauaaaaauuagcuggguguggugauacacaccuguaguccuaacuacuugggauguugagauaggaggaucaccugagcccaguaggucgaggcugcaguaagccaugauugcaccacuccacuccagucuaggcaacagagcaagaccuugucuccaaaaaaaacaaacaaacaaacaaaaaaaaacaaaaacaaacaaacagaaaaaaacaguauagcagcauaauaaauuaugaguauuuuaaaauaacaaaauaacaggccagggacgguggcucaugccuguaauccugacacuuugggaggcugagacgggccgaucacaaggucgggagaucaagaccauccuggcuaacacggugaaaccccgacucuacuaaaaaauacaaaaaaaaaaaaaaaaauuagcugggcgugguggcaggugccuguaaucccagcuacuugggaggcugaggcaggagaauggcgaaccccggaggcagggcuugcagugagccgagauugugccacugcacuccagccugggcgacagagcaagacuccaucugaaaaaaaaaaaaaaccaaaccaaaacaaaacaaaacaaaaaacaguucuuauuuuauuucauuuuaaauuuugauugcaauagaaaaaagaugccaagccuuucugggguuguuucccccaccuccuuuuaaacaaaaggccaaaggagguaagaaauauuacauaaaccacaaaaaguuuagaugaauaacaauuaaaaacccacgagaaaagucauccaauauuaacuacuucucaacucuucacaagucuuaauaaaugucugguuugggguuuaaugguagccacaaaaagauacccaggcuggacuucacagaauuccagggcccagcuucaaaagucugggucucaaucaaagugaugaaaccaaaagaaaaugacucaaugcagaaauuuguaaaauauuuacuuaguauuuguccuaagcccaauucuauguuagaaguuuuucauauacacuuucucuggaauucucacuggcauuuuggaaaaggaguuugcaacucccauuuauguaacagaaaauuaagcccagagaggugaaauguucauccaaagauacaaaacccaaaauugucauggccagaauucagaacagggcucuugacuccagggucaaggcccuuucggggucugaaauucauuuucugacucaguuucaucaaguuuucuuguucuacagaacauucuugucaaauuccacaguauuucugaauucaaaugaaaagugauuuuuuuaaggaagaaaggagauuaacugaaaagaaaacagcagucauaagacuguuuuuuuuuguuuuguuuuuuguuuuuuuugagacggagucuugcucugucaccuaggcuggagugcaauggugcaaucucagcucacugcaaucuccgccucccagguugaagcaauucucccaccucagccguccaaguagcugggacuacaggugugcaccaccacgcccggcuaauuuuuguacuuuuaguagagaugggguuucaccauguuggccagacuacucucaaacuccugaccucaugugauccgcccaucucagccucccaaagugcugggauuacaggcaugagccacggcgcccggccaagacuguucuuuauuccauuucagaaacaauucugucuuaccugucugaggcuggggagaaauggacaaagaggugguaacaggguagguuggcagguauggggaaaguguggcaauagcaacaaacauaccaaagaagaagguauggggcgaacacacaauguuuugaaaacaauuuaaagggauuuuaagaaacuggucacugaccaaaauggaagguaaauuauaaaggagccagguccuuggugacaauguuuaaugacaagacaaaccaacccugaacacugcccuaccacuauacuuccaguuauaaaggccaauaaaugcacuuauuguuuaagccacucuuuguuggauguucuguuauuaugggcaaaaacauaaugacuaauccacacacaggacuggacugaacaacaguuaauacgccuacaaaaacgguuaauacauuuaccgugaaguuuugauuuuugccucuuaucuccuuagaugucagacaaguacauacuacaaggacauucauacacacacacacacacacacacacacacacacacacagcuuuuauuacuaagaaauauagacaucucugaagugaaauuuuccuagguacuaaauuauaaauggcaauggcaaacugacaguucacagacauauuuuguuugagccaagcaguacuucuuucaacauuaagccaaagcuuaaauuuuugcucuaaauuguaauaucuuguuuuugaaaaaaaugcgugacaaauaguaaauaaauaucugaccaucaguaaguauuuguugacugaaucucauuuagauggcgaaugcacaaaugugcuuuccgauucacaauagucugaauaccaacauguacuugcacccaaaccacuauagcucuggggguuugggugcaacacucuggaaguguuuaaauuugcaacuguuuuaaaagaaacauuucucauaaggcuucaaagggacagugguggauuucauaggaguguguccuaugacaacuuuccacagagaguaagggcuuaaauguuuuauuuaaauuaauaagugcuucagcuauuuugcauaauuguauauaagggauuucugccaguggucauguaguaugucaugcccaugcuacgucaaauguuaucauuuacuugcuuuuuguacucauagaucuaauagaugccuaaugggcaaagcccugccuucccacuuuuaaagaaaaauucccaugguccccaguaucuaguucuguguuuaauacaaccagaagcaacaauguucaucaaaauguuuuaaaaauaaguucucuccaauucauucuccaacacaacaccaagguagcucuaaauuaaauaacccugaaaacugaucaucuuagugcaugauuaaugaguccaaaauacguuaauugucacaugguugguuuuacagcugauacgucuccuucaaagaaccaagugagaaaucacaaaauauucauuucaauucagaauggggaaauaccuaaacacauacaugacuacugcuuacuggccaguaacuuagaaacuucuccuucaguucaagcaaggacagagaaagguauuuucuguuugagcugugcuuuuccuaaaaaacuaaaaggcguauaaaacccugaagauaaaggacagaaagaauacauuuugagaagauaauacuucuaucacaauaauaaaacuaaaugcuuuuuaguuuagaacuaaguuuagaacuaaauugaaauuuaguuauaaaugcuuucauuuuuuugcccuagacagcuuaugaacuuuugagcucauuuuuacuauuauauauuucauuucugaaguaaugaacaaccacaacacuuuucuuccagggcaaaugaaaagccugggugucgucaacaaaaaacuguaccugcuaccucuugauguuuaagaguuuuuaaaugauacagccaggggauugugcaaaaaacuguaagcauggagaagcauucuaagaaaugaggggugagaaagggcgggggaguaggauaaagagauccauggguaggcagggcaugaaaccauuacagucagucuuuggggacacucauauccacaucccuuacuuuuuuucucuuugagaugggaaguagaauuuacuagacauggauguuucaguuauaggugagaguuuaagguuuucuauguaacccacauauaaaccacaaaugagaguuacagaucuaguuguuaagaaaauucauauuuauuaacuaugauuaauaauacuguuaaauugagacauguaacacauaagucaaacaaaauaaauacuugcaacaucugccuuguucagggucacaacauauuuuauauguacacauucauggguauauaugcauguauggggaagaugggagaggaagauugagagagagauuucacuuauuaaaauaguacauuuuaugcuaacaaauuuggcauuuuagaugaaauggacaaauuccuagaaggucacaaauuaucaaaacugacucaagaagaaauaaaaaucugaaccuauaagaccuauaagauguaaagaaauggguuaaguaaaaaucuuacuacaaauaaaugcccaggcuaagacuggcuuaccuggucaaguuuaucaaauguuuaaagaaauaaugcuaguacuccacaaacucuuccagaaaacagagagggaugguacacuucgaauuucaugcuaugaggucaguaucacccugacaccaagccacaacacacaccucacgagaaagaaaaacacacauccuucauuaauacagauucaaaaauccucaacaaaaauacaaacacaccaaaucgaacaugaccaaaguaagauguauaucuggaaugcaguuggauuaauaucugaaaaucaauuaauguaacauaccacauucacagaauacaagauaaaagccacaugauggucaguuaagauguauaucuggaaugcaggauuggauuaauaucugaaaaucaauuaauguaacauaccacauucacggaauacaggauaaaagccacaugaucgucaauuaaugcagaaaaaauggccgggcgagauggcucacaccuguaaucccaacacuuugggaggccaaggcaggcagaucaugaggucaggagaucgagaccauccuggcugacacugugaaaccccaucucuacaaaaaauacaaaaaauuagccgggcgugguggugggcgccuauagucccagcuacuugggaagcugaggcaggagaauggugugaacccagggggcagagguugcagugagccgagauugcaccauugcacuccacccugggagacagaccaagacuccagcucaaaaaaaaaaaaaagggcauaaaaaacacuugacaaaaacuaaaacccauuugcaacaaaaacucucaauaaacuuaggcuagaaggaaacuuucucaaccuaauaaagggcaucuacuaaaaaccaacugugauuaugcuuaaugguaaaagacaaacacuuuaccuccacccccugccaagaucaggaacaagggaaagaugugugcucuuauuucuuccauuuaacacaguccagguugaguacccuuuauccaaaguacuugggaccagaaguguuucagauuucaaagucuuucagauuuuggaauacgugaauuauaucuaccagcugagcauccuaauaugaaaaucaaaaauucuaaaugcuccaaugagcauuuccuuugagcuuuguuaacuuucaacaaagacuuuguugaugcucaaaaauguuuuggguuuugcagcauuucagauuuuugacuugggauucucaaucuguccuggagguucuacacagugcaaucagacaagaaaaagaaaagucauccagauugggaaauggcuuuuauucuuaagaugauaugaucuuauauguagaaaauccuacagaauccacccaaaaaccauuagaacuacuaauaaacaacuacagcgaggccacaguauauaagaucaauauacaaaaaccaauuguauuuccauaagcaagcaauagucuaucaaaagauaaaaccggaacauaauucuauuuguaauagcaucaaaaauauauccaguuaggaauaaauuuaacagaagcagugcaagaccugcacaccaaaauuacaaaggaaaauggugcuaggacaacuagaaaugcaugugcaaaaagaugaacccugaccugacacccaaaauuaacucaaaauggaucacagacuuauauuuaagagauaaaacaauaaauuuuuuuagagcaaaacaugagaaaauauucccccaagaguuugaguuaggcaaagauuucuucgauacuauuccaaaaccaagauaaacuggaccucaucaaaauaaaaaacuagugcauuuuaaaagacaacauuuuaaaaaugaaaaaaaaaagggaccagccuggccaacaugguaaaacaccaucucuacuaaaaauaaaaaauuagcugggcaugguggcacgugccuguaaucccagcuacuugggaggcugaggcaggagaaucacuugaaccgggaggcagaaguuggagugggccgagaucacgccacugcauuccaaccagggccacagagugaaacucuaucucaaaaaaauaaauaaaauaaaauaaagaaaaaaaggagccaggaauaguagcucacaucuguaauccuagugcuuugagaggccaaggcaagaggaucacuggaggcccggaguucgagaccacccugaccaacauagcaagacuuaguuucuacaaaaaaaaaaaaaaaaaaauuauuuuaauuagcugggugugguggugugugcuuacaguaccagcuacuugggaagcugggguggaaagauccuuugagcccaggaguuugagguuacagugagcuaugauagcaccacugcauuccagucugggcaacagagcaagacccugucccaaacaauaaaaacgggggggaauagaacucaaaaagguuuguuuuuagucugaacuuuaaacaaucaguaaugaaaaaccaugccacucaauaagugauuuuuaaaaaaauaauaggaaaaauuacuaaacaggucacugauuuuguuaaaagauacuaacacauaucugccuccugggacaaaguguaaaaaagacaagauggggaaaagauccacacgagauauaggcugaugugcgcauucaaacacuaguuuuguggucgauaucauuagcaauauuaauuaagccacgcugaauuuuaaggggugaaggguucuuuugaguauucaacacaaugaauauaaaaugcuuaguauggcugcucaucacugcugauggcugguggcagcagugaaguaguauuaacaacagaagcuauauuaggugugggccagaaagaaauguuauguuucuuauacuaaaaugucuuuaaggccuuuguauggagauuguuagaaaccaaguagcacaccucuacuuucucgaggaaacagacugagcugaggcaaagcuguacugagacaaagaguuccucaggaauggcauguacgaaacaugcacuacacacaacagaaguccagugcaaauguacacuaaaaaacugcuugaacaaggugaauguuuccaaagagaaguuauguuaaacauaaaacuaggcaggcaacaagucauuugacaagaaauaacucacacuaauaguuauuuccuucuucacagggaaaacaaaaauuaagagguaguauuacauuaaauugcugaugcuuuagaaagaggaaagguaucaugcaugaaaguaguauuucuggcuccauuuccacgcaccaaggaaccacagcuuuuuauuuuauuuuaucuuauuuuguuuugagacagggucuuacucuguugcucaggcuggagcgcaguggcacgaucucagcucacugcagccugucucccagguucaagcaauucucccaccucagccucccaagcagcugggacuacaggcacacgccaccaugccuggcuaauuuuuguauuuuuugguagaggcggggcuucacuauguuggccagacuggucuugaacuccugaccucaagugaucugcccaccucggccucccaaagugcugggauuacagaugugagccaucaugccuggcccaucuauuuuuauaaauaagguuuuauuagaagauagcuacguauucacucauuuacauuuugucugugguugcuuucacacuucaacagcagaguuaaauauucacuacagacaccaucuggccuauaaaaccuaaaacauuuacuaucuggcucuuuaugaaaaaaaaacuuagcagguucaguuuauuuaguauguaguaugggaugacauaguucacauguuuuuaaaccaagaaauuaaaagauacauauuucuggauuugguaauggacugguucaagauauccugaguacaucauguaacaggauauacacugaaacugcaugcuuuggagucgaaaaggcuugauucuaaaucuguucaaaucugagaugacacaggcuaggcaagauauuuaaguccugagacacgaaauaauaccuauaccuuccaguguuguauguacaggacccaaaaccauuaacaccagcagguaaaugccaggucagugaacauuacuuccuuccuucuagccacguaucaaacugggaguuugacagcucucuccagauucugcauuaacccccaguguuuaaagccaggcauugugucacuaggaaacacuguugugcaauguaccccaucccccugucuaccuauuauggaccuacuaaucaggaaugucacaguaacuuuuauaaagugauguucauauauaaccugagaaaaugaguucuacaacuaaaguucuuacuguauaaaacuucaggauacgcacacacaugccaauguguauauauaaacauaguuuugacuugaaacucgccucuuucaaacucaaagcuaucacuccuaggucuagaauaauaagucuauuacccuacccacuucagacuucucuugaaucuuauaaaucacuuucuagucugccuauccaaacgaaggcauccuguuuguuuuuagucaaguucucacuucugaguccaugaagccacuuuuaaucuugcugguuaagaacagaaucuucuugguaaaguggccacaugugcugauuugcccaggacaguccugauuuaggccuaucaucaccaaguaauuauucauagcacccccuuccacucacaaaaguguucugguuugcaugauacauuauauggugacucuacaucuagcauucaauuuuccccaucuagcaaauaaaucaguacuuuaaacuuaauacauaacugcgggagaggaguaugcaccaugcuugagauaagaaaacaucucccauguccugaaagauuuagagauuugccaccaaaaaaaagguaauauaauuuucuuuucauucuuauagccugcugcuugggauccucuuuuucucucccuauuuucuagaaucuagaugguaauauuuuaaaaucccaugcauaaaacaaucuaaauauuuaauagggaaauauacaucuccucauuaacauacuauaugguuugagaguuuauauuuacaaauauuuuaaaauauggcaaaauuuuaaaaauaaaaugcuuuuugugaaaaagcaagauauuauauguacauauagcagaggggaaauuuugaaaggaaauaaggcaaaauauuaauuguggugguauuucagguggugauacuaggugauuaaauucugucucuguguuuccuagcuucacugaaaugaaccuguguuuauauuguuuacauugaaauacucucacagguagccaaagaauaaaauguucauacuaaagcuaacugaauauacagggaauguacccaaacuauaauaaagccaaaacugcuauacuaucuauagguacagccugaauaacaugagguauuuacggaaggcacagaacacccaggacacuucuaguauaaagggacuguccuuugcuuaugcaaaguucuuguaaugucaucgguggcaagagaguucuagaguucaaggugguguuagaguaaugguucuuacccagguuuaagcuugaagaggauccaugugaagagagggaaggagguggugucugugaauguccuggucccugacuagggagaggcaugcccacggguccaggagaggaggaaaagcuaaggccguuauaaaaacuguguccaaugggggucaagcugcucgauguccucuuauaaaggucacugcugccagucagggagucacggcgggagccacugccaguguuggaguuugcaacuaaaauggaauuaaaacaaugcagauaagaacaggccuguucuucgaagaacaagcccagugaccuguuccuaacacuuugauccagacuccuuaccaccgcaaauuugucagcagagacagccuaacuguuaauguagcaguacuaggggcagauaaguaauaaagaggacauggcucagguuaacaugaccaucaaacauaugccaaauuuaccuuccuauggugucguauauuauaggauaagggaggguuaaaaagcucugacggccacaugaacuauggaaaagguggaagaaaauggacuagaagaaugccuuucaucaauugaaaagguucaaguagaaaaaugggauacagaaaaaagauuuguaaaugggguacugccccacuacacaagacuucuauaugaaagccuguuuucucaguggguucaaucgagaguuaaugcugcccucaauuccaauuaagauacuuucuuucacacaugcccuucuauuuagggaucacuuuuguuuguuuguuuuuuauaaucucugcaauuaucccauuauucaccauacuacacuccugcuuuuuucaucaaaacauuaaaaauaucuuggucuaauauccuuccuccuaauuuuccacaugucuaccuuaaauucuacucaaaagacugaagaaaacuuguaacucuuuaaggccugcaggccaagaacucggcucagucucaauuguggaguauuucagcucugcuaucuuuaguaaguccuccucccucaguuuuugauaucaauuucuacaguucccucaauauuuuucccaaauacagcaaaaaucuucccuagauuucaaaucccugaaagaaacugauuaaguaaguagccacaugagcauggauugaaauaggucccaucuguauaacuugauuucaauagucuaucaucucacagauuaugugggauggcuggauucccacaaggcuugguccagaucugccugugguuccaugcauugccaguauuccagaaggauuguaaaaauaauuaaaauucagucuuaagagcauaucagucuaauuucuaccugcuguuccaaacccuccaagggcggaucccaggguggcgccgagagaacugcuacuuccgaaucccaaggauguguuggcaggcugggcagagcccugggagaagagggagcugcucugugaauugcuguucagagaguuguugccguagaaagaacuggaugccagguuguuauugggcugcugcuggggcuggggcugaggcugcuguguuccuaaagggcgaaaugguccauuuguuguuccagcaagaccaccagcugcuccauuugcugaagcugcggcugcugcaacagcuaugaagaagaaagcaaaccguuuggcuaugaaagggacuggccacauuuccaaacuacauuuuuaucuuuuuucaaaaaaucuuuuaaugcugccuaucuuuucaaaacagacacaaaccauacaaaucugucuuugaucccuucauaugaagcuucuauuuucuguuucuacuuucaauuugaacucaaaauaccacuagaacaaguucacuaugcugguugcuuuuaagaguauacagauuaaaagggguauaaacaucaaauguauccauuaaauacaacuacuuccuaaaaucuuaaauuccauaaauaucuauguugaggguuucuucuagaaccauguaaugcacauacacauccuucaaauuccuauuuuagcacacugcugucuucuagauguuccuguuauuguucuuaauuaaaaaauaaauaaauauaaacacuuaaaguaaaaaacuauuacuccucccaaccaaauguauuauuuugucacuucucacuacucuuucccacguccuccacuccugccccuguggcaaaaaacaaccccuccucuaaaauuaucuuaaaauaaugacuuggauuucugccaacaaagccauuuugugugaguaaugcaacuucuauguucucaguggagccagaccuucagaccuugcuucuaaccagcuggcacaugccaccccucccccaacccaccaaccccccaacaaaaaggagaauccacuaaggucacuuauugcuucugaucucuuuuugaaacauuacaggguagaaccgauauacugagaauugccaaaaguuuauuucaacauacuuuaagaaucucacuaucagucgccacuuuuagaucucuggcaggaguccacucagaugugcgcucaccugcuugugcagcugaggaacuaaugaugacuggggcaggagcuacaagucgaacaggagcuccaagaccauuucucgcgccugcauucacuacaagggcaccaguuuggucauaguaagcagcaggagccaacaccggauaaccuaggaauaucaagccaacaaagaaauguauauguuaaacaaacaaguaucuccugggcaccaacauauugucaauaaucacaaacucagcuuugagguugaauuggccagauuuauauacuggcuccaucacuuaaauaguugaauaaacagaggcuacaaaugauuauaaaaaucauaguacuuucauacuacauaauaauuuaagaacaaauauccugcaaaauagcaggaaaaaccuagauaggcuuuaaauaacaugaucuuucaauauuaugugagauagaaucuccaaaucccaguuuaagccauaugaaaaacugcaggugacuuccuaagaacacacaaaggcucaguaacuaaaaaacaaaugaaacagguuaaaguuauuuauugaauucauaaauggcucaguuaaauuggcuaugcucuaugaucaguaaagguccauaaaaauacgcugacaucucucaaagacuuguuucacauguagaacaucaaaguacaucuaaucccaugcaaagcaccaaaccagcugacagugaaccaaaaacaacauauauucaagauguaucuauauaaacauguaucucagagguagacagcuaaaaaggaccccuacuauugguuuaagagaaaccuuaaaaacguaagggaugacccuaucaagguauaccagaaauuucucacuaaucaugcuguucaaaaacaucaacauaaagacuaagccuuguaaacuagcuuggccacuccaucuaucccugauucugaaacagaaaacagauaauccaccaaggaaaaaccacauauuccaagcugcauggacauuuagauaccuccaauaugacuuaagacuggcucagaacaaugcucucaucagugaacuauagucuaagugagggcaaguguguaucauccuugccaguccccaaaucaugacaagccuaagcaaggugaaagcacugcucauuccccucuguaaucaccucaaacgugcagccuuuuucccugccaaaguauuaggaauaacaaugcagccgcaccuggcaugccugcugccagaccuuguccaaaugcaagggcagaauucacugcugcagcugccacaaggggauccguuugcugucccugcugguucugguuuggggucaaaggacguuggcuggcuccuccacggagaaccugggaaaggaagacagaaauaacucaaccacuuucuuuucauuggagaagaccuacccuaugcucagguugggucaacuuuuaaaacuuaauuguaaauuguuucccuauaaugguuuuuauaugucacagcuguuagcguauaaauucaauuaauaacauuucauagaguggaauuucauucuaccauucuuacuuuaaacacauuaucucuauaagcagcaaaaagcacacaaaagugaugauucauucauucaaacauuuuaucucaucugccucauaaaguucuugugacaauuaaguuaaaagaugaauuuggaauaucuggcaucagcaagugguaguguuaucaaauauuuaaugccuaccauguggcaaaugggcaagugagacagagcaaugaacaagaccgacaaagccccuguccucauggagcuuuuauuuuaacgaaugagacagacaauaaaccauacuauauaaugucagugcucugacaaaaagugggugaagaaaaaaaaagaguguaacaggccaggcgugguggcucacgccuguaauccuagcacuuugggaggccgaggcagguggauuaucagaggucaggaguucgagaccagccuggccaacauggcaaaaccccgucucuacuaaaacuacaaaaauuagccaggcguggcagcaggugccuauaaucccagcuacgagagaggaugaggcaggagaaucacuugaaccugggaggcggagguugcagugagcugagaucgagacacuucgcuccagccugggaaaaagagcaaaacuccauuucaaaacacacacacaaaaaaaaaaaaaaaaaaaagaaaaaaaaagaguauuaauggggguugggagggguuccagacaagaugaacagggguaauuuacccacacauuuaaagucaacugagucucacaugcacacaaaagauggaaugagaauauuuccucuuuaacacuaauauauuuaucaagguccacauggccccaaaugaguucaccagauucgauuugguagggcucucaccugacuauuucuauuucccucucagaaauuccacaaacauacgcauuagucaaguucagugcagaauaccaguuaugccacucugauaaaggaucuacuuuuuuuuuuuuggugggcggcggguggcgcggagugcagggaagagacagggccaugcucugcugcucaggcuggaguguaguguggcacagucucagcucacuguaaccccugcaucccaggcugaagagaugcucccaccucuccugaguagcugguacuacagguaugcaccaccacaccuggcuaauuuuucuauuuuuuguagagacagggucucaccauguuguucaggcuaaucucuaacuccugggcacaagcaauccaccugccuuggccugccaaaguguugggauuacaagugugaagccacugagcccagucaaggaucuacuuuuuauuaaugaaacacagacaucaaaaugcuagcaaucauuauuauucugaaugaugugaagaaucuaucucacaagaucuacacacuccagcaagcaaaaaugcaaaacccacaaaccaaggcuaaaauuacuacaguuccuaacaauguguuuugucauauugucaaguguacaguucuuaucagaucacuuucaauuucacuguguuauuuauaaaaguuagacauauggucaagaaaauggguacaaauuauucuugguaccagugguaaaaaaaaaauguaaaaagagaagcaacacuaauaaccaauuaaauauuuguuaagugaguauaaggugaccaacacuguccacacuggcaagaagggauguguggacacuuaauuugcccaaucuuuuacuucuauaucaguaauaaguaagaauuaacaaaugaucuugcagauuugcuggaaauaucucaaauaauguguuuaagccacacugccugauacccaggagaucaucaauaaccaauagcaaaucacuauuaucaagauauuauauaauuuguuucugaccuaaagaaccuaaccaacuuuguaagagaaaguguguuucaaacuacguagauagaagagucggggggcuguacaggugaguuuuaccaaauacuuagaauuuacauacccaauaacucaaaagagaucucacucuaggauaaguaaauagcaagcauuuuugccaaauacuuagaauuuacauacccaauaacucagaagagaucucacucuaggauaaguaaauagcaagcacagaaauauggcaaaugcuaauaguucaaaauugcugaagauuuuaaaaaacaaugaaagcauugcuuucacagaauauaaagaaguagguuuauguuugauuagguguucugugaaagggcaggugugguagaguggacaagguaccuaaagagguagucuaagacuauugaugagucuuguaauaaggaaggaaaacaguguuagcuuuuuguccacucucuagaaaucuguccaguaccccuaacuacaaauaaaaguccuucaguuaucugccaaaauucauauauuuucauuucaucaauagcugucaaauccaugauuuuauggaaacaaaauauacaguuucacaaguaacauuuuaaagucuaauaaaucacaaaaugacugaauuuauaaaaacuauccuagaacagucagcuugacuagaacgcaacauauacuuucugauaaaauacaagggcccaaaaggccaacagcaaaguuuaaaaagaaccucucauuuuaauuacuaugacaaggcaguuuaccaaaaaaaucauauuuuccucaaauacuuaaaaucagaaacuggcacccaaaaaaaaggaacuaaaacaauggcugcuaauuaaaaacuaaugcuaaaaacuucuuaguaggguuugacagaaccuguagggaaugacagaaaacugaaaaguuaaugauuauuauguccauuuuauaacaaaaauauaugcauuuagagaagccauccaacuugcccuaguuguaagcuaguuaacggcagaagaaacacaagaucucagauuuucuuuaagucaagacaucacaauauggucagaagaaaaguugucaagacagaggcuuauguucaaaucuuaacaacuuuguauuugugugacccugggcacacaaauuguauuuccucaaucgauuuccucucaauuaugaaauucuauuucauaaaacaagaaguuguacaacuaucauaauaagagaaauagaaauuacauguacagcacuuaacucugcacagaaagcuuucaauaaacagcaauuaguauuauucuuguucacuguauuagaccuaauuuuaaaacaugguaauuacuuuagucuuccaaaugcauaauaauuuggcagccauuuaaacaaaaagaugaucacacaaauaaauacagacuuauccacaaagagcaguuauuaagaaauuuauuugcuaggugcagugguucacaccuguaacccagcacucugggaggccaagguggguggaacacuggaggucaggaguucgagaucagccuggacaacaugguaaaacccugucacuaccaaaaauacaaaaacuagccagguaugguggcacgugccuguaaucccagcuacuagggaggcugaggcacgagaauugcuugaaccugggaggcgaagguugcagugagcaaacuuggcgccacugcacuccaggcuggaagacagagcaagauuaugucagaaagaaaagaaaagaagggaagggaagggaaggggaggggaggggaggggaggggaggggaggggaggggaggggaggggaggggaggggaggggaggggaggggaggggaggggaggggaggggaggggaggggaggggaggggaggggaggggaggggaggggaggggaggggaggggaggggaggggagggaagagaagagaagagaagagaagagaaauuaauuuauuuaauaggccaggcacagugacucaugccugcaaucccagcacuuugggaggccgagggggguggaucacugaaggucaagaguucgagaucagucuggccaccauggugaaaucccaucucuacuaaaaauacaaaaauuagccagguguggcggcacacaccuguaaucccagcuacucaggaggcugaggcagaagaaucacuugaacccaggaggcagagguugcagcgagccaagagcucacugcacuccagccugggcaauagaacuagacuccaucucaaaaaaaacaaacaaaaaaagaaauuuggccaggcgugguggcucaggccuacaaucacagcacuuugggaggccgagacggguggaucaccugaggucaggaguucgagaccagccuggccaauguggugaaaccccgucucuacuaaaaagacaaaaauuagccaggcgugguggugggggccuguaaucccagcuacuugggaggcugaggcaggagaaucgcuugaacccuggaggcagagguugcagugagccaagauugcaccauugcacuccagccugggcaacaaaagcaaaauuccgucucaaaacaaauuuauuuuaacagaucacucauucugucaacaaauuauuuacugaauuuccuuauauauaugguacaagaacuguaucuguugccaagaaaaucauuuaauaguguccaaauaacggggggaauuucaagaccuguuuuuuuuuucuguaauuguguggaaucuaaaaaaaaaaaaaaaauuaaacauacacccucugaguaagacugaugucaagcaaaaaauucuuguuuggaucauuuaauauauucauauaugagcaggguguuuugucucaaaugacagcuuuuaucugacaaugcguaucgaagccuaagugcugauuuuauuugcuccagaaaaacuccauuacuaggaauuuuuuccaaggauaaacuuauguaaaggauguuaaucaaucucauuuaaaacaccaaaauacugauacaaaugaaauaucaaauauaauagacuagucaaaauaaaguaucguuugguggauuuaaauguaccuaguaaaaaugucauuuaaaagaacacuaaauaacacaguaaaguaugaaaucagaauguaaaaccacguggacacaauaaugacaauuuuguaaaauauuaaauaauaaggcuaaaauaacagauaccaaacauaauagcauugguuuucugacauaaggauuuaggguaauuuuuuuuuucaaguuuucuaguuuaccacaguuucuaucaauaaagagguguuauuggccaggcacgguggucacgccuguaaucccagcacuuugggaggccgaggcggguggaucacgaggucaggaguuugagacaagccugaccaacauggugaaaccccauuucuacuaaaaauacaaaaauuagcugggcaugguguagcgugccuguaaucccagcuacucaggaggcuaaggcaggagaacugcuugaauccgggaugcggagauugcagugagcugagauugcaccacggcauuccagccugggcgacagagcuagacuccaucucaaaaaaaaaaaaaagguguuauucuagcaaucaaggaggaaaugaccuguuuaaaaaaauaaaagauguaguuuugcaguuuaccguccuuucucaacucaaauaaaaagcuaaugcagauaugauaguuuaagauuuacauccaauccaauccaauagguacuacaaauaagcagucuaaaaaucuaguaccccugcuuuagugucaagccccuugcaaaacccugaaaugaucugaaaguggugcuuagcaagcaacuacaguauggcagaacaaaauuuuacuguaacuuugaagauccacuuugccacuugcagcuaagcaauuucccuauaggugaacugguuaguaucguuaccccaccuagguacaauagugucuaauauauaaaagacauuccguaagaguaguuaaaucugagccugaacucagacacacauauauacacacaagaggaaauucaugcauucacaguguuuuucuauuaggcgcaauauuaccuauuaauuauccacaauacuacgauucccacuuagaagagguaaauuuugucuacauuuaccugcugcuguccuugcugagccugugggguggucuguugauuagcugaauuaguugcugcagcggcagcggcagcuugcugcuggaaaagacuggcaggguagacuccccagggaguaacuccauaauacuggugagggaccacagcugggccuaaaaauagcaaaagaaagguaaagaaagucugaacuacugaggcucaucucagccuuuccaaaauuacaucugacucaauagauccuacuguaaaauauuaacuuaaaaguauauauuaauuuaugcuagcuaaucauuaacucuuuuuaaagaauaguaaacauuauaugagauccuuacaccagucuucuaauauaauccaggccuagaggaagaagcaguggggaaugaaacauuagaaaacuaaaagggggaaucacugauagaagggguucaauuuaauaacagauggaggauguagcauagagacaauaucuguugguagaagggaguaaauggaggguuugcgugcuuaaagugauggaauagaacaaaagguuaggauguauccuauguucaaugauaagaauggcaccuaaggugauuuaacggagugcuguuguuucauuaacuccagaaaaagaacaucuaucagucugacaacaaaaccuagacacucaacugaaccuccacugcaacuucaaaguugcuguuacuguuuguuuuuuuuguuuuuuuguuuuuugagacagggucucucugucacccaggcuggaaugcaaugaggcaaucucagcucacugcaacccugaccuccccggcuuaagugauccucccaccucagccucccuaauaccugggauuacagaugcaugccacuauaccugacuaauuuuuuuuuuuuuuuuuuuuuuuuugguagaggucuguguugccccaggcuggugucaaacuccugggcucaagcgauccaucugccuuggccucccauauugcugggacuuuaggcuugagccaccaggccuggccccuauuucuauuuuuaaagucacaaaggcauucaacacaacuacauucagacacugauaugugaaauuuuaaauuuaagucaacguugaacacaaauagaaacaaaaaauacaacaccuugacuuguuacagaccuguugagaaccuuaaacaaaauuaagcauucucuguaaccccagcauuacgggaggccaaguuggguggaucacuuugaggucaggaguucgagaccagccuggccaacauggugaaaccccaucucuacuaaaaaaauauauaaaaaauuagccggacgugguggcagaugccuguaaucccagcuacucggaaggcugaggcaggagaacugcuugaacccaggaggcagagguuacagugagccaagauuguaccacugcacuccagccugggcaacagagcaaagagugugucuccaaaaaaaaaaaaaaaaauuaagcauucugcuuuaauccaaauuaucuguucauuuuccuuggcaacaaaguacagcugcagucggccacauaaaguacacaacagagauauaacaaaauuaugcagauaucaacccaaguguggcagaaaucuaauuauagaauucuaugacgaagcugguagcaagaaacaccaaagacacauuugcuaaccaggaaaugggcucaaagucaauucuucaaaucugcugaaacauaucuccaaguugaacuuccuuaaagcagagaguuaaauauuuccaacuugauucauuaacaguaaccaaaccuuccuuacacugacugaaguucugaagagcuguuucaaauauuacagcuacucugaugcuacagcuaauucuggagaaacacauaauucauuaagccaaaauaaauagacacauauucuuguuucccccauuuuaagcuuccaaaacacaaauaagucaaauuguaccacugcccaauauaaauauguuuugacauuucuaauuugguguuuucuauaccugugggcuuagaaaagauuaagaagcuguuuacaagcaagggugcacacugaaacacuauaccuggguacagaauaaagguguugcuaagaaaagcuguuacacuaugaacuauuuuacuauaagaagaaaagggguuaaaacauuuuuuaauuugucagaaacugaacggccuaaaagccauguauucaaguuuaaaaaaaaaaaaaagagugauagagccucauacucauuugauuaguguuuauaaagcaggguggucuugggcaguuaaagaaauaaauaagagaaaaaacacacaaaaaagacccuaacugugccuuaguuuccucaccuguaaaaauggguaaacagguagaguguuccuuaaccagagugcuugagaccagaaguguuaccgauuucagauuguagacuauguguguguccaagaguuaucuuggggaugugacccaagucuaaacacaaaguucauuuacguuucauauaugccuuauacacauagccuggggguaauuuuacuuuuccuuuggggaugcugaauagaugaacuguguguuaugugccugugguuuugacuaugacccaucacaugagaucaaggucaaguguggaauuuuccacuuauggugucauguuacuacucaaaaagauuuugaauuuucagauuagggaugcucaaccuguaauacauguugggaguacagccguaucuaccuugaaugagugguugcaaccugcaauaauagucccaacgcucucccaaaagccaacaaaagcgagccucuacugggcaaggacugcuauuaccauuaacaucugcauuacucucuaaauuuucucaacuggcauuucuacuacuauacgcuggucacauggccuaagguuaaauuuaggaaaacaucccagggcaaaucaacugagcuuggcacaucaggaugcccacuucaauuccugugugacugacacccucaaagaauacacauuuucauaguuuuaacaguuaacauuuccuguuauuugugaaaguauuaacucauuuucacccuggcucaacugacauauacaaaaaacaagauucugaucaccgaacuaccaucucagugacagcagcagugucaacccuaagaccaguucuuuguuucaaguaacauaaauuaguaaagacuucuaaagaaaguacagaaaagacaauucaagacagacagcacaggcauucuauauacuauagugaagcauacgcaugagcuuuggaguuaaaccugguucaaaccccaacucuacaacauuuaaauugugugacuucaaaugagacaguucucucuagguugggcgcaguggcucacaacuguaaucccagcacucugggaggccaaggaggguggaucacuuuaagucaggaguuugagaccagccuggcaaacauggcaaaaccccaucucuacuaaaaauacaaaaauuagccaggcgugguggugggugccuguagucccaguuauucaggagguugagguaggagaaucaaucacuugaacccaagaggcagagacugcagugagccgagaucgcaccacugaacuccagccugggcgagagagcaagacucagucucaaaaaaacaaaaaacaacaaauaaggcagcugucugagccacaaauuucuaaucucuaaaaucaucaucugaaaaaucauaugaaagaaaagcauucaggacaaugccugacaaaaguuaagugcucaauaaauauuaaugaugguuagcagagaucauucuccuacgaagagcuuucuguuuucccccaaaagggggaugaccacggacagccagaugacccuauguuaacuaucuucccaucauaaccaugccaaaauguaaacaauuuuuuaaaaaaucuaagaaaugcuaggcuacauuuaaguucauaauugcaaauuacauguuacauaauaaguaguaaaauuucgaaguaauauuuagucaugaugaacuugacuuggagggaucuucccccagugaauaucuaaacuggaagacauuuuguuuguccuaauguugaauucaacccaucauacauuuauggucccaucacggugacgguaacugugcaacacacagucaaauaacaaagaugccugucuuuuaaaaaucuagucucaagggaaagaaaaaaacacucauaggcugggcacaguggcucaugccuggaaugccagcacuuugggaggccaagggaggaggacugcuugagcccgagaauuugacacaacaccagccuaggcaacgcuggcgagaccaccccaucucuccaaaaauuuaacaauuagcuaaguguggugaugcacaguagcccuagcuacucaggaggcugacgcaggagaauccagugggcccaggaauucaagguuacagugaacuguauucacgccacugcaucccauccucggcaacagagugagauccugucuccaaaaaaaaaaaagagagagagagaaagaaagagaaaaaaaaaaagaggggaaaaaacucauguauacaucccacaagcaaauaaaaacagugcaguaauuagccaacuagggcacuucacaggcaaagaaugggaaaaagagcuuacuacagaagaccacagugaccaaagacaggggccuaaaccaaugcaguaucugcagcaaacuaaaaucagaucuguacugcuacaauguaugguguuagccaauggcagucaacuaggaagggaauugggugguacauauguagagaccuguauguaugaggcauggugauagagcccuauauacugugggucccaacccuagcuaacccacagaauuaucuggaagcuccuuaaaaauacugauuccaaggaacaaaacaccaccacccccaccccgacuccaaguaaguuguaaugaucagccauguuugguaauaacuguaguaugacauacuaggguagaaaaaagggaaaucaauaaaagguuuaagcagaaagaugaagagguaagaucuaaguuugaaaucauuuucuugaacaauuuagaggggaagaggaggugagagaggcaaggaaauuauaaauacauuagagaccaguaaaaguaccugaacuauaugauagacuagaggugguaggagaucugggcaaggggggaaauucccaaaauauaaaugaguaucugguggcuccauggaucaaaaacacauaugcaaggcguaugugauuaauuugccuuugaacauuuucaagucugaggggccuaugauacagcuacggagagauauuaagcuggcagguagauggcauugaaaaucuggauaaucuccacuggagacauggauuugggaaagaguauaaagaaugcacgcccaucucaaaugacuuuucagcaggugagaaaaucccucaugcagcagaaugucucaccuagugucgcugcugcagccaauccagcuguguagggguccgucccugggggagcagcgcugaugauguauggauuggggacaaacgcagcgggagcuaaaccugcugaaaacauaccugucaguaaaaacaaacuugacuaaaacugcagcccuaucaaauaccuacacaguuucgcuauucacuccagacaguagauaaggaaaaaaugaaaaaagagaagacgggacagguugaggguaaagagaaauuuuaaaaagauaacugcuauacuaaagauuauaaugaaauguuuauauagucaaauuuuaccuuugcuaaagaaauauuuaacuuaaaacuguauauaguuauaaauucagcauuucuaaaagauuauuaaaauuguaacagccuacaauagaacaauuuuaaagacuaauauuaaaaugggaugaaguauuuauuucuauuuaaaacaauuuuccaaacaguuuucaugaaauaaaauguauggguauuuauaaagauuaccaucuacaacuauacauuaucagacccaaggacuuuaugccuggccuuuauuuauuuagguuggaaguaaguauauucuucuauagccuaucacauccaagauuagcuaucuccuuucuacucaaucaugccauuuugacacauuaaaaaaaaaaauucuacuucuacuuguuuauacuuaaugcacucuaagagaccuuaagaagguccagggggaagaaacgucuaggcaguacgaugaauacaucgcucaaaacuuuaacaacugcuaaaggaaaagggcaaagcuacuuuaaaaucgguaauuauaugagaauacuuuuaaauuuuuucaaugcauacuuacuggaaaauggauuuauacuguuuguucacaaaauaagaagcugauauauuagucuauagaaccacaacuuauguaaucaaugucauccaaaucuuaccgaaagagcuaaugguagucaccagucauuacucugauaaauacuuuaaauccugaaacaucugagguagggcaauggcugaacacugaagaaauguuaugaugcgggucuacaagcuaugucaaaacuaauguggcuggagacaacuggacaaaaggaagaggccacuuacucugucugagggauuugucugaacuuuuauaaucaguuuaaauuacuggguuucacagcaaccaguuauccuaaaauggcggccacaccuaucaugaaagagcuaugggcuuaaggacuuaccgaugugcggcugaugagcagcugccagugcauacugcugcugcugagcagcugucaacugcuggacagcaagcgcauuaggucuuuggaacagcugaggcaagaggaaaaacacggugugguuagggaaacugucuuacaaaaucauuuaaaaaccucucugacuaaaaauuuuaauaagcacuuguuuaggcgugacaccuuaacaauaaauguucucacacucuacuucauucccaugggauuaaaauguuucauacuucuguucucccugucucucuuucuuuacuucaauuuacuguguccugguuccaugagcugaccgcuucacagauuauauguccccugaaccacaaauacacacucucucacacacacacacacacauaugagauaucuauaucuauaucuauauaucuaucuauauaucucauauauaugcauucaaaagcccuaaagauuaucaggucuacagguccugccugauccaaggcaaaguuaaaaauuagacaaauguacuaccaacugauuugucacauugucccuagugcugaaucuccuuucagugcuuucaagaccccacaaauaacugaauuaauccucaccuacucacauuuuggagaagaauaugaaaaguguucacuucauccucugagcugccucuuccugggaaaaugguauugaauaacuuccucaacuaguagcuuauccuaaugaguaaauuaagacaccugcccaacuuucgggagcuccagagucuucugggauacuauucuuuauauguuaaaaauaaaacagcagaaacacagcagcuacuaacaaaacuuggauuaugagcucacaccuagcacacuucuuaguucuaaagaaaagaaaguucaaaggccuuaacaacacuaagaaugucuuacgauucuacguuaauacaaaaccagucauucacucauuaauucaacaaauauuuaugaaacaaaugauaccugcuaggcacugugcaaggaacuagggauaugacagucaauaaaacaauacauaauccugcccugauggagauuacauuuuaguaugaauaguauugguauaaagaaaggggaugccaguaaccuaauuuguggaucaccuuaaugggccuccuuccaaggagucauacugaagacuucaauguuugcuaaaaucagacugaaagcacuuacugaagugaccucccuggauaggaccuucaaccuaccugcucuuccuacaggauuuuucaacagcucagcugacauugcuggaugauguuuaacagacaccauggaucuugaauuacagauguccucauaaagagaccugauuguuucagacauuaggagauaaugucauucuagcaacucagcuuaauuauugucaugacuggacuuacucuuaucuuaggugguggagagauuuuauccugagauuuggcuacccucuacaccucaaacaugaggcuaauuuuagauuaaaagaaaacaaaaagugaauacuuugaagauauuggccaauuucaccuguuaacucuuuagucuuagucucugcuuuuggaguaugaaugucaaaaguaaccaugcacagauuucaaaaauacuuuaguuuuuuuuguuuuguuuuguuuuguuuuuccccaaaaguuaaagaaaaacuucacugcgaugcuggcaaaaaagaaacaguauuacuaaauaucaagucuuaaaaagaaauaggggaacugaaucuacugacagacauuaucaaaacauuuguccuccaggaagggagccagucaagacuauuugguaacagugugcuugugauuucugcaaguugguuucacauuucuguuuuacuaaagaugugucucacacaguauucccuccaacaggaggcaguccacccaagaggggcagccaggagugggaaauaaguaaaacaguagaaaguuacuuuuaaauuauuuccaagguugugaaaacaucucauaguuccacuaaacauguauugccucuucaauggguuucuggaauuuucuuggccuaaaaccuuuugcaacauuuaacauaucagcuugugcuagcugcuucucucuacccuucuuugcccuacugcaaacaaaagaauucauuucauucaacagauguuuuucgagcaccuauuauuaggcaggugcugugacauggaacuggggaaaaaaagacaguauguucagaacacaacucuuaaggguaucucgauuuauuaaccaaaaacaguaguccacugccauuccaucugacuuaaccucacuucauauauuuuuguuuguuugaagagucggagucuuacucugucugucacccaggcuuaaaugcagugacgugaucauggcucacuacagccucaaacuccugggcucaagcaauccuccugccucagccuccaaguagcugcgcaugucaccacgccuggcauuuuuuuuuuuuuuuuuuugaacuuuuuuguagagaugaagucuacguugcucaggcuggucuggaacuccugggcucaaaugauccuuccacuuuggccucccaaaggacuggaauuacaggcgugagccaccacaccugggcuauauauuuuuuuaauauuacauguaagucauuuuauguauguguacuguaucuguaaauauacacggaaauacauggcaugugggaauaccacaaaaguaaucauuccauauaacauuagcuugugguuuucaccaccacauuaaaacauucugaaagcaggaacuauuacuuuuaacuaaaagcaaacaagccuuacaagagaccccauauagccuauguuugagagcugauuaauaucuuaguaauuauggugaauagaaaaggauuuucuugagaccauuuugcaguaaacaacuuaacaaaaguaaauuauacaucuacagcagacagauuugauuacagaacagauuacagcaauuuuggcacauucucuuuauguaaauggugcaauauuaacuggaaauacagaguauucaaaacaaauuggguaauuggcaagugacagauuccaaaggauccugaaaaacucacacaaaugccaucugcugggcaaagcacugagcucugcuaacauuuucauguuuuucacaaagcaagcgaauaucccauaacugagaaacaaaauacugugaguugggggaaaugcucaaaggucaguauaaugauaaaugugacgcaguuaauuauaauucacuuggguagauuucacaaguuguucaagagucugaaugcuggggaaaauguaucaucuacuucaagcauaucgagguuccuaauaaauacugaaggcauaguuuaagaaguagacaagcugguuugccuccuuucucugucacuuacuauauuaaaaacagucuacagagcucuuauuccagaaaggaauccgggcagccaaaaacacccaauauagugacugacauguaguuggcaucuuauaaaagauagcuacuacuauuauuacuguuguuguuaucaauagcaguugcugacauaaaaaauuauggcuuuuuuuuucuaaaccuggaggaguaaugucuaaauaaggaguuaguaaaugcaaaagacuaccgcccccacuccccccuggccaccggccacaauaaaauguacugccagcccugacuuuuuuaccaguuugagacuauauacauagcagacagggguuaagagcacugacucuggagccagacagccuugguuucuaucucagcucaccagugacuugcuaugucaccucuggcaaaucgcuuaaucucucugugccucauucucuucuccucuuuaauaugacaauaaagauaauauguaacauggcagguugcuguggggauuaaaauuaacacauguaaagauuuauaagaguccuuuaugugugauguucuuucugaugaauggggagagcacccccaacagacucagcccuucugagagucacccuuuacaguuccuucccagagccaggcagcccaagcagaccaaaagcagagggcaggacuccuccuagucuguauuaagagucuaaaucagccaggcaaaguggcucaugccuuuaaugcuagcauucugggaggccgaggcaggcggaucaccugaggucaggaguucgagaccagccugaccaauauggagaaaccccaucucuaauaaaaauacaaaauuagccgggagugguggugcaggccuguaaucccaguuacucgggaggcugaggcagaagaauugcuugaacccaggaggcggaaguugaggugagccgagauggccauugcacuccagccuaagcaacaagagugaaacuccaucucaaaaaaaaaaaaaaaaaaagagucaaaaucucaccgcaccaggaccaccagcugcuaucagugggucacaaagauaacagggaagaaagaaaaccauuuuuguuuuuacggaugaguacuuucugcauuauacuacuuuaagaaaaagcuauguaguugaauuugaaggugagacaacuccaccuauuaaaaggcccugcguuucuaauacaaaguucaaaagagacagccugaagcuagaaaccaaaauaauagcuaucugcauagcuuguacuagaugaccuucaaacaagucccuaaacuucacugauuuuuuuuuuuggagacagagugagacucuguccccggggcuggagugcaguggugcgaucuuggcucacugcaaccuccgccuccuggguucaagcgauucuccugucucagccucuggaguagcugggauuacaggcuugcgccaccacaccuggcuaauuuuuguauuuuuacuagagacgggguuucaccauguuggccaggcugaucucaaacuccugaccuuggguguccugccagccucagccucccaaagcgcugggauuacaggcaugagccaccaugcuuggccucuuauguguaaaaauaaaauagcugcccuaccucgugggguuguuuucaggguucacagagaaaaucccuucgaaacaguaaaagcacuauaucaaugaugggauucuaaaauuuuaagaaaaagguuuauuuuggagucauuccucagcauaugaaauuugugaaaucuuguuacugcuugaagcuucuagauaaaagcccaguuuauaccagguuauuugaacuacugcaaugaucaacuaaugauuacaaugauuuuucguaggcgcauacaaauuaaaccaugcugcuaaacuaaaaaaaaaaaaucaucaucaucaucaucugugcauuucuuuggcagaugaagaaucugauuccaaaacaaaugauuucuaagguccuagggaagaacaaaacacaucccuucacuaaguauuauuaauacuuuuugagaaaaacuucaccauaaguaaaauuugaacgaagucaaauaacaauagaaguuaagcuucaacugaucaauuacuagucacucuuugucaguuacuauacacaugacacuugauagaauaaucauuuguaaguuaaagagaaaguugagcauauuaaauaccuacauuaaaaguauauacacacuuggccucacgagaaugacauuuaaucacacugccacacuuuuaacacaugccgauuuccacuccccucugacuguggucgugcaggaaugaauaccauacuucaacuuucauuuucagaauauugaaucuuuguuaaaauucaugcuuaacagaugaguuuuaguacaacaguguccaauuuugugaaacauacuacauuaggcuauuuuuagauuaacugaauucuaaauaaagaucaacaauacaauuaauucuacacugauauaauccuggcuuugguuugugccauguuuguaacauaauacaaccuaguaacaaauuuuuuuuuuuuuuuuuuuaagacggcgucucacucugucgcccaggcuggagugcaguggcgugaucucagcucacugcaaccuccgccuccuggguucaggugauucuccugccucagccucccgaguagcugggacuacaggcgugugcuaccacgcccggcuaauuuuuguauuuuuaguagaaaggggauuucaccauauuggccaggcugcucucgaacuccugaccucaugaucugcccgccucggccucccaaagugcugagauuacaggcgugagccaccgcgccuagccaaaaccuaguaauaauuuucuaaacugcauuuaaggaaacaggcaacuguauagcauuuuguaaaaaauaaauacugcuccaacaucacaguacaaaaugguaugaacacauuaugcaugaacugcucacagcuguuuuccaggauuaagaagacaaugaagugaauuugagacaaaggaagaacauuuuagaaauaacaacgagcauuucaagcugacaaaauacuccaagucagagguucugaacccaagauauuuguacuuggguggguaauacugcaucuuuaucucaugcacauuuaccugaaauuuagcauguucuucaauuaugauuguagacaacaaacuacauuaacuuuagcaauauaccugugacauuaucacaaacagaaaucacauauacuuucauguuacuuuacaguuguuacaaguaucucaacaucuuacuugugcucauuaugacagcuaguacaucuacuucuauuucaugcaucauaucauaaauaaguaaauauauaauuaacuuuguuuuuaaauaugacagcuauuuuuauaccacugguuuccuuuguaauccuacuuuauacauuuuaaacauuauucugagaaguaguccacaugguucacuuauuaagaaguucacggcacacacaaaaacaaacaaaaaagaauuagaaacuccugcucuuauaaauaaaccuuacaaggguuaaauucagagugauuaacagugaccagacaaccaacugacucaucaaaaucccaugucacagcuaacaagaacuaaguuugcaaugaauuaaaugaaaauuaccuuuucccuauuugcaggcugcuccaugucauguaucucauuauaggcugauaauaaguuugaugaaaccagcuuauuacaccaaaucaaagccaagauugaaagaaaauauaacaaaagagagaauuacuuauuuugucaaccuccaaaccagauuccuauucuaaaaaaucacaaauaaagcaaaccuaccauuugcagcaaacucuaaaccaagaaaaaugaucaccuuuguugcuuauuucagaaagccaagauaaaaagagcagaaugugcagaaaaguaugugcugcacuagaccucugguccaacccucacaaucaucaguacugucugagacuuccagcugguucucaaggccuccgggacucaauuuucaaaggcaucuguaccuccuuguccucuuguacacucgucuucuacucucuucagccuaggacuacaccacagucauucccagcuccauaccucugcucugaccugcaacaaaauguauuccaccuguccuucaagucaguugcaugcaaccuuuguccucauugagcccuccccuugucugauaagauucagaacccauuaauuuagcacuuaguuccccaaauauuccacuacuguuucauucagaacccaagguuccuagaaggacacaacagucaacaguuaacugaauaauaagaguaagagaaugccucaaacugcugcuaaacucacacuaaccacaaaaaaaacaaacuauaauaauuaaguaauuccugcuuuaaagugucuucucauuuccuauaggcaacacagcauaagacucacaacaccaucucuucaaccucucuaguuauuuuucuucaaccuaaccaccaaccagacugacuacuucuacauuaucuacugaacacauaucuguuuuacuauuuccuccacuagaauucucauuuucuucguauauaaaaaagucuuucaaggcacagcuaaagaacuaccucuucuggcugggcgcaguggcucaugccuguaaucucagcacuuugggaggccaaggcgggcagaucaccugaggucaggaguucgaaaccagccuggccaguaaggcgaaaccccaucucuaccaaaacuacaaaaauuagccaggcacaguggugggugucuguagucccagcuacucgggaggcugaggcaggagaaucgcuugaacccaggaggcggaaguugcagugagccaagaucguaccacugaacuccagccugggcaaaagagugagacuccgucucaaaaaaaaaaaaaaaaaaaaaaaaaaaagaaccacuucuuccacaaaguccuucccuucccaagagaccagaguacacucuccauaguugcaggguuccaagaauaugggcauaaauggucucaucacuugucaucgaguacuuccaugcacaauuuaaaugauaaagugaguuacaaugacuaaccugagagcaaaucaagaagaagaaagggaaucuuacucuauucaugaaagauaugguuggcuacaaagaacaaaagauaugaacagaaggcuguaucuguagaacacaaaucuguggucucccugaaguuaucuacaaaacugagugucagagaauuauguacauuuuucucaugagagagaccauggcuucugaucagaugacaacagagugagccuuaaaauauuaaguucugauccaagaaguaacuuuccuggauauuauacagcauaguuauuuguauauaagugguaagcuggauccaaaggacacacauauuagaaaacacgguaguucucaaagaguagccuccagaccuccugaaaggcuaguuucaaauuuuaauuuugggaagcauauuacguacagaggaugcacugagauauuauaauagggaugggggaaaguccccugaaaccuuguucugcuaaagcaaugcagaggaaaugggguaagguucagucuuugcccucaaggagcuuacaaucuggcaaggacuauuagacgaguaaucacaacacaagacaaaacaugguaacaccuucucuuaaaggaaacacaaaaugcuauggaguucuagggaggcagacaugacagcuuuuugguuuggagacuaagaaaggaaggugacaguacugaaccuugacaaaugagguggacguaaauuagaaaugaaaaguggaauaaaauguaaugaaaacuaaaaggauaagggauaaaauguaagaaacaaacaccaauuuccaauagaaaaggaaucguuccuucuugacaacuacuagcucuuauacaggaacaccgagagauugagggucuuaaagauauaggaggcuuacgccagugguucccagguaugcuauuagggcccccgguacaagaauguauaaaacaaacuacucagaaaagaauuauggcccaugagauaaaacaacacucacaucaugacagugguaugucuguguaaaaaugccucuauguugcagcaaccaagacaugcacaggaaaccugaauccaacaagagauuaacuuucaaaauaauguuuacuuucaauaacugcugagauauauggugagggcacccuugguuuuauauuuuugaauaagugguagcuaugauguaaucaugcuaacuacuuguggguacauagaaguacauuucuguucaaguucuaauaauuguccagucuccaaaaacugguaaaauuauuuugaaaccaaagaucaauaaaucaaaaaagaauaucaacucugauuaugaaguaaagaacaguuuaaaaaaaaaagagagaaccauauauuuuuguucauaagaaaucugagacaaacccuucuuaaaaaacacagaaaguguuagauugcauuacacugggaauggaagcuaagaaccaaaaauggccauaaagagaaaaaaagcacagagagucaauucauauggggaggcaggcauaccuacuaagaacugcacggagaagaguguacacuuucaguuuacucucucugaaagauauuuuguuaauuuaaccuuauaugaauaugcacauucacacaaucccuuaaagguauuuauuguucauaaacgacacaggagacuuaaagggaaacuucauauguuuaacuuuuuacucuaucaaucaaaauucauuuaguaucagcuauuuaugacaauaacuaaagguacaacacggcauaauaaucuccaaagaccauaagcuaauuucccuacauagaauuucuaaacuucaaaaugagaugcuaaccuuucaaaccuagaagucugcauuaacgaucuauuacaaaacuacuaaagaguaacagaaauucauggucaaucaaacugcuuccgccacaagggagaacuuaacaagauugggaaacuaacagccccucuuuuguaguucagacagcugaccuuucuuuaaaaaauaaauaaauaaacacagagaucaguuaauccuagagguaguccuacaugucuucaaaaacagaagguagacauacaacaucuucagggacuuaugaauuuaaaaaaagaaaaagagccaagcaauuucaugguagauuuuaaguugaaugauuugugugugugguuuccucugaucgcauucuaauacuuuugaaagaugccagauccuugucuaugcuaucuggaguaacuuguuuaacuguaagacacaacugguaagaugaccuggcacuacacuccugacagcgguggauaguagaguuuacuauuuuaaaaacaaaacaaaccaacagcaucacaaccacauaaaucuucagagauuaauuuagcacccgagaggguuguguuacaagaggcaauacuaccucauccacuccccagcugcugaggagagagaagaaccaaaggaaguacauacagaggacgguggccucuugccagugaccucagcauagggaccagcuucaugaggggacucuguaaaccuacaucacuaacagguucacaagggcuagcuauggauagccugaaacaaugccaccaccucccccauccccccauucuuaauuacuugaacaacgugcuggcuggagggagaguagagagggugacagagacacacacaguaccuguuguugagaauuguagucaaaaagucccacaguugcugcugcugaguccacagguaccugcgugccugaauaaucaaacugaagaggcuccaugcccacauguuccaugggguccaaggggacacucugggacuccauguuggagaaauccuccacaggcuuggcaccauuggugcuggucagcugggcuaagcccucagaaccauucugguuuggacccagaagauccacuucauuagcagaguucuggcaauuaccagggguacggcuaaacagagaaaguaaagggcauuaaaccuuauuuucaguggggagggacuacagcaacccaaguuuaaggacaauguccucaacauagcucauuaucaacaguauuuaaaacuauuucuauaaaauaaccagagauacuuuacagggcuuacaggguuacaucuucuaaauugaugcuucuauugccggcaauuccauauaacucaccccuuaaauucacauuaauugcuauuaauuuacaucccuucaccaagggggccggguuugaggaaaacugaaauaaaguggaaaaaucacugucuauagcauccaugaaagcagaucccaaaaugcaucaaaaugcaacaucuacucuaucuacucuuuaaauacagagacaauggaaaaaguugguuucugggggaaauuccacaacucagugauucuaaaaaguuuuuaucuuccuggcauauuugugaggaaagaaacagaaugaaaaaaguuuuuacaugucguugguauuacugaccaauguuaaaacuaacuccccuuucuaagaaaccgaaauaagcagacuauuccaaaguaguacaagaugaacucauuaucuaggauaugccccuguuaaggagacaauucuaagaauuaaaaguaaugggaagauguaauuuaucauccaaaccaggacaugccuaagauuuaaaaaaaaaaaaaaaaaacagggcacuauugauaauuauuguaggacacaagguucuggguaacccagggucuaccaucaccuuauauaaaaggacuucaggauuauaugauccaaaaucagacuaauauauaauauuauauaaacagaagaguguaaccuguggcaacauucaaugcccuucuucuccaccuccaacccccuaccccaaaaaauccuguaguccaguagcugguacauauuaaagguauuauucugguuccuucucuuucuuucucucacucacacacucaccaccaccaccaccagcccccauuuaaauacaacaaaauacugcuacaggcugcuggauauucaagguggagaggacaccugaacucaucugaaagaccuuagguaaguauuuauuacccugugccuuaaauuucuuccaaagauuguaauucaggccgggcaugguggcucaugccuguaaucucagcacuuugggaggcuaaggcaggcagaccacuugagcucaggaguucaagaccaaccuagcaacauggcaaaaccccaucucuacaaaagauauaaaaauuagccaggcaugguggugcgcggcuguagucccagcuacucgggaggcugaagugggaagacugcuugaacucaggaggugguggcugcagugagcuaacuucaugccacugcaguccagccugaguaacagagugagacccugucuccaaaaaauaaauaaauaaaaauaauuuuuaaaaaguuuaagacuguaauuauuuacacaugcaagauuaacaauaauuagauuagggauacaaaacaacugacacuuguccuacaacgaugguccaaaauacauuuucauuuugacuuuggcagacauuagaauaagcagaggggugugagugugugcaugcacacacauuagcuuuacacugauauuaaaauuacucaaaauuaaauucucuaccuguacuaucacacuggagauuaaaaaaaaauccucuaccuguauauauaacuggacaaggauuuuuauagauuuuucaagaauaugugccaauuguggaagauaaauauacauuauuuuaauacuguguaacuuaaauaauaggguaaaaccuguacauuaaucaugaccagagauggaaugagaggcaucugcagaagagauaugauuaagaacaaaucauuuaagcugcaucucuggcucuucaaaauaaggaaaaugauaccugguccaccuaccucaaaaagagcucaugagacucaaaugagauaaugcacaaguucucaacuguuuuucccucuaaaccaccagagggauaugacauauuccauuaguaaccauagcucucuaauacgguaauuugggagaaacuuaagaaagguuccaaggcaucuauccuaggugauuuuaauaucugagaaucacugaaauagucuucucuggaaucuuucuucagauuuuaaaguucuaugcaaaugcaaaaucuaucauuuuggcaacgcuucaggcauugacaccuuuuagaaaauuccaccucaccaguuaauuuacaaucuuuguagcauagccuacacuagauuggauucuuaaaaagaaaacaugaagaggggaagaaaacgaaaaucaaaguaaaacuaaaucaaaacaaacaaaaucccauagcccauauucaaaaaucagaaguguaaaacauacaaaccuaaaaucuuugacgucugcaucaaucccauucugcacugguaaaccauuggucuuguccaucacaucacccuccuccuucaaaucuccuagcuuaucuccaucaaacguacccuuguucuucuuuucaccuuugucguuuucaucacugucugcaucccuugggcccuguuuaaaaaauagcuucagcuucacuaaucgucaucaacuaauaauaacgggcaaccguugugggcaccagacuacacuagaugcuacucagaagaggauaguguugugcccuuucacacauuacaaucuaauuaacaaacaacacagaggcaggaacacugcagaaggucuugccaaaugagggagacagacauacauuuauguuacagaguucagaacagucuuacuauauccaaugucccaccaacccauuuucuuccuuccuuuuuuuucuuccuuccuuuuuuuucuuccuacccaaagcccagccauaacuuugcagcucuuggucaaguucucuacucccaaaccuaacucuguauaauagcaugacucuuaauaagccccagguaugacagcuaauagcauagaaaaaaaaaauuauuaagccuguaaaaagaauuucauacuucuccacugcacuauguaaauuccucccuuacuucuaaauauugagccaaguguggucuaacaucauaucaacucaauuauucuguaccugaucuugggauauaugcccugucaauuugcaucaccucccagcucuacccuauaagccucacagguaugcaucaauucacugaugacccuuaaauuuuuuaaugccucaaaacaaguuaacucugagauucuuucaccaaaaguauucuaauaacuaucuucuaccaucuacugguaacaaagauuauucaugagaucucuaagugggaguauguuaaauugaagcauuugauacaaaagaauuucucucugaagugucuaucuccucuuaccgacaucccaaguuaagcccuggacauauaaaguacauguaccuugauuuccaaaggaaaagauuugguauagugacuugacauaguacagagagauuugcagaaccuuacaccaaaggguuaaggguuuaacccuuuguucuuguaaaacuagagggaagcagccuugcuuuuccccacgacugacuccugguuuaaggaagagaaaugcacauggaccaaguucaaguuccugguacaaggcaagauccacucaauagaagaugagaguggcugcaaagcauucccagucaccaaaaccaaaugucaauggggagaaaucaacaauggaggacacagcagcagacacucgguuauaaauagacugacuguggacaggccuguagauccaaaaccaacagaugcucuuaagagaucacuggcccagaaaggcugacauucuuaaaccuuucaacuacuacuuuagagcccauuuuacuucuaaaguuauucucuguucaaaugugauacagaaaaagauaauauaaaaaaagaacaaauaugacaaggaacugagaaaggauauacaacuuagcuucauguggcaucaaaacaguaaaccacagcuuugacggccauugagaugugcccuucagaauagaaucuuuaaaguauguggcuguuauugauuuaaaaggacugaaugauaaccaauuaugcaccacauugagauuccucaaagcagagauaggaauaugauaggguucuaaaggcaaaaagaucuuucaaaauauccaaaggcaauagcuuccuccauacugcagaggcaaaacugacuaaagcuguguacucauuuuuauaucccuagcacugacugcagugccugauaaaagcucaauaaauaugaugaagaaaauuaaaaggaacaaaaaaaucaugcaaaacugaacuguuaaaauaagaaugaucuuccuguuguccuuaucaucauuaaauaagaguccuggaggugguaauauggucuagaugacaacucugccugaaucagaaaccauuaaugucaacagcaaaagaauauuacaagaaucaucccacugccacgccuaagucaucaucuuccgcagucuacaaaucaaaucacuggcucagaagaaacaguucagcuccaauuucucaaaaggaguucaaaaggucuguaggcaaaaauggaaagaaagggccaggcgcaguggcucacaccuauaaucccagcacuuuggaagggcaaggcaggaucacuugagcucaggaguucaagaccagccuggcuaacauggugaaacccugucucuaagaaaaauacaaaaauuaggcagcaccugaaaucccagcuacucgggaggcugaggcaggacaaucgcuugaacccaggaggcagggguugcagugagccaagaucacaccauugcacuccagccuaggcaacaagagugaaacucgucuuuuuuuuuuuuuuuuuuuuuaaaggaaagaaaggaggauaaagcagcaguaggaaguuucaacaacaagcaagacagcugguugcaggggaugugcacuagucauaucaaugcucugcauuaucuuuccucaggggcucuucacaagggcuuuacugagaaccugcucagcucuucuacaugcugacuggccugaaaucucuuuuguggugguggugguguuuuuuaagacggaaucuugcucuguugcccaggauggagugcaguggugcgaucucaggucacugaaaccuccaccucccagguucaagugauucuccugccucagccuccccaguagcaaagauuaccggcaugcaccaccacgcccggcauggccugaaaucuugacugcuaaguuacacuuucagccacuaauuuacauucucaguuauacugccacgggccagauuuucaaauauuucccugcaauguguugcauuuuaccaauaucguacaggccauuccuacaaaauaccggguuuucuacucugaauaagcuauugaugccuaaccaaaauggugggcuccuucuuuuagagaguggggaacccaagggaaguuucuaauucuugaucugggaagguguuauauggguguuuugauuuugcagaaauucaagacgaacauuuauggcucguacacuucucugaacauaggucauauuucaauauaaaguuuacuuaaaagaaaaaagaaacucaagaaaucaacaauggcccuccauaaaaauggccagcagaagucugacuucugaguaaaaacaaaagcacaaauaggaaaccauucugucaaaagucuguuauuaagagauaguaucagcugcacgcaguggcucaugccuguaauccuagcacuuugaggcagaagcggaaggaucuagguugaggccuagaguucaagacaagccugggcaacacagaggagacgccaucucuaaaaaaaaaguuuuuaaaaaaauuagcugggcaagguggcaugcgccuguaguccuugcuacucaggaggcugaggcaagaagaccacuugagcucagggguucaaagcugcagugagcuguggggugggcacuugaucuacuccaagaauagauaaaauaaaggauacgaaaagaaaagaaaaauaaaagacuugacugauauuuugagcucuccuguuauucugaaagcugcucuccugaaguuugagauuccuauggggaauacuaccaaaaauuuacagugaaugcucagaacaaaauaugcacuggcaaugcacuccagucuggggacaaagugagacccugaguuuauuucauuaauagacagcaguaucagguucaagauccuuaaaauggucucuuaaaaacaugaagacccuaaagacaauagaagaaagguauaaaugggcuaaguuuuaugaaaauuuuacacuucugaaaaauauuuaagauaaacuauucauagcugugugguguuuuuguuuuuguuuuuguuuuuguuuuugagacagggucucgcucuuucacccugacuagaaugcaguacugcaaugaugacucacugcagccuugaccucuagggcucaugugauccuuccaccuuagccucccaaggagcuaugacuacagaugcacacaccaugccuggcugauuuuuauauuuuuuguagagauggggucuugcuauguuucacaggcuagauucaaacaccuggcuucaagugauccuccugccuuggucucccaaagcucugugauuacaagugugagccauaacaccuagcccagucuuuuaaaaaaauacugaacccgccaggugcgguggcucacaccuguaaucccagcacuuugagaggccgaggcaggcggaucaccugaggucaggaguucaagaccagccuggccaacaaggugaaaccccaucucuacuaaaacuacaaaaauuagccagacgugguggugcacaccuguaaucccagcuacucgggaggcugaggcaggagaaucgcuugaacccuggaggcagagguugcagugagccaagaucacacugcugcacuccagccugggugacagagcaagacucugucucaaaaaaaaaaaaaaaaaaaaaaaaaaaaaaaaaaaaaggugcugaaccagggugcacagaaccuacauucuaucucaacugcuaacacuuacuggucacaggacuuuggacaggucauuuaaucucugagacuuuguuuacucaugaauaacaaugaaauaaugcaugccuaaaaguuuuauaaagauaagccauuuuacacaaauguaauauaauaguaauaaagagacgcacugggaugguguuucuuuguaacacuauacaugacaucaagaauaaaaaucuuaaaugucccaauuaagugguuuaaaucucaaauacaaguauacggccaauauggcccucccaggggcauugucauuugcacaaagcagugguucuaugauuaggguuaggcaucgcaaucuuuuuaaauucacagguggcugggcccacccucugcaccagagauugaucugauuggucuguagagguuccugcaaauguugugaaaagcuucuccucaaauagcucggguaaguauccacaauugagaaccaagguaauuaaaugcaacauaagcaucagaaaggcaugguuugugauuugcuuuuuuguuauauauuaucaaguacauacaguacuggaaaagucuauuagcuaaaugaauaaaugaaaaaggcuuaacagcaucuuuuaauuaugggcuuucuuuagcugaauguuaacccaaagcuauagugcucaaauacaaacuucaguaaaaugcucaaauugcaaguggccaagcccaaucaaaaucucaagaguggaaccaagaugggugcugagagaucccagaccuacagagaggcagagaaauugcuaaauaucaaagaacugggagaaaagcagacguagguagaacuauauauuguugaggucagaauccaugcacuuauggcucaacuuccucaaaagacucacauaaaggggggaauacuuccuaauauaccuauuaauucugaaugaagucagaagauuucaaaucuauuuacuacucuuacugccgugaucuuaaaagaaagcuucacacagcagaagucauauuuaaugggauuagucauuuuccucccuucuuucuacaaaguauuuuauaccugcuugacacacugaguccaaaaacuauaacaauguuaacuaaaacacugguuucuccugcacacacuuacccauuuucacaaaaugccauaaaacugaaaugucugauuccuuugaaguacaacaaugucgagcucuacugguaauuuaaaauuucaaauauaaauuagcugggugugggccgggcacaguggcucacgccuguaaucccagcacuuugggaggcugaggcgggcggaucacgaggucaggagagcgagaccauccuggcuaacacagugaaaccccaucucuacuaaaaauacagaaaaauuagcugggcaugguggugggcgccuguagucccagcuacucugcagguugaggcagaauggcaugaacccgggaggcggagcuugcagugagccgagauugcgccacugcgcucuagccugggcgacagagcaagacuccgucucaaaaaaaaauaaaaauaaaauaaauaaauaaauuagcugggugugguggcacaugcacuccuguagucccagcuacuggggaggcaggggcacaagaaucacuugaacccaggaagcagaaguugcagugagcugagaucacaccacugcauuccaggugacagaaagagacagaaagagauugucucaaaaaaaaaaaauucaaauauuaaaaauuauaaguuugaaacugcuggccaugugaaauacuccuuaauuuaacauauuaaaucugauccuuuugugaggauuccuacucacaaacaaugccaguauggcacaguugaaagcaauacagcuaaaaauugaaauuagaacaaacaaaguuugaauucagccccccauuuccccucuaagacucaguuuucucaucuauaaauuaauagagacaacaguaucuaccucaaaguguuguuccaaggacuaaacaaagaaauucaugaaaguacaguugucuuuuuaaaaaaauacuuuauccaauuuucacauuuuuuccccauugccuuuuucacaaugcccucaccagcccuccccaccaaggcuuaaaaauugcuagacauacuauguuuuuuccccuaggaaacuuuuaaggcucuaaucauuagacucuuuguccagcugaguuuucugagauaacgcguaugauagcagugcuuaucaaacuuuaaugugcauacaaaucaucuggguagucuugucaaaaugcagauuuugauucauucgcucucagguaugaucugagauucugcguuucugauaagcucccaggugaugcuaaugcugucggcccacugacuuugguaguaagacuucuaauguuuacaaagcauuuucacauaugcuacacagccguaugaauuagacuuuguugaguuuugauuauucucauuuugcagaugaauuaagguccauuugaaacucaaaccccugauuucuaucugcauuacauuguacagaaguuuucaaacaaaaccuaugaaaguuaaguagcacugguuaccuaaaguaaaugcagugaaaccuagacaaacaaguuucacggcccaaauagauguauacuacgaauguguauacauccuccagaucaaaaagcagauacucucuacagaacaaacagaaagaccuucccaauauauuuuuucuaaaaaucuuucuucugugagguuaagguggucauuacccuaaucaaaguuuagagugaucuucucauuucccugggcaccauaaaccagcaagguagaaaucaugauccauuuuuuggcuggcuaggcuuccaccuauuugaaaaagaucagcugguauuccagagagcaggguccuuagauggcaaucucacccaugggccucaaaaauaaaauaauuacaucugauuuuguaaccacccugaaccauggggggcuguggggugagcaccuguucuacuccaagaauaaauaaaggauacaaaagaaaagaaaaauaaaagacuugauugauauuuuugagcucuauuauucugaaagcugcucuccuaaaguuugagauuccuauguggaauacuaccaaaaauuuacagugaaugcucagaacaaaauaugguugccagauucuucuuguuagccagaauguauucuuaucacagaagccaaaaccacuaaacugagaccauuuguacaaucaaaaugaauucaagcuagacaaagagcuaaacagcuucaaucuagccauaaccagcaaaguucacugaaaaugguaaaacacuacauagagauuuauuuuaguucuaaacaccuuuaccugaaaaguuaaagucucaauuaucuguugucaguguguuaagaauaacuucuuaguuacuugcuuugaggucuacaaucacuauaccaucagagaugaugcuuucagcucucaggauuaaagugaggcuuacuggaauuaauguugauacagcuaccccaaaaguaaaaauacguggaugcccugaccccauacacuaccaaguaccacuccuccuuuagaacaauuaucuacaagaagcagaaauccuaucuuccugguucucugaauucaacacuuuaaaugacagacuagacuuuaaaagaaaaggcucacuuuccucaagaagauguaugcauacuaugacaaaaauaaagugauucaggcuuccacaaaaagagcuuuggucaggugucauccugaccaacaggcagagcaaagucagguuagguauaaaaucaagaggauacaaccacaaagcugauaaucaguucacuggccgggcgcgguggcucacgcuuguaaucccagcacuuugggaggcugaggugggaagaucaccugaggucaggaguuugagaccagccuggccaacauggggaaaccggaucucuacuaaaaauacaaaaauuacccgggcaugguggcaggcaucuguaaucucagcuacucaggaggcuaaggcaggagaaucguuugaacccuggaaguggagguugcgaugagccaagaucaugccauugcacuccagucugggcgacaagagugaaacuccaccucaauaauaauaacaauaauaaucaguucacugagccacaggucuccauccaccagaagacuguauaugccaacaaguggcuugaugucacuagaucaguccucuuguaucacucuauagaugcaaucuaagucaaacuaugggauaauauuccauuacccacaaucuuccuucuaaaagaagcuggaacacagauuuggagaauuuucauuuaucuucaugcauacuucagaauuuucauuuaucuuuaugcauaccucagcagcucaguaaauuaucuugaugguuaaaguccaaucuucuggccccaucuaucuagccugaagucuuaaccuccucugucacgauucuuuuguaaaagagguaaaucaccagucucccaagacaaaugauacagcuuuugucaucaaaauaaccgucuagugagaugacuguuuaaagagagaaaaauaaguggcaaaaugauucaaucccaccauguaucuuccuccuaauuccaacuauuuuucugccuccuacaagcuucacaguaaugcaggcacaugccuccugguuagugcccaagaauuagaaacugaucacacacaugacagagaauucacagcuagagucacagguuccaguucaccacacuagcaaccuacugaugcacaacacuaauuucugcugaggaaucugugcucauaagaugaggaaagagugaggacagaaaaagaggugagcuggggauagggugaagaaagagaaguaacucacauccaaaggguagaucuuguucuucccaagcagccccuugggaagguucaaauaacaggagccaucuccuaucugauucacaagcuacuaaaccugaccuaggucucugcagggucaaaacacugaaaagcaaucaggucagcuuuagaauagcuaguacuuaagaacuguacuugacacuugagaaagcugcaccaaaaaugaacuacuguuacucuaacaaaauuuaauguggaauagggaaaauaggaccaagccucugauacccagcaaaagauguauaacacuaagaaauacugagcaacaaaugcuauuaaagaaagacaguuauaauauuaauucucaauuugugggaaagaaggugcuucugcuguucuuucccacaaauuacauuaaaaucuuuuaaaugacuguuuucaggugauaucagcccaaaaugacugcagggagaaaugucuuugaaaaaguacaaaacaaguuuagacaggagaaagggagggaagaagauucaugugccucucauggccuuccugucugugaccuggaauaugacaacagucgcagaauucaaaaugaggaagacucaaauggaaauacaucuuaacacuucucgaucuagaaaguuaaugauaaagaaagaaauuguuuugagaaaggcuaucacagaugcucauagaaaaaugcuuaagacuuaaaaagaaaaaggcuauagacacagagacuuauuugacuucaguuuagcaucagagaggucagugauaaugaaucaaaaaaauuuguaagaaagaauuaacagaaucccuaauuucuugacaggccaggugugagaaacaaagccguucaaggagggccaaagaggauucuauaauuaaaucguagcuaacaaaacaagaauagcccuauaaucugaucuauauuaagguuucucggguauuggcaaaucacugcucucaaaucuggaauucccuguuaacaucccagcaucagcuuuauuuuuuuaauuccuucaccaccccccuuuugcuuuuauuuuaaaguaaaaaugguguuuucugauagaccaaugaacuuugauccagauuucaguucuuaucucacaauacuaucaauguguccccccaccaaaacauuauuacuuuaguuuuuaaaaguugaguuuacaucuccuacuauguuugcugaguucuauuuacaacaaacguuguuugaaaauacccuguaauuaaugcugugaacaucuaaggaaacuaaacaggcauguuuugcuuuaggggaaaaaaagagagagagagagagagagagagagagagagauaggaacaaguuccucaagccaacuuacaaauccuccuuuucuuagacaggaaucgcccggggaugagcucaacacauacuccaccaugcuaacgccuagucccccacucuccgaucguggggacaguacagaauugaccucacuguucacauggaaacucugaccaggucuucucugcaccaugauuggcugggaaacugaaugaucuacaaaaaagauacacaagcaugauacagugcagccagaggcucaaacaaauuaugagugaugucucauggauaaccaauggaaucaggaaacuugccauggucaguugagccaaaaccuccuaucaugucccucacuguaugauauucaacauaagcuaaggaaauggaacacacuccucauuuauccaggauagcagaggaauacaacaguuuaucuagcuuaucugguuuaacuagcugaguggauaaaauuuuuaccccuuuauaaguaaaaggauuucuuuuuaauauauuuuauuaguauuacuaaaacaaaauaugauuuuacugcccuuuuuaaaaacaauauaauuuguucuuuucugauaauucacugucaucaugagguuccaugcuuacguuguacuguaauacacgacauuggcuuuuggguuuucugucuccuuccucccuaucaucugucacuuuuucugcugucagugugucugccucuauaaguucuccccaucccucuucagggguaguaugccagaagaauguccaugcccagugacuugauuuggucccaaucacguuuaaagauagaucauuccauacacgguacacaagggcaaggggagaaaaagaaacaugaacuucaaauggcagguguggauuuucuaauuccaaguaugcugacagcaguacagaacaaaacguuacagcugaaauuauggucguuucaaauaagaccauuccccuguggcuagcacuucaaaaaauauugaagauaugauuuuguguuaauuauguuuuaauaaauuacaucauauaagcuccuuaauggcaauuauacuacaggagaggacacugcuugacaugcuuaugucacugauguaaaauucaugacuugccaauugcugaggaaaggagcucuaagacaggcauaaaucacaguacagaugcuagaucuagauuaccugauguuccccaggcacugucucgccauugaucacccaggaauauuccuuuugguccaucuuugcuggauucaucuguuucccaaaacuuuuuaccuggcaagagcugcugcaaauuaaaaauaauagaugcuuuuaaagaauucauaaaggaugaaaguacagcagucaacacuuucuuuuagacaaggguacugaagaugcucacgugcccugaaggucuuuaauuaaaguguuccaacuacacaacuguggucagaacacugcuauauauuugguaaaagucacagagaggccuaaggcaagguggggggcagggguggggacacugaucaaaccauccaauagaggcugaacuuaaauaucuagaauuacucgcuuaacccaugccaagauuuuuaaggaguggggaagggaacuaacagugacccuauuagcuaacuacuaaguggacucuuacugaaaaagaaaguauuuacaacuauuaaaacacuucucucuauacguguacuaacuaccagacaaaguuacucaagcuggagcaugaaccagcuaugaaccucagcuauggaaugccagaggcaaaauucacuuccuuuauacacagagacuccauuaaccaaaauacuucccaaccacaacacuaaccuauuccaagauuuuggaaggacagaaaagcuauuccuucauuacuggaagggaaauaaaaucuucuaaccuccauuaauuuuuuaacaauacuugguaaugccauuaaagugacuucacaaaucacuccaugcuucagagaaacagggaucgcuggccauaagccaacaugagaaguuuauacuagcuucaacaaaaaaaugcaaaguacccuucaagcaagacacaguacaguuuugcauaagaucaaagcaccagugaccaggcuuacaaaguaaaauuccacagaacucuaucauucuugguucuggucaucagcuuuacugacuaaaaugcccccucuuauuuccucuaauuauguuuucaacugcuauuacacaggaaacuaagauguuugagauaguauuuaaccaccauuuuugagcacaaaaauaccuggagaguugaauuucucagaagaacacaauaaaaaaccagaaagcacaaaacauuuccucuccuugacgauaaagguuuaacuuucccauuuaacccauaacccaaugauaauggaaaaauaauuaaacucugcucucacuaaaauaaaucucugcuucccaaaucuaauuucuggguuucucggcauaauuuucaucuaccuuuaaguggcucuauaaucuaucucauggacuuggguuacugccuggaccaaagcaguuugccauacauuuugcucuuaaggaccuaauuuguuguuuacuaauuaaacaagauugagaaaaaaaaaaaacauuugucugguauuuaauugcacagauaccuaaguuuccuugaaaaugaacaguuauaaguagcagucuuccugguguaccacuuauuacccuaagggcauuugggggagggugaggaucaggguaaaaugggaaagagccccgaucgaggguagcauuagggucgggaagcacuaaacuggacaacuuugaagugcccuaggaaaucuuacuaaacugcccugaaccucauucucuuuuuauugaugaagaaaauaucguucaaguugcugugaugauuagaaauauuguugaugagugccuagcacaacagguucucaauaauguauucaaaaacaucacaccuaggcaaaacagcggucaaaccaggucacagaggggauacugaaaauuaauguaaacuaugcaaaggacaauucaauaauuauuuuuaaacuuauuuuucuccuuuuagucucaaaaauguccuguccccugcaaggccgggcgcgguggcucacaccuauaauccuagcacuuugggaggccaaggcaggagcaucacaaggucaggagaucaagaccauccuggcuaacacagcgaaacccugucuuuacuaaaaauacaaaaaaaaaaaaaaaauuggccgggcgugguggugugugccuguagucccagcuccucaggaggcugcggcaggagacuagcuugaacccaggagugggagggugcggugagcuaagaucaugccacugaacuccagccugggcaacagagcgagacuccaucuucaaaaaaaaaaaaaauccuguccgaagauuacaaauaaaauuucuuuccucauugguuauacccuuucuccaauuaaaauucugauuuuuuuucucccguauuuugugcaaagcaaaagcaacuacucuuuuguauuccagaagaaagaaugucagccuaaggagggucucacuuguuuuaugcuccacauaacagugcaaagaacgcuaaggugaucaaaaccauucuuguccuuuaaauguuuuaagaguucauuccucacagaaacuuguaaauguuuauuuaaaacucaaggaacagggcccagcaugguggcucacgccuguaaucccagcaccuugggaggcugaggcaggugaaucaccugaggucaggaguucgagacuagaauggccaacauggcaagauccccgucucuacuaaaaaacucaaaaauuagcugcguauggugguguacaucuauagucccagcuacucgggaggcugaggcacaagaauugcuugaaccagggacgcagagguugcaaugagccaagaucacgccacuguacuccagccugggcaagagagcaagacucugucucaaaaaaaaaaaaaaaaaaaacaaaaacagaaacaaaaaaaaacaccucaaggaacaguuuccaaaaguaccagccuccauauguaaauauagucuuauccauaauuuguaaaauugcuuacagaaagcagcagccuuucagcucaaggcuucaaaaaucaguucugggauccugucaccuuucaugauaguauaccaggcugucauaaugugcaaagccaggagaagcaggugaacacauaagcgaggcuauuuucaggguaaauucucucaaaaggaaacaacaauacagcaaacaugaagcaaagugcuauuagguuggugcaaaagugugguuuuugccacuauggcaaaaaaaaaagaaagcaaaagacugaaccaaggugcuugggcaaagacagaagcaaaauuagcaaagcucuuaaaagucucugaaucuuacucagucuuucucccuuuccuccaaaacauaugcgucuauacucaacugcugugguuagcagcaucugaaaugacucuuaaugaucuucacuuacaaguacucauacccugaguaauccccuuccccugacugugggcuagaccuaugacaugccucuaagaaauaacauaagacaagucaugggauguuccuuucaagauguuacaaaagcugugauuuccaucuugcuuguccucuucuaucuauuguccugauugcuuacucugaugaugacugcugcuauguugugagcugcccuauacagacgccacaugaagccaagagagagacaucucuggacaacagcuacauauacaaagcuguugcuccgcagcuucccacugaacucugccucugcccugggucauuuacacacaauuaagaacugagauccuccguccaacaaccagcaaagaauggauucugaugguugauaccacaugagugaguuuggaaacagaccuuucuccaagcaaguuugagacagaccuuucuccaagcaagcuuugagaugaaugcagccaaaguugaaaucaugacugcagcuugugaaggacccugaagcagaugacucaggaaagucaugccuagguuccuaaccuauagcaacuaugaggcuuaaacaacugucuuguuuuaggcagggcgugguggcuuacaccuguaaucccagugcuuucuaagggugaggccaggagucuaagaucagacuuagcaaccaacauagcgagacucuagcuuuacaaaagacuuuuuaaaaaucaguccggagugguggcacaccccugcagucccagcuacucaggaggcugaggugggaagacuccuugagcccagagguuugaagcugcagugagcuacgauuacacuacugcacuccugccugggcaacagagugagacccuaucucuuaaaauacacacacacacacacacacacacacacacacacacacacugugcuguuuuaagccacuaaauuuuagggugauuuguuaagcagcaauaacacuguugugaauauguggaaguauuuuuguauauuugaaacacuucuuuaggagucuguuuucaagaaacacuucuuguuccauuucuaauauuuaaauguaagugaugaaacuaaaauccuuuucaauugaaaaaaaguaaaagacuggcuuuuuuaacucggcaaaaucaaaucaauuuagacauguugagcuuacugagaauuaguagcaaucacuuauauucaacagucagcuaaaagauaccuaacuguucaaaucugaucauauuaaaaggaguuagaaacuacugaauuauaaaaccaaaugauaauguguuauccaaguacaauuucaaauucaacaguaagcucucuggagguaacaucauccacagcguuggguaaaauauccuaguuugccaacccacuggcauaaauaccagcaguugccaaaucuucacuuaacacacaauaaccaaaaauguaaaugcauccaaccuaugaaaagauaguuccuauccaccccaucaagaaucuggaaauaaagacuaguuuuuuugacaaggcgaaaaguaacagaucacaagagagauguagaguuuguuuuaaagaauaacuuagcaguaagaggauuaaaugaugugacaauuccaaaagaagauaacaggaauuaggaauugguccaacaaaagcaaaagagacccaaggaaucagauguagccaguauuauccaggugacacauuuaagggcagggcauaugaugcacaaagaagccuauucuuaucaaagcaauuaaugcaucugguuagauaguagcuuaauuacacuggacacuaaaaacacccaaguaaucucccuggcuccaacucugcuuaccaagccaccuucuuaaagaacuggcuuccuccuauagccaaccaugccaaucaccaaacacaaccauccuuguccaucuaagaguuguuuuuuuuccuuaaaaaaaaaaaaucagcagacugcauuuugguuuucauacauuagccucuuguuguucugguuaguguggggucaauaucgcaacccagucaucugaauuaguaauaacaguccauuucaagaucuacaaacugagaaccaugacuuggggaguccuaucauccccagcaauaaaauaaauagaccuuguacucuuucuuguaaugaaacauuaaguggaauuccuaacugccccaccaauagugugugcucucaaaucucugggagaaacacacacacguacacuguuuaucccacccugaaucguaaguuuauaaaauaaaaaaacuuaugaaaaguaaaaaaaaaaaaaaaaaaaaaauucaguaagcuuaucuaugaggcuucuggaaaacaaaauagaagucaagcacugguuuacaagcaaugucagccacuugagacacuucuuuuaaauuugucuggaaacaccuuuuuuccuuuccaucuaacaaaaaagaacaauacgcaaaaccacacuuaacacuuaacaaucaaucaugucauaaaccccuacaccaagaacccuuaaaacauggauuaagacaauaaaaaguggagaauaucaagaaacucuaagcuucuuauuuuaagaacagugauaaagacccaugaaugcucugaaaucacuuuauuuuaaacuaguuuuaaaucccagcugugugaauuuuauccucuucugcuuuuucucaccuauaaaaugaccuauuguguacaaugaaagagauaacacauguaaugacauaauacaaugcugaaacaguaaacaaaaaaucagcuacuauccuucuuuaaaagagcaaaguagcagccaauagacaucacaauacuaaugauuugucaaugaaaugcuccuaugucaaacuaucagacacagugaucauggcaucaccuaggccaugucaguacaaaccucauuacauuaacuaccccaacaaaacaacacuacaagaaccaugauuacggcuuuucaggaacugcagaggcaagacaauuauugccuggacuuguuugaccauaccgccacuaauauuugaauagggauuuaucaaugagguuuacugaugaucucaacaguaaaagggcucuccagcaacuacucuguacucaaaaggaauaaaauauuagguaacugcuuacacacucaauacaggcugcacagagcaucucucagagcagaaauugagcaucuuaagaaauacuacuaacauggauguuacaacccugcagacgugaucaguuugaucauguuauuaucuagcaucucuaacuuacaacacaagcuuaguuucacuggaaugcagccaaugcaggaaacaaaugcuugauauuuaacuagcugguaagacagaccaacaaccaaaacaauuauuaaucucuuaguauauaucucaccacacucucaguacauuaagagaagaugacaucaacucagagaaaggaccuuucagaacuaacugaaaugaggaaguuugauugguaaccacugauaaucacaggugguagucuuacuuguaaaaauuuuguauuuuucacaacuuauguagucucuccauaccacagacuguuguugugaaaucaagugagauaguauaugaagugcuuuuauaaauacuaagaacuauacugauauuaaguuauacuaaagcuuuauuuaaagcuuuaacuuauuaaaacauaucuuuaagaaaagccaaguucauucauuccugguuagcguaauucuuuuggaagggccucagaaacuacauacguaucaaaagucacagccagguaugauggcugauuccugcaaucccagcacuuugggaggugaggcaggaggauagcuugagucuaggaguuaaagaccagccuggaaaacaugugacagcccaucucuacaaaaacuuaaaaaagccaagugugguagcacaugccugugguccuagcuauucaggaggcugaccuaggugggaggaucaccugagcccaggaggucaaggcugcagugagccaugauugugccacugcacucuagccugggcaacagagcaagauccagucuccaaaaaaaaaaaaaaaaaaaaaaucuacauucaaagugcuuguaaaaauaaaaaaaagucgaggcuggaugcaguggcucaugcuuguaaccccagcacuuuaggaggcugaggugggagggucacuugaggaguucaagaccagccugagcaacaugccaagacccaaucucuauuuuuaaacauuaaaauuaaaaaaaaaagaauuaaaaaaguugaaaguaggccuguaaucucagcacuuugggaggcugaggcgggcggauugcuugcggucaggaguucaagaccagccuggacaacauggugaaaaccugucucuacuaaaaauacaaaaaucagccaggcguaguggccaggcgccuauaaucccagcuacucgggaggcugagguagcagaaucacuugaacccaggaggcggagguuacagugagccaagaucgcaccacugcacuccagccugggcgacagagcaagacugugucucagaaaaaaaaaaaaaaguugaaagcaaacugcaaacuaaguauucaacaauaaauuagcugugggccuggugcaguggcccacaccuauaaucccagcauauugguaggcagaaggaucacuugaggccaggaauucaagacuagccugugcaacauagugagacccugucucuuuaaauaaauaaauaagcaagcaaacaaguuguaguacaacaauguaagcucaccaaaaauagccauaaugacuacauguaauauuuauaaaauaacauuaaauuuuaaaaguaaaauacaaaauuguacauguaaagacugcuucuccucaugcauucuucccuuuuggaucaagacuggaaagaaaaauaaaagcagaagaguguuuguuagugcacugggauuguggauuacuuaauucaaaauauacuuuuguuaugauuuucaacuaauucucuaauaaauaaaacugagauuaugguggucugaaauucacugcaaauaaauaaggcauaucucucaagcagauacauuucacuucaacauaauuucauuuucuuuuucuuuuuuuuuuuugagacggagucucgcucuguugcccaggcuggagugcaguggcaugaucucggcucacugcaagcuccaccuccuggguucacgccauucuccugccucagcuucccgaguagcugggaauacaggcaccugccaccacgccugacuaauuuuuuauauuuuuaguagagacgggguuucaccauguuacucaggauggucuugaucuccugaucucgugaucugcccaccucggccucccaaagugcugggauuacagacgugagccaucacgcccagccacuucaauguaauuuauuuauuuuucuuuuuuuuucuuuuuuuuuuuuuugagauggaguuucucuauuguugcccaggcuggagugcaaugaugcgaucucagcucaccgcaaccuccgccuccuggguucaagcauuucuccugccucagccuccggaguagcugggauuacaggcaugcgccaccauaccuggcuaauuuuguauuuuuaguagagaugggguuucuccauguuggucaggcuggucuugaacuccugaccucaggugauccacccgccucggccucccaacgugcugggauuacaggcauaagccacugcgccuggccacuucaauacaauuucaaaagggcaaaaguuaauagcaauuuuaagaagagagcucauguccuaaauuucaaauauuuuuaagcaagcugauacaggcuuagcauccuuaauccaaaaaaaugcaaaauuugaaaugcucuaaaauccaaaacuuuuugauugccaaugugacagucaaaggaaaugcucacuggaucauuucagauuucacguuuccagauugggcuguucagcuaguaauuauuaugcaaauauuccaaacaucaaaaaauuccaaaacauuucuggccccaaguauucuggguaagagauacccaaccuguaauaaacuuccaacucauuuugaaaauuguugcuuaaauaaggaauguuaaaaauguugaguguuccaucacaagccaguuuuuuuaauuaaaaauaaguauauaaagcaaagaauuuuuaaguuuucaccuucucuuucagugaaggaauaagaucuuccaaauucucguuuugcauuuauauauauguauauauucaugguauuaaaaauaaucuacauauaagcagagugaagugcauccacuuuaaucaguuacucaauacuuacauguaaagauguuaaauguuaaaauuuguguucucauuaauuuaauucaaaucaccaaaaaaacugucuaagaaucaacaucuccaauaauuuucuucauauuucucuacuagguaucaucacaaucuggcaugcaguaauuacugcuuaaaauuuuuacccuguuguuucaaaugguuacuacugaaaacagauuaccauagacaugguggugucuuaacaaaaugccucuuuuggcugaaaucuaauauacugcuuuuaaaaaaagcaaacuuuaaucuguugcauaauuauaauuaugcaguauauaaauuaacagauuuuuuaaagguuuucccagguuauuaagcaccuuuuauaagcacuguugauaccuguaucuaaugccuuuaaauaacacuuccuccacuaaggaugaaaucaaggagaucgcagaguauaggacaagaugagguaaucugaucuucucucccacaacugggaaaucaacacugcuuuucugacuauugaaaaaauaaauuucaguauuugaaguacuugcugaugcccaaaaguacuacuugcacacacccuaaaaugcacagccugcauuagccacuauuggaaaaaacaaaaaaagcaguaaaagacauucuuugcccugaaggaacuuaaaagauuaaaaagaaaaaccagagucaaacggacacguaauuuuaagauaagcacacugccuaauaauggaguauagacugcuaaaauucacaaccuacuacagaugaagaaaggaagaguaaccaaccacaccaaugaagaaaugaaccugggauaggauggucaagaaguaucuuaaagaaggggacagaauuuagagcaagcuuguccaacccgcagcccagaacugcuuugaauguggcccaauacaaauucauacacuugcuuaaaacauuaugagauuuuauuuugcgauuuuuuucuucuuuuuuuuuuuuaguucaucagcuaucacuagugauaguguauuuuauguguggcccaagaucacauucuuccaaugugguccagggaagccaaaagacuggacaacccugauuuagagugagugagacagugcaaaggaccuucuacaaugaaccaagguaggcagaaaugaaagcaaguggagcaggugcccaccuggaaacuggccaucaacacaggguagcaauaagaagagggugaaaaaucacuaaugucagcugucagugagacuacaaaaagcaccccuagggcucuaauccaauaggcaacaguaguaacauuauaaaauuuaucuuuaaaagauugaucugacaguccuccauaaaauggggugaaggaaagcaaaugaauauugggagucuaagcaaagaggccaauguaguaauccagaugugaaaugguaagaaaaggaacuguggaaguaggggcaaggacaaaauugcugcugagagacucuuuucaaagcaaguguuuuuguuuuuguuuuuuuaagcuauauaauuuuaccaggcgcgguggcucaugccugaauuaccagcacuuugggaggccgaggugguggaucaccuaaagucaggaguucaagaccagccuggccaacaugguaaacucucaucucugcuaaaauacaaaaauuagcuggguguaguggcacaugccuguaauuccagcuacuugggaggcugaggcaggagaaucaucugagccugggagguggagguugcagugagccgagaucucgccacugcacucaagccuggaugacagagagagacuccaucucaaaaaaauaaaaaugaaaaaaauuaaaggcuggcgaggcgugguggcucacgccucuaaucccagcacuuugggaggccgauggaucaccugaggucaggaguucgagacccagccuaaccaauguggugaaaccccgucucuacuaaaaauacaaaaaauuagccaggugucauggcaugcacccguagucccugcuacuugggaggcugagacaggagaauugcuugaaccuaggaggcggagguugcagugagccaagaucauggcaccguaauccagccugggugacagagcaaggcuccaucucaaaaauuuuaaauaaaguaaaacaaaauaaaagcuauaaauuucagaagagucauugcccauuaugaugaucaagaaugaauucacuaaguauacauaagccagucuaucauuggaguucuuuuaauuaggaaucuauucugcagagacagcugagugcaaaagcuaaaugaaaacagaauccauuaagucuccugugggguacaugaagaaaaagaaaauucaaaaauaaaaaauaaaaacacaaacagauccaaaugugugcauauaguaucaaaaguuuaaguuuuaugcauucaaaggguauugaggcugcccugaagauccucuauaggcugcugggcgacaguaagagcaaaaagagcaaucaaguugagauaagaauuugguagcuuuuaaauuuuaggacaaccaggucgggugugguggcucaugccuguaauccuagcucuuugggaggcugaggcgagcgaaucgcuugagcccagauuuucaagaccaaccuggccaauauggugaaaccccgccuccauuagaaguacaaaauuagccaggugugguggcaggcaccugugaucccaguuacuugggaggcugaggcacgagaaucacuuaaacccaggagauggagguugcagugagccaacauagugccgcugcgcuccagccugggcaacagggcaagacucuguuucaaaaacauaaauaaauaaacaaauuuuaggacaaccacaaauuagauauuagauagaauugcaaacuugaugacuaccauuaaacuucaaaacgcacagggguuuccuguuuucugcacacaccaaagaauacaacccugucugucaacgacuucauccuagaaaccaagcacaucaaaagauaucauucauacuuucauaaagcaaguccauuaaagaacauucagaaauacuguuagcaccuuacacuccauguuauuuugucaugaauuaaccugaacaggcucccauacacgugcccuucugaaucugaaaguaaagguuucuuuauaccuucacauuuuguuaauggaacagagccaagaaacuucucuucucuacugucuucauaaaaccugacagacugacaguaaaguauguugauaaaaugaugaaauucccagagugaaucgggcuuuucugcaugauacaggaacagcauauaagggauguuauguuaucuacagguuaccuauaaauaaggucacguguuuuuacauaugaauaaacuacacaagguuuuuuuuuuuuagauucagagagcaaaugugcagguuuguuacauggcuauaauauauugugugaugcugagauuugggcuucaacugaaccugucacccaaauagugaacauaguuacccaauaaguaguuuuucaacccuugccucccuccuucccuuucccuuuuuggaguccucagggucuacuguucccuucuuuaugucuauguguacccaauguuuaguucccacuuacaagugagaacaugugguauuuggauuucuguuccagugauuaauucacuuaggauaauggacuccagcugcacccauguugcugcaaaggacauaauuucauucuuuuuuuauggguguagguguaccacauguuccuuauccaauucacuguugcugggcaccuaaguugauuccacgucugugcuauugugaauagugcugcaauaaacaugcaagcgcaagugucuuuuugguauaacaauuuauuuugacuacaugguuugaucuauagcauaaccacauucauuuuauaauagguauucacuuuaauaauuacauauuacaguacuugugagcccaguauacaaaagauaagcuccagaccccucaggauacuguaaaguucacaaauacaaugaugaaaacaucuagauugcuucaugacccccucacacccccaaagcaggaagcaaacagcccgacugagauaacaaagaauacuccacaucaagaugggaccaaauacucuaauaaacccacacccaguuagccucagggaauuuuaaauuuuugaucugaaaaagacaaggaucucaacccugaguuccccuuuuccuucauuauaggaaacaaauauuucauagauaugccugcuauguauauagggaauacaacacagaaaauaaacuuuugcuacaugcuucaccucaaugagaaccacaucaugcaccaauuaaucaaaauacaauggauuugcuuugauguuaugguuccuuauuagcaagguuacaguaaccaagaaggaauuacacacaacauaguuuaauaccagcuugagaaagcaauggaacaaaaguaauucuauuuuucuaaacaucauuaugucugguuacuguauauauaaugaggauauauuuccaugcuccaacagauggcccagagaaaguaccaucgaucuguaacaacguaacaacuauauuaaacaaaagauccuuuauuuaaaaaugccuuuauauaucggauucaauuuggguaacagcacugcugauuuauuguuugucuucuauauuuuugcaaaaguagcuaaugaauagcuuuuaaauguacauauuugcagacagccugaauauaugcuuucaguuuugucuguucuuuauucucucccuguacacuccaacaucccugagagcagaaaagucaugugaacagaaaauacaaccaauauuuacuaaauugaacugagcucccuugggggauagacaaggauaccaauuucugauguaaaaggaaaaauaaagaggaaacuaugcuuaggaaaaaauauuuacugauaugauucuuucaauacaauauauuuagcagcuauuguuuacaaagcacauuauuagcugaagccccacccucaacaaacuuuuguaugagaaaaaagaaaacaucaccauauauacacaaaucauuauguauaaaacaaacugggccaugauuguugaaacaguacuuuagaguccagcaugcaaaagauaaagcccagaccaucuggguaucaucuggggcuuugauaagccacagaucaucauuuguaucaucuuuguaagaauacuacaaaucacuugcuacuugaauuccccuucacagcuucuaaugggagggagcaaaaaagcuuuaauaggggagcugauaucugaagcuaaaucuugaauaaguagacugugaauaugcagaaaccaaccagaaaaacucaggauuugaguuauaagagaucuggguucaaacagaggcuuaaugauuacauuaacuucucuaauccuuguucaccccaucuaaaaaaaaaaggcaucauaauauugcaggaccacccuaaaaacuguaacauacaugaggugauuagcauaguucugggaaaauuguauacacucaauauuuuguagcuauuauuacuuccgagccuagaaaaaaaaaaaaaacagaauuugaagauaauccccaucuugacacuuaagaauuuagcuggagucauuuaaucuuagggcucauucugcucaucuaaaaaaaaaugggaauaauaccucucaaaaaccuacugggagauucauaucgauaaugauaucauauagaucauuauauugaaaaguguuaccauuuauuagucuucccuccaauaaagcaugcuaguauggauaaaagaguaacauuuuagccaaaggagguugaugaaagggaagaaauuuaaugaagacaaaguaagcagcauguggaucuucugcugcaagaguaugauuugcugcauucaaacauuccaagacagcuuaacaucuacauacaguaguauguuccuggucuucccagugcagguuagaagacagacagaagaaugggugggguuugcacauuggucucaaagucaggacagaccugggaacuacguuccaaaucaguuaugaccacauuuccuggguuagaaaacaccuucuccuaucucguuccucaaagugcccaaucccaaucccaaaauuauuauuuugggucccaggaacuuccucaaacaauacugauaaaaaggucacuuuaccucuaacagucauuaaccuaaaauaagccaucuaccaagaucuuguuccuccagaccacuuggcgugguuagcuguuuuuucuaaaauaaacauuucaagaacaagaugucaaaaaaauacccaaaaaacauaaaguuaagggaacuaggguguuuuuacuauuccuauuguacgugaaagcuacauuuuggcugggcgcagugggucacgccugcaaucccagcgcuuugggaggcagaggcagguggaucacuggaagucacgaguuugagaccagccuggccaacauagugaaacccugucucuauuaaaaaaaaauacaacaaauuagcugggaaugguggcacacaccuguagucccagcuacuugggaggcugaggcaggagaauugcuugaacccaggagguugagguugcagugagcugagaucgcaccacugcacuccagcgugggugacagagugaaacuccaucucaaaaaaaaaaaaggcuacauuuugaggaaaaaggggaauuaauuacacugcuuggucacauauuuuuauauuaauauaccucaaggcauuauuaauuuuucaucccuucagcaagaaagucuauaugauuuugcuggcagacaucuuuccaaaacucaguccauuuuggagucaacugugcugcuuuuauggcacccuaauugcaaagaacugccaguguuaauuuaagguagcccucccagagcuguggauucuagaaguacuuuuagcuauucaaaagccuccaauucuauuaagacacuguuugccauaauagaaagaugugggaaaaaaauuuaacagauuuagucuccauacuggagucaggcuaauacuugccuugacuccaguauuaccaucccacgaacucugauggacacuucagugucuugggcagcugcagacagugaauaagucacuuuaaagaacccaacgaagccaggcgcgguggcucaugccuguaauuccagcacuuugggaagccaagguggauggaucacgaagucaagagauagagaccauccuggccaacauggugaaaccccgucuacuaaaaauacaaaaauuagcugggugugugguggugcacaucuguacucccagccacucaagaggcugaagcaggagaaucgcuugaacccgggaggcggaauuugcagugagccaagaucgcgccacacuucagccuggugacagagcgagacucugucucaaaaaaaaaaaaaaaaaaaccccaaugaaaaguuacaaaaucucuaaaucacaggggggaaagucaaucuaaaaggauaucuuuuagacacucucuacuauauccuaaaaaggccagaacaauuccucuuuucuaucuuuuuaaagagagaaagaagggcaagcucccagaaucuuagaccugaaaagguccuaggaaacuaucuaguccaacaucuuugucuuacggguagaaaaaaguaagugcaaagaagaugaauguuugaaccuaggcucuaagaaguuguggcgucagaguucuggcccaauccaaugcuaccucuaucccaccaaauuuugccuuucuuuggauuaacagcucacccaaaucacuauccaauuccucccucuauaagccacucugcuaucccacaccuauggaucaaguacuauauaaugucuaaugagaauauaaagcuacaauuuaaauauaucucagguuauccuaauuccugugaauaagguaggauuuguuaucacucuguauauaggagcacuuucuagauuuccuuugucagguuuacaaacuuguuauaaucaaggguauguuuuucuaugcuucagcuuucuaagacaaaggugaagagucacauaucuaaauacaauccauuuguuguagaaauaagcuaguauucacuacuauuuuaacuucccuggaaguugucaaguucacuacacauaaaacauuaaagaaucuuaagggaaaaaaagguccuugauuuuuaaaaguuaaaaaaccaauuaugcgaacaaaguaccuuucugucaaccucucaaaguacuuuccaacuacagcuucuuuuuuaaaaauccauccuuuucuaggucaugaacaguaacaaugcugccaaccuaaagguggagcaaacagguuaugcaagaucauaaaccaaaccaauuuagaaauagagcccagaagcccaaggucagugagccuuccucucuacuacaaacauccuuuucuagaaucaucgauuagcagacugaucucuucauauauaaauaaaagcugcuaaaguaugugccuuuaaacuucucagggcuuuaagccaaaugaaaggggcuaacaaggaaaguagacaaaauuuuuaaauaauuuguggccuugauccuaagaucuuuuccuaucuucuuuuuuauauuagcuuuguagaauaggaagcacauaaagcacuuguacuaugaguccuucagcuaagaacagcuuggagagugauauuuuuaaguagucaccucuuagcaagauuucuucuaagaaauacucuaaaccuuucaaagugacaccaagaggccaacaguggcuuugaagaaaaaaacguaacaagagucaaccagcacuaauuuucaacuacuagaaaucaauuacuuugaauggaaccaauucuauuugaauucuaaagacuccauacauucuuuacauaacuagcauuuacccuaaugacucacacagaugcacacgcgcauaggugcccacacauccacaaagaaaccaaauaacucaaacgaagauauggugccuagcuuaaaagucaugcaauuuacuucuaguguuuauauggguaaauacugguuuguuuuuugucuuuuuuuuuuuuuuuuuuuuuuuugagacggagucucacucacucuguugcccaggcuggaguacaguggcacuaucugggcucaguacaaccuccaccaccuggguucaagugauucuccugccucagucucccaaguagcugggacuacaggcgcacaccaucacgcccagcuaauuuuuguauuuuuaguagagaugggauuucacuauguugaccaggcuggucucaaacuccugaccucaggugaucugcccaccucggccucccaaagugcuggcauuccaggcgugagccaccacgcccggccaguaaauacuguauuuauacacacucccucucagagauguuuuauugcuaaaaaggaagaaaauuuaaugaaguuaauuagaagcuguucuuuuuuauuauaaaagcuuaucuuccaccgggcacgguagcucaagccuguaauccuagcacuuugggaggccaaggcaggcgacugccugagcucagaaguucaagaccagccugggcaacacagugaaacccuguuucuacuaaaauacaaaaauaaaauuagccgggcacggcggcaugcaccuguaguccaagcuacucaggaggcuaaggcaggagaacugcuugaacccaggaggcggagguuacagugagccgagauugugccacuucacucuagccugggugacagagugagacucagucucuuaaaaaaaaaaaaaagaaaaggaaaaaaaagcuuauuuucauuuuuucuuuugugcuguucucccguugcugcaaaaaaaauucucuuaaucuguaccuauccaaagccuaacuaaacuagaagaugcuuuuuaaggaauaucucuccuccuccauuaaagucuaacuaguccugucaauaaugauccugccuucucugaacuccaaccauacauagaaaaaaauuuacucuuucuguuuauauguauauucauuguuuccuuaacuagcuaaagaaagaacuccuugaauacagaaaccucacuccacacuuaggaaauguuuuaccucucaauuauuuuacaaacauuaacuucauuuacccuaauuaagggcacaugccuugcagugggaggaagccagggaagaauccuaucacuuacuagauguguuaccuuuggcaaauuauuucaucucucuuggccuuuuuccuuauccggauaauagaacuguccucauagaguuauuaaucagauaaugcauaaaagccccuuagcaucuaccuaugauugauaaaugguaguuguuacuguuacuugugaauaguggggaaaggaagaagaaugacacagcauuacugauggaauauacuguuuuguuauuaacauaugccuauauucaugcccacggaauuauauacauauaccacaaaaaaaaaaaaaaaaaggcguuucuggaagaagaaaaaaaugauaaaaaaagaauuuaacacugucaacuugucauuuaaauaaacuuuacccucuacugaaauuguuugcuauucaauuaaaauuaagcauucagugauuauaaacuguugcucacaaaacaauaauagggcauuauucuuaucuuguaucauuaauuuuuuaaaaauaaaaacaggcuggacacaguggcucaugccuguaaucucaacacuuugggaggccaaggcagaaggaucacuugagcccaagauuagucuggacaacauagugagacucugucucuauuuuuauaaaaaauucaaaaaagaaagaaaaacaccuggaauuggauuuuugguggaauacaccagcuuagaauuauaggaguaagaaagacaauacauauaguuucucuuucuauacuuaauauccaacaaauauguuaacuuucuguucaaaucugcuccaaaaacuuagugacaaagucuuuuagacuuucuaaaccauacaggguuuauugauuugcauugugucagugacauuaggcaggcacaggaaacacaaggacaucucccaaucaucuccuaaagcucuaggaggaaaacagaccaaaaaugcaugaacucaagaugauaggacacuggacucuguggccacaagaagauucagaaaguuggaaacaaaaucuuguaacaaagaaagcaaggaucucaguuuaaacaucaacaauuuuuaacuguucacugccuaaccacaaaggcaaucaaggaauauuugcuucaaacucagaagaguaauuauccuaauuuugaccucagaaccuagcacagugccuggggaucaaacauuugcugaaucaaagaacaaauguaucuaauaaaugguauaaaugaggacccuagaauaaaguaauucucccucuugugaaauauuaaaaucgauguaggagcuaucaaauauuagauacacaaaaaaugaaauggaagagaaaaccuaacgucacuuuccagaacaagagagccacaacaaaugucacuugugggccugugguauuuuaaguaguuaauucaaacuguauauucuaccuuugucaucaauacaugcuuauugucacagcuacaauagccagcaguuggcuacauguuagauaucuauacuccccuuccuuuuuaagacuuacagcaacccucucuauugauguaauggauaaaaguaaauuuuguuucugcaaauuuuaaacauuacagucaaagcaaaauucuuauuucugaauuuccuguaauggaugacuggcucagcucucuaccuucuguaauuccuccacuagaaaccuaacaacuucccuuucacaauggagcucuaaacaacuuccucaaaaaaaggcacuacucuaaaaauagguuacugacauuuucugauuagcagccaaucuaagacucccuuugccauuggcgggggggguggguugggggaaaaccuagccacuggaaaaugaaguaaagguuggccuuuuauuuaaugcauauaaaauuaaaauacuucuuaaacuuaaaaugucucaauuuauagcugacauuaauauucaauaauuugugcucacauuuuggcuacuuuguuuugcuuuuaagacauuagguuaugguuaacauucuucuuuuaaugacauaguuuuggcaaaauucuccagcaucccguuccuaucaugagaauggcaacaaggaaaagcaagcacauauuucuggagacuagauuuggacacauuugaugaaagacaacuccaaccuucccuuaaaaacagacccacuuuucugacacaccaguucacuuaccucucccaucgcucuucccuccagagcaagugcuugaaaaucaugauucaguucauccauggaacgcaccuauuguuuagaauagagaaggaaaaaucuucaagucagcaucuugaauuuuacauacacauuacacacaauugaaaauuuauucuauguuuacuuucagacauuggcaaagacaauagcaaugaucaagugacuaagagauuaaacauucacuuaccuuuaaccaucaggguucagcaaugaccccuacuuucuccccucccauucccuuauauuuucaaaacaugaaaaacacaaaauccaaaugaaugaaaaagcaaauuccaucaugagaauuauguuagcuauuucucauacuuuuuaauuuaauaagaccaacauucugaagagcaaugaugccuucaagaugacuaugugaccuaaugagucaaaagaucauggcuccuccccaguugugaacaguuaaguuaaauuagggagugcauuugauucaauccacuauuucucuuugguaaaccucaggaaagggggaugcaaacccuauaaugaaguaucccaauaucucuccauauugggagaucccugggggcuccccaaaccuaaccagggggagaaaauaacaugucacaagaaucccuccaaaccuuacuaauuguuaaauguaauccuaccuacagcauaacaaucucuuuaggcuucaauuuaccuaucuaucuccaaagccauuccuacaagguaauaacaucaaggaugaugugugaaauagauuauucaaaacaguuauaauucaacuaguuuacuggucuucuuuguuaugagcagcaagcaugucucugcugucugaggcuagagucaccaccuaccccugggcaagggauucaagaguacauuccuuuguuuauuaaagacguaggcucccagccuggggaacauggcaaaauuccccucucuacaaaaaauauaaaaauuaguugggcugugguggcacacacccagauacucagcagggugaggugggaggaucacguaagcccaggagcuagaggcugcagugagccgugaucgcaccacuggacuccaaucuagguaacagagggagauccuuuuucaaaaaaaaaaaaaaaaaaaaggcugggcgcaguggcucaagccuguaaccccagcacuuugggagggcgaggcaggaggaucacuugagaucaggaguucgagaccagccuggccaacauggugaaacccuguuaucuacuaaaaauacaaaaauuagccgggcgugguggcaggcgccuauaaucucaggagguugaggugggagaaucacuugaacccgggaggcagagguugcggugagccaagaucgcgccauugcacuccagccugggugacagagcgagauucugucucaaaaaaaaacaaaacaaaaaaaagauguaggcuuugcucuucugccuacaugaaaaacaauguugacuaccugaagcaggagucucucaaacucccuccucugaucuccacuaccuuccaaugucuguuuacaauuucuaccacuggauaaacguauugagggucaaguuagggccaagcaauggagaaaagaguauggagaacaugagccagaauacaauuaagagaaucaguuuaagaauuuuauuugaggcaagaucacuaaagcccaggaguucaagaccagccugggcaauguaguagaguacccugucucuacaaacaaaaauuuaaaaaauaaaaauaaaaauaaaauagcugggcacggugaugcacgccuauggucccagcuacuccggaggcugaggugggaagauagccugcacccgggcagucgaggcugcagucagcagaaaucacgccacuacacucuagccugggugagagugagacaguguccggaaaaaaaaaaaaggauuuaauaacaugcugccuagcugccuauacauuauaucaccuaagaaucuuaacugucagaacuaacacugcaaaaagauacaguugcauuauuguuuucagucacauauuuuaaaaacgcacagccaauacuaugcuacaaaugagacacaccguaucacuaagauacaaaagauugggaaugcucacuaaaaauugaaauuuauaaaacucaaaguaagaguaaaguucaguuaguuacaugagcacaaagagacagacaaggcuuauaauacugugguguuuuaaaaaggcccugaaauaggagcuaugaucauuuuacaugguguuuagauuauuagaugagcacaauaaauagacucauaaacuguauauaauaaaaauaaaggaggguagggaggaugaagacaggauguuagcuaggaacucuacacguuauaugaaaugauaaaccuuuaggccagcauuaacauugacaaagcauguaaaucaaaugcacaaagcucuguaucuagcucuuucuguggaaucuaauuauacauuuaaauagagcuagacauuucuuggaaauccaaaaaccuacaaauacaguuucaaccagaaauauuaaaaauucuauuuauaugucccaaggaaacuaaguaggaggaguaagaaaaaaaguaugcacuguguauauuuauguagccaucacaacaaccucacagugauuauucccauuuuagagauuaggaaacugauccuccaagaaaugccuucuccaaccauuguuagguagggaaaagcauaggaggaaacuaaggcucagagcacuuacauggcacugccaggaucuuaauccaagucuucccauuuaaaguucaaggcccuuucuguaccaccaagcugcccccuggcagucaaaggaaguuuccaccuccaauauucuauuauuuuacuacauaaaacugcugucaguuucugcugugggcuucgaugaaugugcucucuuggucuugccuuugcuuuucacuaucucuuccccuaccuucaaaacuugcucauccugcccuuguagcauuuuccauuccuuucuacacuaucuuccugccaccauucucuuucaccaucuauuuacacucuuuuggauaugcgcacucucgcucccugccuccccuggcccucucucucucucucucucucugguuucuucucucccucucuuuuucucucuacucacccuccccaccucccucuuucaggguaucucccgcugccucauuuauauaagaaccacacucuuucccuaucccuguauaccacccuccugcccuaccucuuacagucaauuguugagaaaggaggcucaacuucuaagaguuuugcuagugcagaaacuacauuuuaaaccagucacccacguugacuacaugagauaaaccaagucauucucucacaaaaguuuuuaacuauuugggaacuuauuuauucauacugggagcuguauuuuguacagucacugccacagggcagacucuccagacaaaauucuuccuaggaaacaaaacuaauacucagaaaaagaugcucaagaaucaagagaaaucaaaaaaugaaggcacuguaagaaauauuuguaagaaauauuuuagaagggagaaguauuuuccaugauaaaggagaaaagcuagcugucaauuauaaucagaguaaaugcucccaucaagguagaauaagccuuucaaguuccuucuacacuucccuuuucucuagcaaucuauuugagucucagguuaauguuuuguuuuguuuuuugagacuccugcucuguugcccaggcuggagugcaguggcgugaucuuuuuuuuaaaaaaaaaaaaaaagguuuuuaaucaaauagauaaaccuggaacuacauuaccacauuuuggaaaaugaaaaauuaaaaguaucacuuuacaaaucuuuuggcaugugccuguagucccagcuacucaugaggcuaaagcaggaggacugcuugagccucggagauggaggcugcaaugagccaagguaacaccacuacacuccagccugggccauagagggagacccuguuucaaaaauaaaauaaagugggccaggcguggugacucacaccuguaauccuagcacuuugggaggcuaaggcgggcagaucaccugaggucaggaguucaagaccagccuggccaacauggcaaaacuccgucucuacuaaaaauacaaaaauuagcugggcgugauggcgcaugccuguagucucagccacucgggaggccgaggcaggagaaucgcuugaauccugucucuaaaaaaaaauacaaaaaaagaaaaaaaaaaacguuauuuuccuugacuacaguguaggcuggcagaaauaaaagguggaaaucuaaauacagggcuaggaagagaauuaggagaccauauugguuaucgagccaaaaaauaaaggaaguuuagaagacgaccuuacugauuuuuccuuuuuuuuuuugagauggagucuggcuguugcccaggcuggagugcaguggugcgaucucaccucacugcaaccuccaccuuccaggcucaagugauccucccaucucagccuccugagcagcugagacuauagguaugugccaccacauccagcuaauuuucuuuuuuuuuuuuuuuuuuuuuuuuuuugagacggagucucgcucugucgcccaggccggacugcggacugcaguggcgcaaucucggcucacugcaagcucugcuucccggguucacgccauucuccugccucagccucccgaguauccagcuaauuuucauauuuuuugaagaagacgagguuuuaccauguugcccaggcaggucucgaagcccuaagcccaagugauccauccagcauggccuccuaaagugcugggcuuacagguguuagccaccacgcccagcccauuuuauuuuuuugagacagggucuggcucuguuaccuaggcuggaaugcaguggcgcaaucacagcucacuacagccucaaacucccaccucagccucucgaguagccaggacuagagacacacaccaccacacccagcuaauuguuuuuaauuuuuuuguagagacaagguuucacuaugucaucuaggcugguuuugaauuccugaccucaagcaauccucccgccuucuaaagugcugggauuacagguauuagccaccgcacccagccauggaaaauaaauucaaacagacuugggcacaaaggaauucugaauuguaagaaguuaaugauccaaauagaaauucaauuauuugaauaauuacaauuuauccauuuuucaagcagguauuauugaacauugaaucuuaaaaagcagaauaaagcaaacauuauguuaaaccaugcauucuggaauaaaaucacuaaaaacgacacagguuuugcuagcauucugguucaguucuuguacuugcuuuacuggcauucuuguccugaacugcucagugugucuuuacaaugaacgucccuuuacuggagccgauuugacuaguugucuguugccugauuagagaaaccaaacucaguuacaacagaguaucacugaguuggggaguucauuaaaucacacugaaaauuuccauauuaaaacaaauguacaggcucacaccugcaaucacagaacuuugggaggcugagguggacaguuucacucgaggucagcaguucaagaccagcauggccaacacggugaaaucccgucucuaccaaaaauacaaaaauuacccaggugugguggcuaauugacguauaagcaaaagguagcagucaacauagagaaaagaaaugugcugaaagaagcagagacaagggacuacagugcccuuuaaaaaaacagaaagccuccaaguauucaggaagcccacauauauauuucuugcucugagguucagagaguccuuaguguucuuucacuaaauccccugaauuuuuguuaacuagaguagauuuccauacuuuuaacugccuuugcuagauuauuuccucauaaagauaggcucuucaucuccacaccuacuuuuguucucaaggauuuuuugcauacagaaaccuagaucaugaugguuccauuucacuaaaagagaucagaacaauauaaucagaaucguugaugccaggaaccauuauggaaaggaaauaccagugagaaaauggcaggcaaagaggagaaacuugagcaaugagaaaaggaaagagaauauaagaauuaaucuaauuugaauuuaaucaacaaagggaaaaaaaccuaguaaaucuguucuacagcaucuucugcacacgauauaucuguauuaauaacaacuauuacuaagacuuacuuugugucugguccugaucccauaaauacuuuauacacuuuaucaucucuuuuaauagucauaacuacacaggaggcugagguaagugggucccuugagccugcgaccagccugggcaacaugagaaaaauccugucucuauuaaaaauaugaaaaucagccaggcaugauggcacaugccuguaaucccagcuacuugggaggcugaggcacaagaaucacuugagcccgagaggcggagguugcagugagccgagacugcaccacugcacuccaaccugggugacaaaacaagucugucucaaaagaaaaaaaaaaaagucauaacuacccugaaaacacagauaauauuauucccauuuuggaagcaaagcaagaaguugguggggcgcaguggcucacaccuauaaucccagcacuuucggaggccgaggcgggcggaucaccugaggucaggaggucgagaccagccugaccaacauggagaaacaccgucucuacuaaaaauacaaaauuagccgggcaugguggcgugcaccuguaaucccagcuacucaggaggcugaggcaggagaauugcuugaaccugggaggcagagguugcagugaaccgagauagcgccacugcacuccugccugggcaacgagagugaaacuccaucucaaauaaaaaaaaaaagaaaagaauagcaagaaguuauuacagcccuuaaacaaaauauagauaaaucauucuuuccuaauuacuggaggagaaaaaaaccaaaaaaccucuuuugguauaaauggcugcaaaaccuauugcaugauguuaugaaugaauguucauaucauuuauuaacugucaauaacaacaacacuaaacaccaggcacuggcacugcgaaacagacguuauuccauuuuauauacgaggaaaccaagguuuacagaaauuacuuguccaaaaucauguaacugauaaagauccgaaauagaauucaaacucaaguuuguuuuuuuuuuuuuagucucacucuguugcccaggcugaagugcaguggcacuaucucggcucacugcaaccccugccucccgaguucaagcaauucuccuaccucagccucccgaguagcugggacuacgagugcgugccacugcaccuggcuaauuuuuuguauuuuuuaguagagaugggguuucaccauguuggccaggcuggucuugaacuccgaccucaugauccgccugccucggccucccaaagugcugggauuacaggugugagccaccaugcccggcccaaauucagcucuuuaugccuuuuaccacuuguuccuguugucaucaaaggcaagagcagaccauacaggguggcucacaccucuacauggccaguacuuucgaggccaaggcaggaggaucacuugaggcgaggccaggaguucaagaucagccugggcagcacagcagacucucaucucuacaaaaaauauguucaggcaaacauccugcuccccagucaaggcacuuggcuaaaaaugggauuggacagcaggggaggcagggauucggagugcucugaggccucgagcucuccacuggggagcagcuuaguguucuguuuugaagaaugcuaugaaguuccuggcuauacaugaggacacguuuaggucuuuggagccacacucagaguacacgaaggguaggaaaaaccacacgaggcaaagaacuuacaucaagaccaggccuaaaauacauuaaugugggugguucagcacaagggcaguugucugauagcuauaaugaagaagaguaugacugucccauuucagaugaagauaagaguaauugaugagucagauaaccauaugagagaagguaaagauacugcugauuaccaugguugugguuucuucccugaacacuggcuucacauaguuuuuugugcugagaacagauaccaaccaguguauuguacacaagacuuaaacaagggguuaaggucagaagaaacuaaaagacaauacucagugugagauuucucacucuuuaugaagccacaauauccuacaaggaaaaaccaggcaucaacuauucagcaauaaaccagaagagcuagaaaauaauauagaucagaucuugaaauaaauugaaaaguggaucaaagaucguaacacuuggaccauaagacuagccacuuuacaaucacuccuguugauauuucucugcugacgugacagaaacuguccaaguaucggugacgcuucauuaaaauuauuuuccaagacuagcagguggacagugaaaagguuuauuaagucuggguaucuaccuccccaugagaaaguuaaagaucuaaaacauaaugaauuuaggcuggguacaauggcucaugccucccagcacuugggaggccaaggcgggcggaucacuugaggucaggaguuugagaccagccuggccaacauggugaaacccugccucuacuaaaaauacaaaaaauuagcugggcgugguggcgggcaccuguauucccagcuacucagcaggcugaggcaggauaacugcuugaaccaaggaagcggccaagauugcaccacugcacuccagcccgggcgacaaagcacgauucagucucaaaaaaagaaagaaggaauauaagauuauucaggauuuaaaauaaaaauuggcaucauuuagggccgggcgugguggcucacaccuguaaucccagcacuuugggaggccaaggugggcagaucacgaggucaggagaucaucuggcuaacacagucaggaggucagcagaccauccuggcuaacacggugaaaccccgucucuacuaaaaaauacaaaaaaauuagccaggcgugguggcaggggccuguagucccagcuacuugggaggcugaggcaggagaauggcgugaacucaggaggcggaaguugcagugagccgagauuucgccacugcacuccagccucggaaauagagugagacuccaucucaaaaaaaaaaaaaaacccuggcaucauuuaauacuucaacugcuaaagaauaaauaaacauggccaaauggguggauaccuuuuauuacagaagaaaaugcagaugaucuuuaaagcuaaagguuaaaaaaaaaaaagagagagagaaauauguucagaggagaacuaucagcuaccaggcaugccuacaguguuagucuccaugaacugaggggguagaaauuauuuaaacaagggggaaaaacuuuaaccugcgauuacuucucuaguugauuugcucucccuuugcgauggacuaggcauugcagaaauguagacuacuguucaaagaccaugguagacacuacuuucuacacucuccuuaacaucugaaguaacacccgccaaguaccaaaccgcaccuuauuaacagugcuauggugauuugucuuaucucccuaaaaauaaucccuugagcgucuagcacaguaucaaaaacaugacaggcauuacauacaaauauuuguaaugugagaaacugcccuuagucauacaaguggugaaauaguacugcuagagcuagguucuuuaagaugauucuuauccuucuuuaaaacacgcauacaaauacacacaacuuuaccuugcuuuauuugacuuuucuggacaucugacaauauguaauauggguuugauuaauauucaugcccuuugaucugguaauuccacuucuaggaauuuaaccuaagcaaaucaugagaaauaugggcacagauuuguuaacaaacaucuuuaaccugguacuguaauaggaaaagauggaaacagucuaaauacagcaguaauuauuaaagcauauacuuagagaauuuauauagccauuuaaaauguuuuaaaauuuuauauauauauauauauauauauauauuuuuuuuuuuuuuuuccuuuucucuuuuugagacaaugccucauucugucacccaggcuggaaugcaguggcacaaauacagcucacagcagucccaaccugccagguucaagcaguccucccaccucagcugccugaguagcugggacuacacguguaugucaccaugccuggcugacuuuuuaauuuuuuuauagcaaugaggucucccuguuacccacgcuaacaaaaaaaaaauuuuuuuuuuuuuugaggcagagucuggcucugucacccaggcuggagugcaguggcacgaucucagcucacugcaagcucccucugccucccggguucgugccauucuccugccucagccucccgaguagcugggacuacaggcgccugauaccacacccggcuaauuuuuuuguauuuuuaguauagacagaguuucacuguguuagccaggauggucucaaucuccugaccuugugauccacccaccucagccuuccaaagugcugggauaacaggcaugagccacugcacccagccuacccaggcuaaaacuuuuuaaacacagaaaaauguuauguauguguaaggauucuauaacguaggcuauagauggguguauauaaaaagauguuaggcuggacccaguggcucacgccuguaaucccaacacuuugggagguugaggcaggcuaaucaccugaggucaggaguucaagaccagccuggcugacaugguaaaaccccgucucuacuaaaaacacaaaaauuagccaggcaugguggcgcacuuguaaucccagcuaccugggaggcuguggcaggauaaucgcuugaacccaggaggcagaggcugcagugagacagaaagcugagaugcugccacugugcuccagccugggagacagagcaagacucuaucucacaagaaauuuaaaaaaacucaugcugggcccaguggcucacaccuguaaucccugggcgacaagagcgaaacuccaucucaaaaauaauaauaauaaauauuaaaaacaaaauacaugaacugugucuuaucauugagaauucuaauucagcaggacuggacuuaagcccaagaaucucuuuuuuuuaaaaaauagagacaagggucucacuaugcugccacagcucuucuagaacuccuaggcucaugcgauccucccacauuggcuucccaaagugcugggaucacaggcaugagccaccaugccccgccaagaaucucuuuauugaaacagcuuccuagcaccggauguuaagggaaaaaguaaauauuaaacuccaauacaggaagauaaagcuucaaugagauguguaugacauacaauaguggcaucaaaggcaggcacccaaccuuggagaaaagugggaguaaaggaguacauuuaucagagaugaagauacauuaguugaagcuugaaagaugaggaaaaggccagguaaaugaagaagguaggggauuccaaagagaaaacuacauaaauaaaaauagcacuaguaugcugagaaacugcacaaacuauaaaaauaggauggguauucacaaaacuacaaauacuuuaguauagccgaaauggagcgccaguaaggacuggagaggcaagcuggaccaaaacacaaaagacagcugggcaugcgaaggcauaugccuguagugccagcuacacaagggggaagggacugcuugaggccaggaguucaaguccagccugggcaacaaagugaacacccucaucucuaaaacuaauaauaaauuuaaaauaaaaauuuauuuuaucuuuaaaaaaaaaauaacaugaaaggucuccuaugcuaugaggaggagcuuagaaguuaucccaaaagcaacaggaaagaaaacgcacacacacacgagugcgugagcaaaagggugagaaauaagcagaucguaucuucaaaaacaucaauuuggcaguggcacagacaauggcuacaaagaagaaaacgggagaugcaggaaagccagugagaagacuacugaacaucuccaggcaagaaacaugagccuaucaaauaaagcaacauagguauaaucucggaacuauugucggcagaaacaggaggcagaaaucuaggauagcuccuaacaugccacaaauggauauaucaaccacagaaacagaauacaguacaggaauugaaggaaauaauuaaauucaauuuugaauagcaucaugccauucacugagcacuuaugaaaacuaaacuccuaggcuuuuuaaauauuuuuuaacagauaugggggucuugguauguugccccagcuguucuccaacuccuagacucaagugauccucccaccuuggccucccaaagugcuaggauuacaggcaugagccaucacggccagucaaaaaguaaauuuuuuuuuuaaagaaaagcuauccucuggggggcgggggguguggggaaaggauauuauacuuugauauagcuuggauguuuguccccuccaaaucucaucugaaaugugacuucuaagguuggaggugaaccuaguguguagugucugggucaugggggcccaucccucaggaaguacuugauauccuccccaugguaaugagugaguucucacucuauuaauucacacaagagcuggcuguuuaaaagugccuggaaccucuucucucuccagcucccucucuugaccaugugacacaugugcucccacugugccuucugccaugaguaaaaguguccugaggccucaccagcagcagaugcuguaacuuacuuccuguacagucugcaaaacugagacaaauaaaccucuuuuuguuauaaauugcccagucuccuauauuccuuuauagcaacacaaaauggacuaacauacuuuuuuuaaaaaaaaaugagaaagauaaaaaugugcauacaguacugaguggcucaaaucauguaaaaauauuagaacacuuccaggacaaagcauaugauuacucguuauuaauucuagauacagaaaggaaauaauacuaaaauaaaaucaucucuaggccaggcccaguggcucacgccuguaaucccaggacuuugggaggccgaggcagguggaucaucuaaggucaggaguucgagaccagccuggucaacaugguuggaacccugucucuacuaaaacuauaaaaauuagccaagcaugguggugcaucccuguaaucccagcuacucaggaggcugaggcaugagaaucgcuugaauccaggaggcagagguugcagugagccgagauugcaccacugcacuccaaccugggcaacagagcgagacucuguaucaaaaauaaauaaauaaauaaauaaauaaauaaaauaaaauaaaauaaaauugccucuagaucucauugaauacacccaaccuauuucagcaaccuauauucaacauaucuacuaacuuuuuuaaaaauuaaaagagagauaacuaaugcaaaggacagcacuucaucaggggaaaaaagcuaaauaauuucgauuuccaaggucuuuucuaacaucuaaacuccacuggaaauguguaaaccaucugcuuucacucaaaauggcagaccaagcucuuaacagaugguauaagguuugucuuuuuuucuuuuuuaacuguuugaaauucagaaaauacaaaauggacaagagcaaagcauacuaccuguaaucucuccaugcauacaaauauaaacacuuugcaguacuuucuuccaguccuuaauccauguacaucacuuuuaagggcuacacugaacuuaaagaccauuuucuuaaaagacagggucucgcucuguugcccaggcuggagugcaguagcacgacgucggcucacugcagacuccaccuccaagagucaagccauuacaggcaugcaccagaugauuuuucuuuuuuuuucucaguagugacaggguuucuccauguuggcuaggcuggucucgaauuccugaccucaggugauccacuugccucaugugcugggauuacaggcaugagccaccacgccuagccagaaacaauuaucuuuauaauucccuccucucuuuaugaaacuaaguuucuccaaaggaacgacauauuaauuucauuguuuuguauuuuacaaggcuucugacccuuaaaagugguaucucccuaauuugggacaacugggugggggaagcaauuugacucaauaaacucuaacaaauuaaagaacauuuccuuuuuuuuugagacaguuucacucuuguugcucagguuggagugcaauggugcgaucucagcucaccacaacauccgccuccaggguucaagugauucuccugccucagccaccugagaaccugggauuauaggcacccccccaucauguccggcuaauuuuuuuuuuuuuguauuuuuguauuuuuguagagauggggguuucaccauguuggucaggcuggucuugaacuccugaccucaggugauccaccugccucagccucccaaauugcugggauuacagagaacauuucuuaauaauuaacacccaauuuggugauuuuaaauacauauaauaaccaagacuagguuaaugaacuguccccuuguuaaaauucuuagggaacuugcuuuaauaaagaaaaauugucaccagcagaucaaucaacugcauauucauugcaucuaaagaguuuacggagcucacugaaaacaccuguucucuacaguuuaagcacuccucuucccggguuuguaaacaaguuuauuuacaguguuagccuccaaauacuuccuucagagagaaaagaaaguagucauuagccccaguaaaauguguggcuuggaaaaauuccaaauccauaguguaaguuguagauaaacuaauccucccaucccccauuucuaaugagcaccugccccuagugaagaaauuuguuauuuuuguaccuauacauuacaaauuuauauacucucaaaccugagaaaugaaagcaugucuacagaaaaaaacuugaacacaaauguucauagcagcauuauccauaauagccaaaaaagaagaaaaaaaggcccaucaacugauaaauggauaaauuaaauguggcagaucuauacaaugaaauauuauacaaaaauaaaaagaaggccgggcgcaguggcucacaccuguaaucccagcacuuugggaggccgaggcagguggaucacgaggucaggagaucgagaccauccuggcuaacacugugaaaccccgucucaacuaaaaauacaaaaaauuagccaggcgagguggcgggcgccuguagucccagcuacucgggaggcugaggcaagagaauggcgggaaccccagggggcggagccugcagugagcugagaucgugccacugcacuccagccugggcgacagcgagacuccaucuaaaaaauaaaaaauaaaaauaaaugauguacugauaaaugcuacauacaacauagaugaacccuuaaaacauuaugcuaaguaaaagaaggcagucacaaaacaugcuucacuuauguccagaauaggcaaauaaagagacagaaguggacuggugguugccuaagacuggggagugacggcugcuggguaaaggauuuuugggguaaugcaaauauucuaaaauuaaugauuaugauauaugcacaacaaugaauacacuaaaaacuaaaaacuacugaacuauauauuuuuuuuaagauggagucuugcucuugucccccaggcuggagugcaauugcaugaugucggcucacugcaagcuccgccucaggcuccagcccagcuaauuuuuauuguuuuguuuuguuuuuuguuguuguuguuguuugagacagaguauagcugugucacccaggcuggagugcaauggcacgaucucggcuuacugcaaccuccgccucccggauucaaacaacucucuugccucagccuccugaguaccugggauuaaaggcaugcgccaccacgcccagcuaguuuuuguauuuuuaguagagaugugguuucauauguuggucucgaucuccugaccucgugauccacccgccucggccucccaaagugcugggauuacaggagugacccaccgugcccagcuggaauuauacacuuuaaauggauaaacuacaaaucuguaaagcugcuuuuuuuuuuuuugagacgaagucaucaccuaggcuggagugcaguggugcgaucucaguucacuguaaccuccgccccgacaggguucaggcgauucuccugccucggccucuugaguagcugugauuacaagcgcccacccccacacccggcuaauuuuuuucuguauuuucaguagagacaggguuucaccauguuggccaggcaggucgcgaacuccuggccucagacgauccacccaccucagccucccaaagugcugggaauuacaggcuugagccacugcacuggccaaagcugcuauuuuaaaaaaucuuuaacaggccaggcaugauggcucacaccuguaauaccagcacuuugggaggucaaggcaggaggacugcuggaggccagaaguucaagacaagccugggcaacaugagaccccaucuguacaagaugauaauauuaauuaaugaauaaaaaugaauuuaaaaauauuuagggcccccaauuuccaaaaaccuagaacaguuuuccugaugagacucauaaaaauauuaagaaagguacuuggaccauaaaagagcacuuacuaauggcaacagacaaauccacaucuacuaaaucuaguaaaaccauuaauaagcuaucaacaaaaaucaauaguucaggcugagcccacuggcucacaucuguaauccuggcacuuugggaggcugaagcggguggaucacuugaggccaggaguucaagaccagccuggucaacauggcgaaacccagucucuacuaaaaauacaaaaauuagcuggacgugguggugcaugcuuguaaucccggcuacucgggagccugaggcaggagaaucgcuugaacccaggagguggagauugcagugagccgagaucgugccacuacacuccagccugggcaacagcguaagacucugucucaaaauaauuuagaaaaaaaaaagggcugggggcgguagcucacgccuguaaucccagcacuuugggaggccaaggugggcagaucaccugaggucgggaggucgaaaccagccucaccaagaaggagaaaucccaucucuacuaaaaauacaaaauuagcugggugugguggcgcacgccuguaaucacagcuacucgggaggcuaaggcaggagaauugcuugaacccgggagguggagguugcggugagccgaaaucgugccacugcacuccaaccugggcaacaagagugaaacucucucucaaaacaaaauuaaaaaaaucaacaguuuucaaaaaaauauuacacaaaaaacaugaagcgcauuccucuggagaagucuaauaacugcagcgggguuuuuggguuuuuuuuuuuuguuuuuuugguuuuuuuuuuuuuugagacagagccuugcucugucacucaggcuggagugcaguggcgcgaucuuggcugacuguaacuuccgccuccgggguucaagcgauucuccugccucagccuccuaaguagcugggauuacaggcaccugccaccacacacagcauguuggucagucuggucucgaacuccuaaccucgugauccacccaccuccgucucccaaagugcugggauuacaggcaugagccaccacacaaggcccaacugcaaguaccaacacauuuacaccauucagggccaaguucuuuaaccaaauucccaaguauuaaacuuacccaaccuauugccaaucacugaccccaccacuucuuacauggagguguaagauuauauucacagcaggcuaugcacaguggcucacgccuguaaucucagcacuuuggaaggccaaggcggguggaucauaaggucaggaguucaaaaaucagccuggccaacauagugaaaccucaucucuacuaaaaauacaaaaauuagccaggcaugguggugcacaccccuagucccagcuacucaggaggcuguggcaggacucacuugaacccgggagguggaagcugugguaagccgagauugcaccauugcacuccagccuaggcgacagauagagacccaaucucaaaaaaagaguacauucacagcaaggagcaaaaugccagggcagccaacaacuacacacugagcugaagccacagugcuauuauggcucuuuacaauauccagaagucaaagaaacugaauguaaaaaacaaagaggagaucagaaaucucucaaaaggaaaagaaaaaaaaaagaugauuuacccuauccucagcacuucagcacugacuucucuccuggcacuauguugucaguucuuucauccuguaugaauguuuaaguccuuucacaagagugaauaacuagauagauucuaauuguuaaaguauucuuuccacacacccagaaaccuaauuuuguacucaggcuuagccugcagaguauucagcaaaugcuguugccugagagaaaauggacacaugcacaaaagacaugugugucuucugaaaauacagaaaggugucaugaaaaacaaguaauaacaucccacuggcugggcaugguggcucauuccuguaaucccagcacucugggagguggagguggguggaucaccugaggucacguguucgagacauccuggccaacacggugaaaccccaucucuacuaaaaguacaaaaauuagcugggcauguuggcacaugccuguaaucccagcuacuggggaggcugaggcauuggaauggcuugaacccaggagguggagauugcagugagccgagaucgcaccacugcacuauacagccugggcaacaagagugagacuccgcuaaaaaacuuuuuaaaaggccggacacaguggcucacgccuguaauaccagcacuuugggaggccgaggcggguggaucaugaggucaggagaucgagacccuccuggcugauacagugaaaccccaucucuacuaaaaauacaaaaauuagcugggcuugguggcgggcgccuauagucccagcuacucgggaggcugaggcaggagaaugacaugaacccaggaggcagagcuugcagugagcugauaucgcgccacugcacuccagccugggcaacagaacgagacugucucaaaaacaauaaaauaaaauaaaauaaaaaauaaaaaaaagaaauaaaaaaaaucuuauuacuuuacaguuuacaaagcacuucaaccacaucuauaacugaaauuccaaacacaacucucccuaacugcuguuuuuuccucuaaguaagaaucucaggaaucauuaugcuuuccucuuuucuuuagccaccaggaccaucaagguaaauucuuuuuucuuuuuucuuuuuauuuuuauuuuuuuuauuuuuuuuuugagauggagucucgcucugucgcccaggcuggagugcaauggugcgaucucggcucacugcaaccuccgccucccaaguucaagcaauucuccugccucagccucccaaguagcugggacuacaggcgcgugccaccaugcccagcuaauuuuuuguauuuuuaguagagacgggguuucacuguguuagccaggacagucucaaucuccugaccucaugauccgccugccucggccucccaaagugcugcgauuacaggcuugagccaccaugcccggcccaucaggguaaauucuauaacccauuauucuggugcauauuucuaacuuuacuccaauuuauuuuccuaucaugaccuuuuauucccauagucacaucucacuaccaccuaucauacaauuuuacuaauuucacaucaaaaaccuuuugaggccgggcgcaguggcucacgccuguaauccuaguacuuugggaggcugaggcggguagaucaccugaggucaggagcucaagaccagccuggccaauauggcaaaaccccgucucuacuaaaaauacaaaaaugagcuggcaugauggcacaugccuauaaucccagcuacucaggaggcugaggcaggagaaucaccugaaccugggaggaggagguugcagugagccgagauugugccacugcacuccagucugggugacagcgaaacucugucugaaaaaauaaaaaacaaaaaacuacaaaaauuggcugggggcgguggcucaugccuauaaucccagcacucugggaggcugaggcagguggaucacuugaggucaggaguucgagaccagccuggccaacauggugaaacccugucucuacuaaaaacagaaaaaguagccgggcaugguagcaugugccgguaaucccagcuacucaggaaguuaaggcacaagaagugcuugaacccaggaggcagagguugcagugagccaagaucgcgccauugcacuccagccugggcaacagagcaagauuccgucucaaaaaaaaaaaaaaauuagccaggcaugguaguggacacguauaaucccaacugcuugggaggcugaagcaggagaacugcuugaacccaggaggaagagguugcagugaucugagauccugccacuucucuccagccuaggugaaaggaugaaacuccaucucaaaaaaauaaaauuaaauuuaaaaaaccuucuaaaauuaaacaagguaaagauacaucauaaauaucucuacaaguugccauuucagaggcauauauaaucaaguaccauucagcauuagagaagagcaucugacugaacuuccuuuuuuuuuuuuuuuuuuuuuuuugagacagagucuugcucugucgcccaagcuggagugcaguggugcaaucucagcucacugcaaucuccgccucccagguucaagugauucuccugccucagccucccaaguagcugggaccacaggcacccgccaacacaccuggcuaauuuuuguauuuuuuaguagagacgggguuucaccauguuggccaggcuggucucaaacuccugaccucaggugauccgcccaccucagccucccaaagugcugggauuacaggcgugagccaauugcaaccagccgaacuucuuuuguuuacacuggaacaagguaauucuuaaaguuauaaucaggcuagguuaaaauuauagucaggccagguacguggcucacacuuuuaaucucaguacuuugggaggccaaggugcgaggacugcuugagaccaggaguuuaaaaccagccuggacaacauugugaaacccugucucuacuaaaaauacaaaaauuagccaggcauggugguacaccccuguaaucccagcuacucaggaggcugaggcaccagauugcuuguacaaaggaggcagagguuucagugagccuagauagugccagugggugacaaagugagacucugucucaaaaaaaagaaaaaguuauaguugaagaaggccugcugaugauuccuuugaccaagcacauaauguuaagccuugugaauucugagcauaaugaaaaggcucuaagaguacauguguaagagaaacaaaauaugaaagauggauuauucagcuuuaacauguuaaccaaaugcuacuagcacaaaugcuaaggcaaucuacccagguagacaagauucauugucuaagagaguccaucagcagguacaacagaaagacauuucuagggaaugucaagacuccccaguuugggaaauacuugggcucccucccaguuuaacauaguagucccuguuaauuacaagguauaaaaauuaacuggagcucuuuccuuuugucucacugcacuccugagagcaagaugggucaccagcagcucuacuggagccacucgcaaaaauucagccaggguucucucucuuguugcguaugcucagaccagcaagaucugauccaaauuacggccucaauaugccccaccaguguuucugucaguaagcgaagaaaauggguuucauuaaauugggcugcauuaaguuggacgaagugaucuuccuugaauggauuauccaaggcauccaccccaaugaaagaaaccaugauagcucuuuuuuaauacauaauaaaaauaaaauuuuuaaaacccuucaaaaaaaaaaagacuaacagcacugaagaguaagacugguugacaugucagggguggguaucagaauaucauuguuaagauggccacaccaagugaaagaaaaagaagguacaaguggagucaaaauauauucauccacugaauuuuuuuuuuuuuuuuuugagacggcauuucgcucuuguugcccagaguggagugcaauggcacaaucucggcucaccgcaaacucugccucccagguucaagcaauucuccugccucagccacccaaguagcugggauuacaggcgugcgccaccacgccccacuaauuuuguauuuuuuguagagaugggguuucuccauguuggucaggcuggucuccaacuccugaccucaggugauccgccugccuuggccucccaaagugcugggauuauagguaugagccacugcaccuggccucacccacugauuuuuuuuuuuugccugguucucuggaauuaucuccuauaggcugucaaucuaugauggauacugauauauccuagugcuaaaagagugcaagcaaaguggguaagcucuguggaacuguccuccaaauuucccuucccccagggcaaagcuucuaccucugucccucauaauccaguacagaggcuacaguucaaccaaucgacuuuaauuuuuuugcccuauuucaucaaccaguuuaucuaucccacagcaguuuacagagaaaacagauuucacaauacaagaauaaaacacucucaagucaaagacuugaccuuaggcuuuuaguaaugaaauuuucaauguuauucaggaaagaaaaaaaucuaaagguauaaaaauuacugucaaaauaaguaacuuuuuuuuuucuuuggagacggagucuugcucugucgcccaggcuggagggcaguggugcgaucuuggcucacugcaagcuccaccucccggguucaugccauucuccugccucagacucccgaguagcugggacuacaggcgcccaccaccacacccggcuaauuuuucauauuuuuaguagagacaggguuucaccguguuagccaggauggucucgaucuccugaucucgugauccgccugccucggccucccaaagugcugggauuacagacaugagccaccgugcccagcccaaaaugaguaacauuuucaaauacauaacucauuugggugggaagaugugucuaguguuuccuaguauuuguuuuuuaaauuuccuuuuuuucauuuuuuuuuucuuuucaaagagacaggaucucacugucacacaggcuggagugccugaacucccugggcucaagugauccucccuugaguaggacuacaggcauaugccaccaugcccagcuaauuuuuuuccuuuuuauuguagauacagugucucacuauauugcccaggcuggucucaaacuccuggccucaagcaacccuccugacccagccuccugaguaucugggauuagaggcaggagccaauguacccagcuuuauuuucuaguauuuugcuccauauccauuaucuuuuuuuuuuuuuuuugagacagagccuugcucugucgcccaggcuggagugcaguugugcgaucucagcucacugcaaccucugcccugcuucccggguuagagcaauucucaugccucagccucucgagcagcuggaauuacaguaacgcgccacgacgcccggcugauuuuuguauuuuuaguagacacgggguuucaucauguugcccagguuagucucgaacuccuggccucaacugauccgcccaccucggccuccaaaagugcugggauuacaggcauaagccaccacgccuggcccaauauccaucaucuuuuuuuuuuuuugagacagagucucccucugucacccaggcuggaaugcaguggcgggaucucggcucacugcaaccucugcccccgauucaagcgauuuuccugccucuccugaguagcugggauuacaggcacgugccaccacaccuggcuaauuuuuguauuuuuaguagagacaggguuucaccauguuggcuggucucaaacgccugaccucgugauccaccugccucagccucccaaagugcugggaguacaggcgugagccaccacgcccaguccacauuaucuuaauuguauacuauggguauaauuuuacaggcaaaaaaaaaaaaaaaauuuuuuucaugagacuucuuucccucacuucccuccgaagaccucaguuuggcccaaaaaugagggcucucugccgggcgcaguggcucacgccuguaaucccagcacuuugggaggccuuuuuuuuuuuuugagacagggucucaacucugucacccaaaauggagugcaguggcacaaucucggcucacugcaaccuacgucuccugggcucaagugauccuccuaccucagcccuccaaguagcugggaccacaggcacagcgccaccaugccuggcuaauuucuguauauuuuguagagacaugaucucaccauguuguccaggcugcucucgaacuccugggggcucaaacuauccacccuccucagccucccaaagugcugcgauuacaggugugagccacugcguccagccaaaaaaugaaaaacuuuuuaauguaaguauacaaguggcccaggaacgguggcucaugccuauaaucccagcacuuugggaggccgaggcagguggaucaccugagguuaggaguucgagacuagccuggccaacauggugaaaccuuguuucuacuaaaaauacaaaauuagccgggcgugguggugcacacuuguagucccagcuacuggggagacugaggcaggagaaucacuugaacccaggaggcggagguugcagugagcugagaucgcgucacugcacuccagccuggacuacagagcaagacuuuauuucaaaaaaaaaaaaaaaaaaaaaaaaaaaggaguuugagaccagccugagcauggcaaaacuccaccucuacaaaaaauacaaagaugagcuagguguugugacgugugccuguggucccaggauagggaggcuaaggcagaagaaucgcuugagccgaggaggcagagguugcagugagccuagauggugcccauugcacuccagccucggcaacaggagugaaacccugucucaauaaauaaaaagaaaaaaguguaaaagcaauugcucuuaaaugggaguaauuacgagagaaauaaaguaccuggcaugacaaagaguuccccucccuccaaugcuacuggcaucacagccugugauauucuuuacuucgcuaguucacuagugaaagcauccugccaauucgaucucaaacuuuguuccauuaugccaaagggccacuaaaaaaaaaaaaaaaaaaaaaaaggcccagugguaggguagaaugagcuggcaauaggaucacuuuauauugagucauucugucucuacagagauaauuuuccauccacauuaccacuuagaacacauauguaauaaaaaacagaacugaagaaaaauggacuuuaccauuacugcuuuugggaguugggggcaaguacuccugcaauuauaggagaauggucaacauuuguauucaucucauuauuaaguuuacagucucuaaauuucaagcaaaauuauggcaaaacaauucuuuggcccuguaaugugccacuugguugcacaguuuugucugguuuaucuugccuagggaagcagaaacagaucuagaacguggacacuggaaucaaagacugauuucaaaaaccagguauuaccugguaacaaagccucaguuucucacuuuucaaaaaaggguauuuaucuccuucauaggauugcuguaaggauuauauauaggaaauacaauagcccaaugccuagaacauauaaauauuuccguuaucaucagugguucucaaccucuuuuucacucugacccacaugacagaucaggcacccucuuacaccuccuauccguaacaguggcuaauaagggcagagauucuccaccuagagaugugccccuuugcucuucaauuaugcuacccuuagcacagcugccuaucaaguggccucuaccuguugccauguguuucccagcaggaugacugagcuguaagacccacuccuuuaccugagcgcaaaacugaagaaccucucgucuucccucauucaaucaacacgaaaguuucauaauaccuccuggaaaaggggcaugaaaaacacaagucucugaucuagaauaguucaguccagaaggugagaacaacacuaaaaccaguacaauacacuauaaugacuacagaaaaguaaccugugggugguccacaacugcaauauaccaacuacccugaguuccccaacguuguucauuauuucaugcguccagcccaaagaauuguguuguaaugaugaaugccaauuccaaggucacugguuuaggccaccugagugggaaacagguuuugccauuuacuauuauuaacucaaguuugcuaacugaccuggauaaaacugcucaguaagucagaugugauuccuuaugauagggcucaguguaagacagaggccugaguaagccuucaauaaacgcuucuuaacuugcacagcaauaaucagaucuuagagcucugccaaggacugaccuagaguuugauuugcucaccuagcaaagaaccugccaggcaccuugacucuccuuucagcuuccacccaucagucuaucauuaggaaacacaacaaaagaucuuauagaucuuuauuacagauuuuaaaaaaccaauguuuaugauuuuugaauaacauuuagccaaauaguacagagauuacaggguuuguuuuugccccacuacacagaugccacccaaaucaaauaccuccuaccuugauuuccugcuacagguagagcugccuacaguauacacccagauauucugcuucuaccucaaacucaacagguguccuaucaaauguaaucacugugucccaaaccagaggcacucuguacuuuuccuccauuacuucaucuuuccaggauauaagauuucuaauucaaucaccaaauucugugcauaucuucaucccaaagaaagagaaaaucuuucuuuuuucuuuuuuuggagacagaguuucgcucuugucacucaggcuggagugcaauggugugaucucugcucacugcaaccuccaccucccggguucaagcgauucuccugccucagccucccgaggagcugggauuacaggugugcaccaccaugccaggcuaauuuuuuuguauuauuaguagagacgggguuucaccauguuggccaggcuggucuugaacuccugaccucaggugauccaccugccuugaccucccaaaguguugagauugcaggggugagccuucuuucagccuuacagcugaaaaccuuccuuuucuuuucuuuuuuuuuuuuuuuuuuuuuuuuuuuuuuuuuuugagacagggucccacucuguugcccaggcugaagugcaguggcaugaucucuguucacugcaacuucugccacccacgcucaagcaauccuuccaccucaggcucccaagcagcuggaaacacaggcaugugcccccacgcccagcuaauuuuuuacuuuauuuuuugagauggaguuucacccauugccuaggcuggagugcaauggcaagaucucagcucacugcaaacucccugucccagguucaagugacucuccugccucagccuuccaaguagcugggauuacaagcaugcgccaccacgccuggcuaauuucugcauuuuuaguagagacaggguuucaccauguuggucaggcuggucucaaacuccuuaccucaggugauccacccaccucggccucccaaagugcugggauuacaggcaugagccacugcacccagccugucuuuguuucgacuauaguaaagaacuggucagaugcaguagcucacacuugcaaucccagcacucugggaguccaaggcagguggaucacugugagccugggcucaaaguagagccuggccaacauggcaaaaccccgucucuacaaaaaauacaaaaguagccggguguaguguugcaaaccuguagucccagcuacucaggagacugaggugggaggaucgcuugaaccagggagaccgugguugcagugagccaauaucaucauaucaccacacuccagccuggaugacagagccagaccuugucucaaaaaaaaaaaaaaaaagaaaaagaaaaaaaaaaaagggcugggcaugguggcucacacccguaaucccagcacuuugggaggcugaggcagguggaucacaugaggucaggaguucaagaccagcccggccaacauggugaaacccucucucugcuaaaaauacaaaaauuagccagguauggaggugggugccuguaaucccagcuacucgggaagguaaggcaggagaauugcuuaaaccugggagggggagguugcagugagccgagauugugccacugcacuccagccugggcgacagagcgagacuccaucucaaaaaaaaaaaaaaaaaaaaaaacaacuaugguucacuuuuggggggaucagaggaaguauaauaaaaucagacuugcagguauguuuguaccugauuuuuucugaaguaaaacagaagcacuagaagccuaaugaaaaaugucaguucucgcuaaucaguacugacgggugacacaaaaugaaccuuuccaaauucaaccuauacccaauuucaaagaauacccugaucaaaacagucuaaucuuuugguuggucauuaucaagaaaucaggaaacauggauaaggcuaaccucucuucucaguaaaauaugcuaugauucccacuaugguuuuagauuaauaagacugaacauguuaaaauuaaaaauuaaacaauaacaagaggacaaaggugguuaaaaccuaaaagccacaaccacuucucucugacacaauauaucagucccauuucaaauaaauuucacuugagcagcugauguuaucaacuucccccuacuuucaacuacaacaucuuaaaaucaagucacccacacccaagagaaaagauucaaaaauauguaucuauccuauaaacaacccuagcaguucuuaugucaacaguaaaaaaaagaauccuuuguuccaaaaaaaguguucuuaaaaaugcguuguaggccgggcgcaguggcucacgccuguaaucccagcacuuugggaggccgagauggguggaucacgaggucaggagauagagaccauccuggcuaacacagugaaaccccgucucuaccaaaaaaaauacaaaaaauuagccaggcauggugcgggcaccuguagucccagcuacucgggaggcugaggcaggagaauggcaugaaccugggaggcggagcuugcagugagcagagaucgcgccagugcacuccagccugggcaaaagagugagacuccgucuuaaaaaaaaaaaaaaaugcauucuauaggccgggcguggguggcucacaacuguaaucccagcacuuugggaggccgaagcgggcagaucacuugaggucaggaguucgaggccagccuggacaacauggugaaacccuguuucuacugaaaauacauaaucagccaggcgugguggugcacaccuguagucccagcuacucaggaggcugaggcaggagaacugcuugaaccugggaggcagcagcugcagugagccgagaucaagccgagaucaggcgacuacacuccagccugggugacagagcaagacucugucucaaaugaaugaaugaaugaaugaauuggcuauuuacuauuuagcaccagaaugauaaaugacccaguaacaguauuacaaugaucaaccuuuauaacaaguaacuguuuguaccaaaugaaaucagcaauuuaaguuuuuaaagacauucauugaaagcagauauccuaaguggacagugauuauaaaggaaugucaaagcuaaaauagugaacuuuuuuuuaccugauguucugcaugaauguuauccccaguaggccaucgauguuugcuauuauuauagccgccuccuccacuuccuccucccccaagcugcucaccaugcugccucugaaagaaguaguccaccauagcgucguccugggaacggccugcaacuccuauagauccugggacagggcuggagugagucccagcugcaagagccugauuugcagcugguuguggcugcgcuugcgacccuguuccagaugucaaaacaacaggcauguugggauuagcugguucuugagggugauguuucaggugggggcugaaagaguccugccaaagcacugcuuuucucuucaagacacaugcaacgcucauuccaccaacaccuaaggacaaacagguuacaaauauuuaauauuuccaucuuuugaaacauaaaacacacuaagauaaaaacaugaaccccaugucuuuuacaauaaauaaaugucguugguggcaugcacucuggcaagguauugggaucagaacucaauacuaccacuucagagaaguuuauguuguuaaccaacacauagcaauacagaauuagacuucuaucagucuacccaacuuacuuauaccucaaaccaacugacaguuuuuaaaugaacaaaagcuuuuuuuuuuuugagacaagaguuuugccccuguugcccaggcuagggugcaaugacgcgaucucggcucacuacagccuccgccuccuagacucaagcgacucuccugccucagccuccugaguagcugguacuacaggcgcccaccaccacggguggcuaauuuuuuguauuuuuaguaaagacgggguuucaccauguuggccaggcuggucucgaacucccgaccucaggugaucuacccaccucggccuccggaagugcugggauuacaggcgugagccaccgcgcccagccccaaaagccuuuuuaaaacuaucacaacuucggccgggugugguggcucaugccuguaaucccagcacuuugggaggccaaaguggguggaucaccugacgucaggaguucaagaccagccuggccaacauggugaaaccccaucucuacuaaaaauauaaaaauuagccagguauggugcugggcaccuguaaucccagcuacucgggaggcugaggcaggagaauggcuugaauccagaaggcaaagguugcagugagccgagaucaugccacuguacuccaaccugggugacagagcgagacucucucucaaaaaaucaaucaaucaaucaaucacaacuuuacagcuggagcagacauaugcuaauaacuaaacaaaagccuaaacccauauauaaguagcaauggcucagauuguguaauuugaaaggaucccuuaaaguguccaacauauuggccaggcgagguggcucacgccuauaaucccaacacuucggaggccaaggcagguguaucacuugaggucaggaguucgagaccagccuggccaacauuaugaaaccccaucucuacuggaaauacaaaaauuaacuggguguggugguacacacuuuuaaucccaacuacuugggaagcugaggcaggagaaucguuugaacccgggaggcagagguugcagugagccaagaucgcaccacugcacuccagccugggcgacaaaucgagacucuguuucaguaaaaaaaaaaaaaauaauaaauaaauaaauaaauaaaaccuccaauauauugauaggauauuucuuaaagaaacaauaaaacccucugaccaagaacagcagcagaaugcuuuuagccuaagcccucuccucaguugucacugauuuuuaaaagcauuaauauuuuuaccaguaacuuacaacuauuaacuguaaucacauuaugccauuaguacuucaacuacuauaaacaggaugagaccaaaccaaauuuaaacacuucauauuaguguagaaagccucacuacaggcugggcacaguggcucacuccugucaucccagcaccuucggagacuuaggcagggagaaucgcuugagccaggagcugaagaccagccuaggcaacacagugagacccccaucucuauuauuuuauuaaaaaauaaggcucuaagaaggccaauggagguugggcacgguggcucaugccuguaaucccagcacuuugggaggccgaggcggguggaucaugaggucaggagaucaagaccauccuggcuaacauggugaaaccccgacucuacugaaaacacagaaauuagccaggcuugguggcacgcgccuguaaucccagcuacuugggaggcugaggcaggagaaucacuugaaccagggaggcagaggucgcaccacugugcuccagccgggcgacagagcgagacucugucucaaaauaaauaaauaaauaaaauaauuuuuuuaaauuauaaaaaaaaaagaaagccucacuauacaaaccagaagccucaguugggugugguggcucauaccuacaaucccagcacuuugggaggcugaggugggcagacagcuugagcccaggaguucaagaccagccugggcaacauagcaagaccuaucucuacuaaaaauaauuagccaggcaugguggcaugugccuauagucccagcuacuagggaggcugaggugggaggaucauuugagcccaggagcgggaggcugcacacccgcuugggcgacagagugaguuccugucucaaaaacaaacaaacaaacagaagcuucaacacgguaauaguguaaugaauauaucgcagacauugucucaucacaaaagcauugaaagguagccauuauuauuucuauuuuacaaaugaaaacacuaagguacaggaggaaaaugggauguuuccaaggccauucaacuagcaaguagcagagaaaggauucaaacccuaaucguucccaagcuuacuucuuucuacuaaccccuugcaggaguaacucaacaauaugucucauuuguauccucuacuccucuggaagaccaacaaagaaucccucaaauguuacuaugaaacacuaaaguuccuuaaaaccaaaaacugcaucuguacuuaagauagaacacuugccagccugugggugcuuuuaaaaaaugcuacaaaguguccggacacgguggcuuacgccuguaaucccagcacuuugggaggcggaggcaggcgcaucuccaggucagaauuccagaccagccuggccaauauacugaaaccccgucucuacuaaaaauauaaaaaguagccaggugugguggcacgcaccuguagucccagcuacucgggagacugaggcagaagaaucgcuugaacccaggaggcggagguugcagugagccgagaucaaggcacugcacuccagccuggacgacagagugagacuccaucucaaaaaaaaaaaaaaaaagcuacaaaguaaauaaaucaguuaccaauuaggacacaccuguccacagccacggucuaauuucaaagccaucggccuaacagucuacugcuacaaaugcuuuaucucuucucccaacccccacugugaugcuucaaaaacacaugaauaacaaaucuacuaucucucuguugaauaaauaaaccuucugauaaaguagcauuugcuucucacaacuaaauucauguuuuugaagccagccuaagaagacacaauggaauuuguaauuuguuuaaagccuaauuuggaaaugccuagucuagguuaagaauuccaauccaucagaaccuuagcaggguacuggaguagucuaaccuagacacuagucccugcucaaguaccaaaaccaaaaagucauagcccgguuucaccaucggucuuucaaaagugcaaaccagccuaaugccucccugcuugguuuuuuaaagaauucauuacucucuuaguacuaauacuagacagucccauucuguucuaaaaggaaaucucgaccuaacaaucuuuguucuagagcaggccaagaguuccaaaacccaaguucuuucacuaaacaaaacuaccuguuuccucaucuagaaaaugaaagaaauccuuccucuaugacucucaauguuuuggguuuuucuuaaugaaaaugagauaaauauaaaaguuuuugguaaauuuaaagucaucgugcuuaagacucuuagaauuuaguuaccccuaguuaaggcaacuccagucccuaacagaauuccuaaaacagcaaaugcaaucuuuucugaaauaaaagccuucucaaaauaguuaucuaggaggcugagagaaggauaaugagagauuaccuaaggaggacaauguacguuauuccagugauggacacacaaaaagcccuggcuucaccacuacgcaauacacgcauguacaaauuacacuuguaccucacaaauuauacaaauaaaaauuuuuaaaagaaaaaaguuaucuaacaaagaauauccacauaaaagaggaguuuaucacugacgcacacuaaacacaccuucauucuaaaaggaaugggggaaagaaaagacuccuauaaaaauguucaaacgaaacaauuggcuuuuguaaagcuaucuguaugcccuaagacuuccugcuuuaccuaaagaggcaaggcaguuucucaaaccagagaaaaccuggcagaacaguuucaaagugagcaaauaccuaagcaauuaacauguuaucuuggguaguuuugugguauuuuggcaaauacggcacaaaaauuaaaaacucaguauccuaaauaucagaaaagcucacuaauacguguagcauuuaaaaugugauuuuuuuacaaaugacaccuuauaaguacuuuaagcaacuagaagugcucaguccagcuacucuuucacagcuuucaaauguuuacaaaguuuuuuaaaauaucacuaauugaguugaauucaaaggaacacgguuuacuuuauuuccauggcucaccuuuuacuaaaaugcuuagugguuuaaaagguguuuauuuuuaccacacuuaacaaacauucuguggucauaaauuuaucuuaaaacaguucauuuuaaaccuaaacuaaacaaauuccaacuucaaaaagcuguggccuugaacaaaaugaauucaauugucgcuaaagcaaaacacuaacucaaaguucagaauccggagagcguuucccaagagcccagauaaagaaucaacagccccccaguguuuuauaaaguuaaaauuagcaaagggucaaaauguuuauuuugcuuacgaaaacugcaucggaagccacauuucuugggguugggccugucuuaguaaguuuuuaggugcuuucaagaaacaaaaugcuaagccuauuguuucagaaguuaacugacuuuaaaacagaacccaggaaaagcuucauaaaaucuuauucuuaauuaaucccaguaauaacaggaauugagcaaaaugguaucgagggcugagaacaguguuuucuuaauugaacaauaaaagguaacaaucuaaguuacgggagaauaaagccuucucugguaaugcuguguguggguuucuggcuuuguuuuuucagcgggggggggggggggggcuauaggagggaaaaguuacaggaguguauuccucacuugacgugggaaugguacugacaaguaaaacaaaugaucuauguuuaccaagcauguuugugaggacuaaaacuaguauuguguaucuagauuuuccuacuagcaaggggugaaccccucuuugagugaagagagacaccaacaccgggaggcucaaaaaggaagaacccaccaaaaacacaagcucacacggaaacaaaaggccacagcaacccaggagccuaaaaagcauucugaaacuuccugaucgccacuucuccacauuuaaggcucgcaaaguucccccacggugaaucucgccuguggacaagggccacggcugcuucuaaagcgauuuauuguuccuccuccuccggcgcugccacggaagcucaagaagucgaagaaaucgggguggcacagaauuacacuucauggccacacagaagacucggggcuucgcaaacccaucaaaaaaagcaacccgaauggcaacaucaaucuucggugguucccaacagggccaggcaaaaauguagaggcacgucuacgcccugggcucgggccuaaacccccagcauuuuccuagcuucgaccccgcuccccacccccucccuccuuugauaacaauaggggccuugcugcugacuccaaaacauguacgaggaacagcgagugagaagccucagccagggccccggcggcuuuuccaaagcccuucucacccccacaaccacucucaaacaccaauaugaagggacaaucugcucguuagggguccggagcagcguuuggggccgguggggugcggauacucacgggcggagcgguaggaugaagauggauuucagccccccgaucuucucucucuggcgcucucgcucccccuuaccuuucacuccgacaacauggcggcccacu

SEQ ID NO: 191418 - RNA, 6966 nt, Homo sapiens
gagacgucggcuuccgaccggaagugagaagaggaggaaguuggcugguugcaccgaucugggggcuucccgggcucggguaaccggagugcugguaucuaaucgucgcucaaaagcuccuaggugcgcggguggauauaauucccggcuucucgagaagacacuacagccucaaggaggugugcuucuaguguuuaauuggauacguguuauggaugccggcuuagaaggaccuauauaccaucaucuuaaaauaacuuccccuuggcucucucucucuuuuuuuuuuuuuuuuuuuuuuugagacggaguuucgcucuuguugcccaggcuggagugcaauggcgcgaucucggcucaccgcaaccucgccuuccggguucaagcgauucuccugccucagccuccugaggagcugggauuacaggcgcucgccaccaggccuggcuaauuuuuuguauuuuuaguagagucgggguuucuucauguuggucaggcuggucucgaacucccaaccuccaguugauccgccggccucggccucccaaaguacugagauuacaggcgugagccaccgcgcccggccuuggcucucuuuaaaaggcauuuuuaggcuagccgcaguguggucucccgccuguaguagucccagcuacucggcuugagcccaggaguucgagguuauagugagcuaggaacuccccacugcacugcagccugggcuacagagcgagauccugucaccaaaaaagaaaagcguacgggggaaggcauuuucagagagauagaacgccuagauguuaguuugguccaaacucugcuaccaacuugcuguguguauccuucugucccucuccaagucucaauauccucaucuauaaaacgaaggucccuuaagucacuuuuucaguucuucugaauuuuguugccucuuuauuaucucguuugagccacauagccuugggaguuaaaaaucacuggccuuuggccgggcacgguggcucacaccuguaaugccagcacuuugggaggccggaucaccugaguaucaccugaggccaggaguucgaggccaaccuggccaacaugacgaaaccccgucucuacuaaaaauacaaaaaaaauuagcugggcuugguugcgggcgccuguaaucccagcuacucgggaggcugagacaggagaaucgcuugaaccugggaggcagaggcugcagugaacagagauugcgccauugcacuccagccugggcgacaagagugaaacuccgucucaaaaaaaaaaaaaaaaaaaaaucacuggccucauuuuauaaggaagacauugagucccagggugagggguuauagauaggacuuucucaagauugcacagguaauguggagguuucagaacuugagacuagaagguaaugcuguaacuccaugaccagaucuccuuucuauauuucugugucaucaguuccuggaacuggccauauaaggaaauacucaaacguuuuugaaugaaugaaucuuugauuugaaggccagugccacaacagaucuggucucucuccaccacuuugauguauaaacaagugaacucuuuuccagguauaucccgugccuuaccugacugggggcucugaguccaguuguguugucuucaacuuagacaccauggaggcaccuccagucaccaugaugccugucacugggggcaccauuaacaugauggaguaccuguugcaggguaagugaacuagggaacuuggauuaccuguuuuccucuucucuguucagcuucccuuaagaugagagacuuaacacaaaagcagccugcacaguuucuggcacccagcuauguuuuuaacuguuacuuuaaauuauaguuuuauaugcacuaaacauacuaaauuugccaucuuggcugggcaugguggcucacgcguauaaucccagcacuuugggaggccgaggugggcggaucacgaggucaggagauggagaccauccuggcuaacacagugaaacccugucucuacuaaaaauacaaaagaaauuagcccggcgugguggcgggcaccuguagucccagcuacucaggaggcugaggcaggagaauggugugaaccugggaggcagagguugcagugagccgagaucgcgccacugcacuccagccugggcgacagagugagacucugucucaaaaaaaaaaaaaaauugccaucuuaacauauuuaaguguacaguucuguauuguuaaguauauuaacauuguuaaacaacagaucuuuagaacuuugguuuauugugaguagcuugaaaaaauacuuaguacaacuuuuuauuucuuugagacagagucucaaucugucacccaggcuggaacgcaguggcacaauaacagcucacugcaaccucuaucuacuucccggguucgagggauucuugugucucagccccccuaaauagcugggauugcaggcgugcaucaccacgcccagcuaauuuuuguauuuuuaguagagaguugugguuucaucacguuggccaaacugaucuugaacucuugcccucaagugauauacuugccuuggccucccaaagugcuaggauuacagguaugagcugccgcgccuggccuaaaauacuuaaguuuuucauccuauaaaacugcaacucuauacccauuaaacacuaauuaccacuccccucuaugccaaacccuuagcaacuaucuuucuagguccuguuucucugauuuuuuuuuuuuaagauggauucucacuccguugcccaggcuggagcacaguggugcaaucuuggcuuacugcagccucugccucccagauucaagcgauucuucugucucagccuccugaguagcgggauuacaggugugcaccaccauggccagcuaauuuuuguauuuuuaauagagacaggguuuuuccauguuggccgggcuggucuugaacuccugaccucaggugauccaccugccucagccucccagagagcugggauuacaggcgugagccaccgcgcccagccagauuuuguaaacaaguaucugaauauguuccuaacauuugagccauagccauggaggcagaaagaugacuaaaaaaauguaugucaagccagcuguuacaggcuuaugccuguaauuccaguuguuugggaggcuaaggcugcaguacugcuugaguucgggaauucaggauuagucuggacaacauagcaagaacucaucucuacuaaaaaaaaaaauuagcugggcaugguggugcgcaccuguagucugaaccacuugggaggcugaggcgggaggaucacuugagcccaggggauggaggcugcaaagaguuauaaucacgccacugcucuauagccuggagacagagugagacccuaccuaaaaaaaaaaaacaaaacuaugccauaaaaauaaagcaggaaaguggcuagagauugguaggacacauacuauuuuauuagggugaucagaaaaggccuugaugauaaagucacuugagcagagaccugacaaaagugauagaguagacaugcagaugggaagaacauccuaagcacagagaauaggagaagggguguggcaggaaggucacuccuggagagaaugaucaaggggaggaauagaaggagaugauguuuggcagguagcagagaccauaauauguagggccuuguugacaacgguaaagauguuggcuuuuauucugaaugacacaggaagccacuguaguguccugaguagaggaguguuauuaucugcccaauaauuuaauagaccauuuggcuuucauauggagaagagaggaagaaggcaaagguagaaagaggcgauugcaaagaccaggcaagaaaugagggugacuucauuugaagggacuagguugaagugaccagaugagugagaagugauugcauucugcauuuauuucaaaaauacggauucaauggaggguaugagagaaagaaagagggugugagucaaagaugauuuucugguuuuuggccuggguaaccaacuaaaaacagagaguugccauuuacugugauguugaagacuguagggugaauaagauuuuggaggaaaaaaucaacaguuugauauugaacauguuaagauaaagaugucuguuaggcauccaagugaggaaacugaguaggaaguuggauguuuucaucuguaguucagagauaaaaacgugggaguccucagggccuaaaugauauuuaaagccaugggaccaaauaaagucaccuaggcaggaaaagaguauugauacagaagaggaccaggauugaguccuaguccuccaguguuuggggaagaugagagagaccaagcaaagaagacuuaaacggaauggucagcaaguuaagugaagacaagaaaguugugucucagaggccaagggaagaauagauuucauaguggguauaaucuacuguaacaauuaugucagauguugccaagaggaugaagauucuaugaagcaauucacucucuucuacuuacauacagaagaggaaaacuuuuccugauaaaaaggaaacuuuagccaggugcaguggcuccaugccuguaaucucagcacuuugggaggcugaggcaggcggaucacgaggucaagagaucgagaccauccuggccaacauggugaaacccugucucuacuaaaaauacaacaauuagcugggcgugguggcacacgccuguagucccaguuacucaggaggcugaggcaggagaaucgcuugaacccaggagguggagguugcagugagcugagaucgcaccacugcacuccagccugaagacagagcuagacuccgucucaaaaaaagcgggggagacuuuauauuucuucuauaaauggaagacuuugauuuguuggaaauagaaggcaauuguuaaaauauauaacaacaaaauaguguuauuggcugggcaugguggcuugugccuguaaucccaacacuuugggagaccaaggccaggaguucaagaccacccugggcaacauaguaagaccccaacucuacaaaaauaaauaaauacauaacuaaaacaguauuauuacauucuagauagacacugucgcugauuaaaggcucuaagccccaggccugcuggagaugagcauuagaagaggccuaaagacuuuguagugcuaaauaagaaaauuccaaaaaaauugaaaaggaaaauaacuuucucacaacguuauacaauaccuugguaguguaauuucuguaaaaucucauguuuggcuguauguuuuaugaaaugcuucacuaaacuguuuugguuuuucauuuaaguuuuuucaauuguauacuaacuccaugaccuaaaaugaaagacaggacucaguggugcuuuuuccguuuucaggaaguguuuuagaucacaguuuggaaagccucauccaccgccuucgugguuugugugacaacauggaaccugagacuuuccuugaccaugagaugguauuccuccuuaagggccagcaagccagcccauuuguucucagggcccgacgcucuauggacagggcaggggcacccuggcaucugcgcuaccugggacagccagaaaugggagacaagaaccgccaugcccuggugcgaaacugcguggacauugccacaucugagaaccucaccgacuucuugauggaaaugggcuuccgcauggaccaugaguuuguugcuaagggacauuuguuccguaagggcaucaugaagauuaugguguacaagauuuuccgcauccuggugccagggaacacagacagcacugaggccuugucacucuccuaucucguggaauuaagugugguagcacccgcugggcaggacauggucucugaugacaugaagaacuucgcagaacagcuaaaaccucugguucaccuagagaaaauagaccccaagaggcucaugugacuaagaggaucuguccacauuuggggccuauccuuacuuguuugaaaaaauauguuugcuuuuuuugguuuuuguuuuguuuuguuuuugagacagagucucgcuuuguuucccaggcuggagugcaguggcacgaucucggcucacugcaaccucugccuccuggguucaagcaauucucccaccucagccuccugaguagcugggauuacaggcacaugccaccaugcucagcuaauuuuuguauuuuuaguagaaauggggauucaccauguuggucaggcuauucucgaacuccugaccucgugauccacccaccuuggccucccaaagugcugggauuacaggcaugagccaccacgccuggccaaaaaaauauguuuuaaaugucccauuucaccauugccaggcaggcauucuuccuucagggagaggauggugagaauuaauugguucuuugcacuguucuccucauguggcgauuucacuuucaugacagccuuucuauauuaaaggcucaggaugucacggagaaucuaucuaaucccacuguauuaagaggggaaaccgggccaagcgcaguggcucacaccucuaaucccagcacuuugggaggcugagguagguggaucacccaaggucaggaguuugagaccagccuggccaaauggugaaaccccaucucuacgaaaaauacaaaauuuagccgggcaugguagcaggcgcuuguaaucccagcuacuugggaggcugaggcuggagaaucgcuugaacccaggaggugaagguugcagugaccagagaugacgccauugcacuccagccugggugagaagagcgaaacuccgucucaaaaaaaaauaaaaaugaagaggggaaaccagaauaaauuaucuuuuggaaaggacaauuucuuguuuggccauuuguguauaagguugguaacauuagaggcugugagcuuguguuacaugguaauaaagccaaugaagagaca

SEQ ID NO: 191419 - RNA, 32753 nt, Homo sapiens
uucauauauuacuucauuuaauccucaaaacaaucaguaucuucauuuuacacagaaauaauaggauauuggcaauacccaaggagcacuaugguaguuaccuuguauaugccauggcaaaucugcccuaaaagcugcugcaguaauucauauucccauuucauagaugaagaaacuaagguucagccaggucuguccaaccccaaagcauuuugggguucagccaagccagacaagggacccacaagggagaguacaaggaaaaguacaucaauggcuuggguauaaaaauuuauuauacauaaagaauauuaccacuaacaaaugcagacaggcuaggacaugguacuggguggaggacggcuagcucuuuggaaagugaaagguuuggguggcgugggccucaugccacacugauuggucaguagacagggggcacaugccaaacaccacagggcaucagaugcugcucugugugcucacaaguguucccugucuuaucugggccuucgaagggagcacacccagaagcgagcaacugaagcgaaggggcuuccuaaggugccccuuccaggcuugucucugaagucacagcaacacuguuuuaagcaguauguuuaauuggaugauuuccacaaacuauccacgaaguuucuaaccaucacaauucagugaaguacaaaacacugaguuacaggcugugggaagagaaggcagcaccaaugguggcaccuucuaauacugguuguucuaggggcagggagagggaaaggucuuuuuuuaaaccaagccccucauuucaauguacaaaagaauuacucugaucgauauuaaaucguauugaaaacaaaauggacuaaaaagcaaauacuacucuauguugggguggaagugggaggaaagaaugaguccuucgaagcaggaagggagauagcaggggaaagguucugugccugugaccuugggcggucacucacguugcuccauuuuuacuuucgguggucucaggaagguccgauuuuucuucucuuucuuccccuucguauuggcuuggaaguuucgccagcuguccacacgaccaucucgacuuuccuaaguacaaaagaaguuugaggugaggagaccagucaaugaguggaaaggccuaaaccuggucugccauccacucacccuccuguagcccagcccacuucaguccucuggaauaacccaagaguagaauagagcuggccaggcacaguggcucauaccuauaaucccagcacuucgggaggccgaggcgggcagaucaccugaggucaggaguucaagaccagccuggccaacauggugaaacccugugucuaauaaaaauacaaaaauuagccgggcgugguggcaggugccuguaaucccagcuacucgggaggcugaggcaggagaaucgcuugagccuggcaggcagagguugcagugagcccagaccaugccacugcacuccagccugaacaacaagagcgagacuuuguaucaaaaaaaaaaaaaagaaaagaaaaaaagaaaaaagaguagaauaggccaggcaugguggcucacacaucagguggaucaccugagguugggaguucgagaccagccugaccaauauggagaaaccccaucucuacuaaaaauauaaaaaguuagccgggcaugguggcgcaugccuguuaaucccagcuacucgggaggcugaggcaggagaaucacuugaaccugggaggcggaggucgcagugagccaagaucacgccaucgcacuccagccugagcaacaagggcaaaacuccgucucaaaaaaaaaguagaauagagcuuucuucccacucccaagggcccaagaaagugucauagcaccccuagaacgcaggaugagcugcagguugcaagaggaggacgaaaucaguaauaaucaucacaacacugaggccccauuuguuggggaccucgaggcuagacguuuaacaugguuuuuuuuguugucauuguuguugucuuuugugagaugcagucucgcucuguugcccaggcuggagugcaguggugcgaucucggcucacuacaaccucugccucccggguucacaucauucuccugccucagccuccugaauagcugggacuaaaggggcccgccaccacgcccggcuaauuuuuuguauuuuuaguagagacgggguuucaccguguuagccaggaugguuucgaucuccugaccucaugauccgccugccguggccucccaaagugcugggauuacaggcaugagccaccucacccggccuuuuuuuuucuuuuuuuuuuuuuuuuugagacggcucugucacccaggcuggagugcaguggcacaaucuuggcucacugcaagcuccaccuccuggguucacaccguucuccugccucagccuccugaguagcugagacuacaggugccagccaccacaccuggcuaauuuuuuguauuuuuuuaguagagacaggguuucaccauguuagccaggauggucucaaucuccugaccucaugaucugcccgccuuggccucccaaagugcugggauuacaggcuugagccaccacgcccggccagcauaugguauuucuaauugucaccaaaagccgacuaugguguguacugcuaccagugcuucacaaauaacacugaggcucaaaaagguuaaaugauuuucuaaaagccauacagcuagcuagcaguacagcuacucuuuccacugcaccuuucugcugccccccaaaacuuggauggcugcuccaaagccaguacaaugccuagcgaguuguguagggguggccacuaggaccucuaccucauuaucauuuuuucucuuuccauacaugaagugcaacagaaacaaagucaucaacucugauuagccagccccuaaccaugaguccuaaacccuauagaagaaaagaccgaauguugccacaauccuucuguccaaccaccugaagcauauaaccagggugucaaagaagagucaaguucaaagguucuaacucucucugcagguaggacacugugggcacaagaacuucagcaucuacuaacagaucucuaagcagcacaauacucuaugcuuacccccuaaauuaaaagugcaauccauuuuucuugagcccacugggcagcugugccuacuacaaucuaaaaaaccauucagggugaaacuguuagugugcuguaaaaagaaauuaaacaauaauuuuuaaaaauaaauuuuaaaaaagccauucagggauccucaucguccuugccaaggcuacagagcuuacaggaggcugaggcaggcccagccucauucuucaccucucccacucuuccccacauaucccacuccccucugacugccccacucaguccugggagcgccacaggaaccaagcugccuuauucuggaauuagaaucccuggccaccuuggaaauuuaccucaaaguuuuucugccacucucuuucccguuuggcuuuuucuugagcuucaaucucuucuucccuuugucguuuccuaggaggaaaaccagaucauaguauuuauaugauacuuacagacugaauuaaccauacaagguggcaucuccccacagaagcaagcauauauaguaaaucaauucccuagaagucuacaaagauggcugucuggaaagggcucauagcauuuucaugaaugucucauucuaaaacacgcagaucagacuugggcauggcuguggggaaagacauaaauauccuuguuacacagauaaaguaacuaaagcccagccaagagcaaucugagguuuugggcucuuucagugacaaagcuaugucgagaacacaggccaccuuauuucagcagaaugaccauuauaaagccaaaguucuuaagaucucuggacaaaacccuauccgaaaacaaagauauuucacacaaccucaacuagcaaauuuuaguuacugguaccuaccaagcaacaauauaaaauacauacagaaacaaaacucggccggauguagcggcucaugccuguaacgccagcacuuugggaggcuggggcagguggaucaugugaggucaggaguucgagaccagccugaccaacauggugaaaccccgucucuacuaaaaaugcaaaaauuagccaggcaggagaaucaccugaaccuggggagguggagguugcagugagccaagaucaugccauugcacuccagccugggcaacaaaagcgaaauucuaacauuucugauguucaagagaaaucauauuuuagaacauuaaacauuuuguuacugaugacacuacaguacuauacacucaccaaagcuguagccacuagccccacaaaagguucuggcuucaguaacaauggccuuaauaacugcuuauuucacuccaggacaucaggaagaacacacacaaggcucuugauuauaaauaaacucccuggcagcaugcaguggcucaugccuguaauccuaacacuuugggagggcaaggcaggcagaucacgaggucaggagaucgagaccauccuggccaacauggugaaacccugucucuacuaaaauacaaaaaauuagccgggcauggugguguacaccuguagucccagcuacucaggaggcugaggcaggggaacugcuagaaccugggagguggagguugcagugagccaagaucgcaccacugcauuccagccuggcuacagagcaagacugugucucaaaaaaauaaauaaaaaauacacucccuaaggacagaccuauucaauaauucucaaaagucaaagaaaaaaacuacuuacccuggugauucaaaagcuugacuguuuuuagguaacuauuuuuauagucucuuaaaugguauacuauauaauucccucauuaggaaaaucaccaaagaccaauguuaguuaaucuagguauuuaaauaugguuuaaaugaauauacugauauguaccuuucaugcaucucuuuggcuucucucucuuuccuuuuaauuuccagcucugcaaagaguuucauugucuguuuauauacagcuuguuugaacuacaggaaaaucaagaacaaaagaaaaucagaguaaauauuuuuaccagcaacuugaaccauguacuuucaccuggaguccaagauaaagcagauuaaaaccuggcacaggcugugcaccguggcucacaucuguaauuccaacacuuuggaaggccaaaggcaggagaaucguuugaggcuaagagcuugacugcccuggcaacauagugaaacucuauugcuacaaaaaaauuuuuuuuaaaacuagcgugcaggccaggcgcaguagcucacaccuguaaucccagcacuuuggaaggccaaggugggcagaucaccugaggccaggaguucaagaccagccuggccaacauggugaaacucugucucuaucaaaaauacaaaaauuagccaagcauguuggugcgugacuguaaucccagcuacucgggaggcugaggcaggagaaucacuugaacccaggagacagagguugcagggagcugagaucaugccauugcaccccagccugggcaacaagagggaaacuccgucucaaaaacaaaaauuagcggggcaugguggugcacaccuguagauccagcguuucaagaggcuaagacagcaggaucacuuaagcccuggaguuugagaccacccugagcaacauagugagaucccaucucuacaaaaaauauuaaaaauaaaacauuaaccaggugugguggcgcacacuuguagucccagcuacucagaaggcugaggugggaggaucgcuugagcucaggaggucaaggcugcagugagccaugacuaugccacugcacuccagccuggacaacagagcaagacucuaucucuuuuuuaaaaaaguauauuauaugauagucuuacaaugauaggaacagaagcuauuauuauuuauuauuauuguuuuugaaacagggucucaaucugucacccaggcuagagugcaguggugugaucauagcucacugcagccucaacuccuaagcugaaaagauccuccuacuucagcccccaaagcacuuggauuauagguaugagccaccagagguuauuauuagaauguauaauauccacuaaggugggaggaucacuugagccuaggaggucaaggcugcagugaguuaagaucaugccacuauauuccagccggggugacaaagggagacccuaucucuaaaaagaauuacaaaaaaauaagugaacguaagugacccagccccugucacacuaaguuaaugaaaucacaaugcccucccuaccaguuuuuaauucuuuauuuucaagaguucuuaagaacacagcuuauguuauucuaccuuuaaauauuuuucuccagauauaaaguauuuuaaauagacauggaaguacaaaaguaaucugucaugcauauuuaauagugccuaaauucuaaaaucagacacuggagcaaagagugauauauggagagaaaggaaaauaaagaagucccuaaaucucugugacuucucuuuuauccuguuaccugcuagacacugcucacuaaaagcaaugcuucaaccccagucccuaauaaagacaaacaucaaagggauaaaggagucuguaaugaauagcucaguauauuuaaaagcuccauacacgggauagacagacacugcgauuuuauauuuuuuauauuucucuuuuuccaaauuuucuaucauuagcauguguucuuuuauaaucaggaaaaaaaaaaacaacugaaaaaaauugggccaggugcggugguccacgccuguaaucccagcacuuugggaggccgaggagggcagaucacuugaggucaggaguuugagaucagccugaccaacaugaugacaucccgucucuauuaaaaauacaaaaauuagccaggcuugauggcgggcaucuguaaucccagcuacucaggaggcuaaggcaggagaaucacuugaaccugggaggcagagguugcagugagcugagaucgcaccacugcucucuagccugggcaacagaguaagaccccgucucaaacaaauacauaaauaaauguauauuuauauguuuuaaguucaaauaaaauguuuguuguuguuguuguuguuguuguuguuuuaagacagagucuugcuaugucaccaggcggaggugcaguggcgcgaucuuggcucacugcaaucucugccucccagguucaagcaauucuccugccucagccucucggguaguugggauuacaggcacgugccaccacgcccagauaauuucuguauuuuuaguagagacgggguuucaccauguuggcccggauggucucgaacuccugaucucaugauccacccgccacggccucccaaauuucugggauuacaggcgugagccacugcgcccagccaaauaaaauguuuuuuuaaaaaauaaaaauuaggccgcgcacgguggcucaugccuguaaucccaacacuuugggaggccgaggcggguggaucaccugaggucagaaguucaagaccagccuagccaacaugaugaaaccccgucucuacuaaaaauacaaaaaaauuagccagaggccgggcaggguggcucaugccuguagccugcaaucccaggacuuugggaggccaaggcaggcggaucaucugaggucaggaguucgagaccagacugacaaacauggagaaaccccaucucuacuaaaaauacaaaauuaaccgggcauggugguacaugcugguaaucccagcuacuugggaggcugaggcagaagaaucguuugaacccaggaggcagagguugcagugagccgagaucgcgccauugcccuccagccugggcaacaagagugaaacucagucucaaaaauaauaaauaaauaaauaaauaaaugugaaauagcauauauucaucauucuuuuggcuucugucucuguaacccaccaauucguagacacaaucacacaagauacaguggcuuuuccuauauuuaacucaccagcucaggaucauccuccucuacaauuguagguuuuccuuccuucuuuaauuguuuuuuucgcucuuucaccuaaaaagaauuuuuuuucaucaaaagacgagcaucugugcuuugagaauauccacugggcuguacacauacaauauauuuaacuuucuauaggcacggguauagcaaaaaguuuucauuaaaaaaaaaaagagccccuccccucccuccucaaaagaacaacagaaucaaggaaaauuaggaaccacaaguccuuuuucuaaucucaucuaaaauccaaucuaccaggaagaaugaaagaugaaaggggaccaacgggagguuguccccaacucaucagauccaaaaagucuuugaaacagacuacuuauuuaccuuucuuggcuugugguuauguguuuagagcaaagcaaauauaucugucaaguuuuagaagaagcuacagaaucuguggcauuauguccaaguaguuuuucuggcauuucuauaacugcauucuugaucacuuucaccauggaaccuccuuaaaccacauaucauauuaacugauacuuuuaucacauuggccacuacugagauaaaaaauaaauaaauaaauauacgaauucauacaagaaugacacuacuccaugaacuaaccagucuauuauaccagcaaaggccaaguacccucuaagcucagaaaggcccuacugccacccuguggucaggaagccuaaggaugacuuucuuacaggugaaagacauacgaagccacaaugauuuaaggagaaacugucaggcacuuucccuauuucuaccaggauagggccuacaagugccauuuccaacacaugacccgcaggauauaguuaugggcccuuugucuccucuucuuauccauuuuccucaccgaaacuggauucauuauuaugguuauaaaguugucucagauuucaaagcucuucaugugaaaagucauccaaucacaauugaagcagcucuuacaaaugaccucaagauucuugccccagcaaguaaaaaguuaaaagaccuuucuuaccuugggaaagccauacugacauuucccaccacauuggagacuuauguaugcccucaagagcaaacaaaaauaacaccagcuacaacucaguuuccuucaacugaguucuucccaacucuguuauuaagauggacauaaaccuccuccuauuuuaaaaaaaguuuacgccuauccucuugcuagccuuugccaagccuuguugcaaacccuucacagggacaagaauaaaaaucaagagucaagagucacaggcugcuccacguuuccacucuaagaaugggguaaguggcaauaugugaugagagggagagaacaacccuuucuccccaacacaggacugguagggaaagagguaggagcaguguaccagcuacuccucaucugaguucuucucuuaggggugaauuacagcuucaggcacacacuauucaugaccaccacagcaaagugguagagagcacagaaguagccacagguugugccaguaggcauuacuauguucauauguacccuucuacaaggugcccaaggcuugcugauacuuccuguaaacacagcagcacuauaaauacuuacaguguguuccacguauucuuuuccugccugaauuacauccagggcccucuucuuuugcuccugauccaguagcaacuuguaagcuuuguccacagcuaaugcaaaacauugaaauuaacuguuucugcaaacacccucugaaagucugaacuauacucaggcaguguaaauggacuugugcucucuaaagcauucccuacuuuaauuauuuacugucguuaaacuaaguuaaaaaaaacauucaacuauagcaaugacuuuccuuaagagccuuggaaaaaauuaaauauauacucaaggcuaaauacacuacaucuggauuuaauucagugauaaaauucuuuauguucaaagaaaaaaaaugauccuaugcaauaacagucuuuguuggcauauaaaaguuuuaacaaagcaaaguuaaggucuacuucuuaaacaacaacauucugcuuugaaauggcaacugcucuacugaaaaccacagcuucuuggugaccagaagacaaaacuauaacagucuuugcuugaucuaggacaaggaacaguuaggcccugccauucacaaucuaauacucagaagcagguaaauuuacaaauaccuucaaaagccuuuugugcucugucagcaucaucuugauuuuugucaggaugcaccaagauggauaacuacaauaagagaaaaguugggguugucaauaagggaaacauuuacuaacuuccagccugcccugucucguuacaaccaaaagcucuaagguccuacggcaaaaagagacucuuagcaaaagcauuuaaaaaauuaacaaaucucuuuaaaugcccagaaauacugaucuuuaacaaaauucaagcaccaaaagguaaagguacaacuaggaaacauuucagguuuuaaucacaaaguugagaccaaacaugccaggcacagaggcucacgccugucaucccaccacuuugggaggcugaggugagaggauuacuuaagcccaggacuucgagaccagccugagcaacauagcaagacccugucucuacaaaaaaaaaauuuuuuaauuacccagacauggugguggucgccuguaguccaagcuauuuaggaagcuaacgugggagaaucacuugagccugggagguugagauugugccacugcacuccagccugggcaacaaagugagacccugucuccaggaaaaaacaaaaacaaaaacaaaaacaaaaacaaauggaagccuagcacuaugaagauguuguaauaauuugggggaggagggagacugaaagguaucaaguuccuauuauguuccuuaugcagguugagcacccaaaauccaaaaggcuccaaaaucugaaacuuucugagugcuaacaugaugcucaaaggaaacgcucauuggaacauuuugaauuuucggauuagggaugcucgaccauuaugcauucugcaaauauuccaaaaucugaaaaaaucugaaaucugaaauacuucuagucucaagcauuucagauaagggauacucaaccuguacuaagcacuaagguggcuaaagcagguaugagacaucaacucucuccuaaaagaacuccuaaucuaaagcaguuucucauucugccugugcuccaacccugugaagcuucugaaaaagacaacauucuaauuuccacccucagaccuucugaguuagucuuuggcaucugcacuuuguaaaccucuacuagacuggguuucagaugaucguagggaauuagcccuuauuuuguuaggugggauaagugauuaugcaagaaaauguccuuuuuuugggaaggguacaagcugaaguauuuagggguaaagcaucaugguuuauugcaauuuacaaugauucagccaaaaauauauaguuaaauauauagucagugucugccaggagcaguggcucccgccuguaaucccagcacuuuggaaggcugaggcuggcagaucacuugaggucaggaguucgagaccagccuggccuacauggugaaaccccgucucuacuaaaaauacaaaaauuuggcaggcacaguggcacacaucuauaauaccagcuacucaggacgcugaggcaagagaaucacuugaacucaggagguggaggcugccgugagccaagaucgcaacacuguacugcaaccugggugacagagccggacuccgucucaauaaauaaauaaauauauauauauauauauauauauauauauauauauauauauauauaaaugaaauuaacuauucaauauagaugguggauacaugaauauucguuguucuauucuuuuuuuuuuuuuuuuuuuugagacagaguguugcucuaucauccaggcuggagugcaauggugcuaucccagcucacugcagccucaaucuccuggacucaagugauccucccaccucagccuucugaguagcugggacuacaggcacggcuaauuuuuggcuuuugcuguuguuguuuuucguuuuuuguagagacgggguuucaccauguugcccaggcuggucacgaacuccugagcucaagcaaucugcccgacucaaugucccaaaauacuaggauuacaggcaugagccacuaugcuuguccauucuuuuuucuauauaaaauuuuuauaauaaaccagcuaaaaaaaaaagaacuuucauagguaauucagauacucacaguuaaaaaccaugacauauugucaauugacagaaaccaacuaguuggaacccagggaacuaugucggggaaugagaacaaaugggaaucuaacgcuccguucagcauuacuggaaccauuaugcuggguucuaauuccaacuucaaucaccuacuagcuaugagaccucgagcaaaucacuuaaccuaucucugccuccgcuuccugcucuguaaaugagauaauacuauguaccuauaucuaauugggcugauauaagaaugaaacaaacaaugcaaguaaagaaauuagcagacuaacacacgcugacaauaguuagcauauagugaggauacauuaugugccaagaguuacucuaaaugccuucuguguaauacaucauuuaaauucuuacaacaaacucaugggauagacaccauuauuacauuuuacaaacgggguaacagacacggaaagguuaaauguaacuugcucaaguuuacacugcuuguuaagugguacagucaagauuuaaacuaguuguauagcuccaauaugcacacucuuaacuaucaguccauauuaaugauuuauuaagaauucuuaacucuuauuauuuauguagcuacauaaaaaauuguuuugacuaugaacuuaaaugcuuauuaauaugggaaugauuaguaaugcauauuagaaaauuugaaauuuuagaaaaaggaaaaagcuaaauauaaguauagaguagagcuuaggaaggaaaaaaaaaagcuauaaaguuauauaaugggauaugauuacguagaccaaguuaaaaaacaucuuggcuuaacuguagaucagaaaaugacuaugagucagcaauauggggaaaauuacuguacugaagaaacaagcacaccacuggauauuaacaaguaucucaucagaagcugaaaauuacauucagcucuggucagacccuauuaaaauaugaaguacauaagacuauaaagaagcuaaggaaaguuuuuuuaaaagacauggaauauauagaaaauccaauuugcaaaggcaaauuauagggacuacgauuauucaacucagaaaaaaagguagccaggcacgguggcucaugccuguaaucauggcacuuugagaggcugaggccagcagaucgcuugagcccagaauugagaccagccugggcaacauggcgaaacucugucucuacaaaaaauacaaaaauuaucugagcauggugaugcacaccuguagucccagcuacuggggagguugaggagggaggauugcuuaaacucaggaggcacagguugcagugagccaagaucacaccacuguacuccagccuaggugacagagugagacccugucucaaaaaauaauaauaauuuuuaagaaaaaaaggcuggggggaggguuacucagcugucaaaacuggaaggauuuuuuuuuuaaguuuacuuuaaaacuuuguaguuccaguuauuaaaccuacgaaugggcaagauucagaagcuauagaucuccuuuccuggagaacuuucaaaaagcacucuuuauaccaguuaucucuuagguauucauuuaaguuggcaaaagauaaaauuacggccgggugcaguggcucacaccgguaauuccugcauuuuggggaggcugaagcagguagaucacuugaggucaggaguucgucaccagccuggccaacauagggaaacucugucucuaccaaaauacaaaaauuagccgggugugguggcaugcacuuguaauaccagcuaccugggaggcugaggcaggagaacugcuugaacccaggagguggagguugcagugaccugagaucaugccacuacacuccagcgugggcgacaaagcaagacucugucucgaaaaauaagaauaaaaauaaaagauaaaauuacagacaaauggagucuuaaagauaaaaaugugcuaugaaucauuugauauguucccuccuagaagacaggggguuugguaguuacaacuccaugcaagcucuauuauucuacuuuauacuuaucccucuuaauuaaggaguugcagagauucuauuuggauauaaaauucauucuauucauagguaagcuauggucauuaaauuauuuaagauuuuauauauuauuaugagcuuuuuuuuacaaaacaguuacacagccuuaaaaaaaaguuaaauuuuggcccaaacauaucaagucaauaauagcaagugauaaaagaaucaugugcuucauacauuuucaaaaaguucaaacagggaaauaguacuguaccugccgaaaccucuuuuuuauuucuucaucuguaacuucaggaucuaucugaagaaccuggaaguaucaaaaucaaaaccauaaaaaaggugaaaauaaauuacauguauauuuaagaguugcucaguaauuauauauauuauaaucagcaucuagaauaguaccccauguucuagaacacaggcuggcacacaguucuagaaauugcuaaagaaauaugaaugaucaaaucaacagaauaacaauuauauugucuuaugguacucaaauaacauaaugcuuauuuucaucauaaaaauaauaauuuauuuuacacccagagacauuuuuacaugagaaaauuuugcauuucuccuucauucauuaaaagaguuuaacucccccucccuuuauuuuugcaaaugucgagaaaccguaauaacucaaaaaagaaaaaaauagcccaauggacacuuuauaauuuacaaggcccagugguucucaaucagagugaauauuagaaucaccuguggaaaccugugagcaauggcuggcccacucuacgaaagucugauuccaaccccauagagcagggguagggccaauaggaggaacaacucuauuuuuuuuuuuuuugagauggagucucgcucuuauugcccaggcuggagugcaauggcgagaucucggcucacugcaaccuccaccuccgcgguucaagcgauuuuccugccuaagccuccugaguagcugggauuacaggcacgugccaccacaccuggcuaauuuuguaauuuuaguagacacaggguuucuccauguuggucaggcuggucucaaacuccagacuucaggugauccgccugccucagccucccaaagugcugggauuacaggugugagccaccgcgcccagccuuaagcaacacuucuuuaaacaaauaauuuuuuuuuuuuucgagacagugucucacuuuguugcccaggcuggagugcaguggcauaaucauaggucacugcagccucaagcucuggggcucaagugguccucuggucucagccucuugagcaacuaggacuguaaguauguggagcgcacaaccaugccuggugacuuuuuaaaauguuuuuagagauggggucucccuggccgggcgcaguggcucacgccuguaaucccaguacuuugggaggccaaggcagggagaucacuugaggcuaggagauugagacgagccuggccaacauggagaaaccccgucucuacuaaaaauacaauauuagccaggcguaguggcgcaugaaaaugagaauuuucaagucagugcgccccacucucauaacuucccaaggagaaaggaacugggaaagucacucaauaggaagagcgaagucacguaagauuuacagacgagggacuguaacuguacauacaaaaauauucauaggaaaaccacuaguucugaggaaaaggaaucucuaggggcaaaccaaaguccaacaaaucccagaggaugcccaaauaaaagaaagaacagaaacugucccacccucacaaaaaaagccucugauaagauuauagcuuacaacuaaucaugccaaauguaauucauaaacccugauugauuuuuuaaaaauaaauuuugcuguguguauuuggggauuacaacaugauguuaugggauauauacagacaguaaaaugguuauagugguucuugaguuaaaaaaaaaaccuaaaauagcuauaaaggagauuuuggggacagcugggcccauuugcauguggacuguaugcuggauaaaguuacuugauguuguuuuccuauggcuaaaguuuccuaagcucuaauuuuauuacaggcuuuuuuugugaagguggggcgauuucuuuuuuuuuuuuuuuuugagacggaguuuugcucuuguugcccaggcuggagugcaauggugugaucucggcucacugccaccuccgccucccagguucaagcgauucuccugccucagacucucgaguagcugggauuacaggcaugcgccaccacgcccggcucauuuuguauuuuuaguagagaugggguuccuccauguuagucaggcuggucuugaacucccaacuucaggugauccgccugccucggccucccaaagugcuggaauuacaggugugagccaccgcgccuggccuuaagcaacacuucuuuaaacaaauaauuuuuuuuuuuuuuugagacagugucuuacuuuauuacccaggcuggagugcaguggcauaaucauaggucacugcagccucgagcucuggggcucaagugguccucuggucucagccucuugagcaacuaggacuguaagugcguggagcacacaaccaugccuggugacuuuuuuaaauguuuuuagagauggggucucccuggccaggcacaguggcucacgcuugcaaucccaguacuuugggaggccaaggcagggagaucacuugaggcuaggaguuugagacaggccuggccaacauggagaaaccccgucucuacuaaaaauacaaaauuagccgggcaugguggcgcaugaaaaugagaauuuucaagucagugcgccccacucucauaacuucccaaggagaaaggaauugggaaagucacucaauaggaagagcgaagucacguaagauuuacagacgaggggcuguaacuguucauacaaaaauauucauaggaaaaccacuaguucugaggaaaaggaaucucuagggguaaaccaaaguccaacaaaacccagaggacguccaaauaaaugagaaagaacagaaauugucccacccucacaaaaaaagccucugaugagguuauagcuuacaacuaaucaugccaaauguaauucauaaacccugauugauuucuuuuuuaaaaauaaauuuugcuguguguauuuggggauuacaacaugauguuaugggauauauacagacaguaaaaugguuauaguauagugguucuuuaguuaaaaaaaaacuaaaauagcuauaaaggggauuuuggggacaguugggcccauuugcauguggacuguaugcuggaugaaguuacuugacguuguuuuccuauggcuaaaguuuccuaagcucuaauuuuauuagaggcuuuuuucaugaaggucggaugguuucuauucuuuuuuuuuuuuuuuuuugagauggaguuucgcucuuguugcccaggcuagagugcaauggugugaucuuggcucacugcaaccuccgccucugggauucaagcgauucuccugccucagccuccugaguagcuggaauuacaggcaugugccaccacgcccggcucauuuuguauuuuuaguagagacgggguuucuccauguuggucaggcuggucucgaacucccgacuucaggugaucugcccaccucagccucccaaagugcugggauuacaggcgugagccaccgcacccagccuuaagcaacacuucuuuaaacaaauaauuuuuuuuuuuuugagacagugucucacuuuguugcccaggcuggagugcaguggcauaaucauaggucacugcagccucgagcucuggggcucaagugguccucuggucucagccucuugagcaacuaggacuguaagugcguggagcacacaaccaugccuggugacuuuuuaaaauguuuuuagagauggggucucccuggccaggcacaguggcucacgccuguaaucccagugauuugggaggccaaggcagggagaucacuugaggcuaggaguuugagacaggccuggccaacauggagaaaccccgucucuacuaaaaauacaauauuagccaggcaugguggugcaugaaaaugagaauuuucaugucagugugccccacucucauaacuucccaaggagaaaggaauugggaaagucacucaauaggaagagcaaagucacauaagauuuacagacgagggacuguaacuguucaaacaaaaauauucauaggaaaaccacuaguucugaggaaaaggaaucucuaggggcaaaccaaaguccaacaaaucccagaaggcgcccaaauaaaugagaaagaacagaaauugucccacccucacaaaaaaagccucugauaagauuauagcuuacaacuaaucaugccaaauguaauucauaaacccugguugauuucuuuuuaaaaaauaaauucugcuguguguauuuggggauuacaacaugauguuaugggauauauacagacaguaaaaugguuauagugguucuugaguuaaaaaaaaaaacccuaaaauuggccagguguggcggcucacgccuguaaucccagcacuuugggaggcggaggcagacagaucacuaggucaggagaucgagacaauccuggcuaacacggugaaacaucaucucuacuaaaaauacaaaaaaauuagccaggugugguggcgggcgccuguggucccagcuacucaggaagcugaggcaagagaauggcaugaacccgggaggcggugcuugcagugagccgagaucgugccacugcacuccagccugggcaacagagugagacucugucucaauaaauaaauaaauuaaacuaaaauagcuauaaaggagauuuuggggacagcugggcccauuugcauguggacuguaugcuggauaaaguaacuugaugugguuuuccuauggcuaaaguuucuuaagcucuaguuuuauuagaggcuuuuuuugugaaguucggacgauuucuauucuuuuuuucuuucuuucuugagacagagucuuguucugucaagugcaguggagcaaucucagcucacuucaaccuccgccuccugguucaagcaauucuccugccucagccuccugaauagcugggacuucagguguuugccaccaugcccagcuaauuuuuuguauuucaguagagaugggguuucaccauguuggccaggcuggucucaaacuccugaacucaggcaaucugcucaccucagccucccaaagugcuaggauuacaggcgugagccacugugcccggccuuucuauucuuucuuaguguuauuuuccaaugggugauaguguugugguuacacggaauuguucuuguuucgaggagaugcaugcuaaaguauuuaggcauuaaguguuaacaacaccuggagcuuacuuucaccacaugauugggcaaaaaggaggagaguauauauaccuacauacacauacaaacacacacuccaaaaguuauuuuuccaagaguuauaucagaacaaauauucacugagugccuucaaagccaauccaacuccucuuuugucuuuaagagcuggaggugccacacguggcauggugaagacaauggacuuuuaccugcggccgguccucuuugaagccagcuuuauacauucaguaccaacuuguagagcacaaaaauuuucuaagauagcuagauacugugcucacuacuuuucuuagucuguuuuguguugccagaacagaaucccauacagugggcacuuuauaaagaaaagaaauguauuucuuauacuucuguaggcugggaaguucaagguugaguggccgucaucagguaagggcaagagggggcuaaacucacauauguaacaagucuauucuugagauaacuaauccacucccaagaugaggacauuaauccaauugugagggcagagaccuaaucaccucuuauuaggcccuacccugaaaagcuguugcauugggauuaaauuucuaacacaugaauuugggggacacauucuaaccacagcucuacuguccucacagaauuuaagaauuacuguucucacaguagauaagggagagacaaguaacaaguaauucugacaaaaaugauaaaugccuuauuaccaacauggcuccaagcacacaggucuguucagauucuuggaagguuuuucugaacuccuguugcgucucaggcuuuuaggauauggagggagagacccacaguuuugaaccucagggagcuaauuaaucaucacacagaaacaaaaaugcuuaacuguugcauucagauaaguuccugaacucaaaauguaacagccaucuccuuuaggaucuucugcuugaaaaaggaauccaggcugggcgcgguggcucacgccuguaaucccagcacuuugggaggcugaggcggguggaucacgaggucaggagaucgagaccauccuggcuaacauagugaaaccccgucucuaugaaaaauacaaaaaauuagccgggcgugguggcgggcgccuguagucccagcuacucgggagacugagacaggagaauugcuugaacccgggaggcggagguugcaguaagccgagaucgugccccugcacuccagccugggcaacaagaaggaaacucugucucaaaaagggaaaaagagaaagaaacaaagaaagaaagaacagucagggaguccugcccacucaaacacaaucuugcagcuuucagagcgugcaaacucaccauaucgucacacaucuaaacauacuuccuauagugagaacaaaggcuacagggcaaugaguuccacuuucagaacuacaauaacuaauagggcacuaaaauccuagcguuucacacugaugcccaacaaucugucccuucucauccaucagguccccacaggagauacuaauuaccuuaacaaaaaauaaauuauauggucauauguucccuuucaugguacuaugcucgauuuuaaaguauggcuagauagaaagaacauaccauaaauucuuuaucaucucuccagcaaaucaucuuccccuaggcccuccccaaaaucauaucaaaaguacucuucaauauuuauacauccauguuuauagcaacacuuuucucaauagcuaagauguagaacaacccauguccaucagcggaugaaugaauaggcaaaaugugguauauccauacaacagauuaccauucagccuuaaaaagaaggaaauucuacaauaugcuacaacauugaagaacccaagacauuguacuagaugaaauaagccagucacgaaaaggcaaacacuaugauuccuuuuauaugagguacuuggucaaagucauagagacaaaaaguagaauggugguuaccaggggcuggggagggaggaaugcggaauuauuguuuaauggguauacaauuucaguuuuacaagaugaaaagaguuaugaggauggauaauaguaaugguuggacaacacuaugaguguauuuaaaaacaaugaacuggcugggcacaguggcucacaccuguaaucccagcacuuugggaggcugaggcggguggaucaccugaggucaggcguucgagaccagccugacuaacauggugaaaccccaucucuaccaaaaauacaaaaauuagccggaugugguggcaugcaccuguagucccagcuacucaggaggcugagacaggagaauugcuugaauccagguggcggagguugcaguaagccgagaucacgccacuacacuccagccugggugauaaagcaagacuccaucucaaaaaaaaaaaaaaaaaaaaaaugaacugguuaagaugguaaauuuuauguuauguguauuuuacaauuuuaaaaauugaaaaaaaaaguaaucuucaagcuuuuuaucucccccuucccuuccuaagcaauaaauccaaauccauuaaguggggucaggcaaaacagacgucuacucugggugggagucacauggcccagagcacagugucagagcccaccuggaacaaggaaggcagugaccacacagaaaguaguggcuagucacagggugcugaagcccaaauggggugagaagggcauccacagagaaggacagccuaacaugguguacaaagaaguucagaaaggcauccccauagacagggaggccagcacaggaacaucagaaccuaagcagggggaaaaugucagcaugggagggcagccagcgcaggauaucagggcccaagagggaugaggaaagcauccguguggaaguagaauccaacacagggugucugagaccaagcaagguacggaggguguccacaggggaagguagccuggcacaggguacaagaacccaagcaaggacauucccacaaagggcagccaagcaugggguauggaagccugguauggugagaaggguguccaaguaguagggcauccagugugaaaaggcagcccaacacaagguucagagcccaaaaaauaugaaaagagacaugguauguggagccagaccccgaguaagaggagaaagguguucauggaagaagguggcuugacggaggaugucaaagccagagcaggguagggaagaugccuacucagcggggaggaucagugugggaugcuggagcccaugaucagugaaaagggcccccagcaggaagagagcaggcucagaaagccagagagccacauggaaggguggccugacaugggaguucagagcccagguguggugagaaagguuuuugcauagacauauccuggugcugguaucagaguacagcggggugaggagagcauucagagggaaggaguggcagugggaaguuaguugcauacagagagaucaauuaaguaaauguagauauuaaauucuguaggagccagcgccaggugcacuggcuguaaugcuauaaucaaucccaguacuuugggaggccaagggaggaucauuugaggccaagaguuugugaucaaccugggcaacauagugagaccuugucuuuacaaaaaaaaaaaaaagaaaaaaagaauaauaauaaagaaaagauagugggaaccagguuucuaacuauuagaauaaauccugugggguuggacugaaaauggauguuggguguaaacauauauguacacacacaaacacacagacuccagggucuguaagcugugauaucccaacagcaaugaaucuaccuagcauucaaaucuugauuucuauauaucauucucugccaaaaggaaccagcgcuccuuggugaaaugguuaauuccaggcugggucaggaaaaacacaaaagugccuacuaaucaaagaaugaugaagacauaugaaagacacaggagcuagauugaaagguaacccacuggccaaacuugagacaaucugagcaucaaaauaaacauaaaauuacaacguacugaauaaaauagaaaaaccuaaguccauacuggcaaauaaaugaacuaaaauuuugauauggacaggauauuuaccaaguuucaaagcaccuccacauaaaauacuuauucauuacaaaggggaaaaauaguaaccucaugacacuucuuuuuauuuuugagauggagucucacucugucgcccaggcuggagugcaauggugcaaucucggcucacugcaaccucugccucccagguucaagcaauucuccugccucagccucccaaguagcugggauuacaggggcacuccaucacacccgguuaauuuuuuuauuuuuaguagagacaggguuucaccauguuagccaagcuggucuugaacuccugaccucaagugaucugcccgccucagccucccaaaguguuggaauuacaggugugagccaccgcgccuggccagggagaccccaucuuacaaaacaaaacaaacacgccaggugugguggcucacgccugaaaucccagcacuuuuugggaggcugaggagggcggaucaugaggucaggaguucgagacaagccuggccagcuuggugaaaccccaucucuacuaaaaauacaaaaaauuagcagggcaugguggcacgcuccuguaaucccagcaaccagggaggcugagucaggagaaucacuugaacccgugaggcggagguugcagugaaccgauauugcgccacugcacuccagucugggcaguggagugagacucugucacgaaacaaacaaacaaaccaaagagccaaacacaguggcucacaccuugaaucccaguauuuugaaaaucugagguaggaggaucaauugagcccagagcccaggaguucgagguugcagugagcuauacagugagcggagugauagagaggcccugaaaaacaccuuuuugggacaauuaguaaaaccugaauggggucugaugauuauauaguaacaauguauccagagaggcccugagaaagacuuuuuugggacaauuaguaaaauuugaauggggucugaugauuuacauaguaacaauguaucaggguucauuuccugauuuugauaguuuauauugugguucaguaagaggauauuuguagaaaaaucacauuaaaguauaucagggugauggaccaucauacuaacaauuuacucuuaaagaguucaaggaaaagucuucauauuguauuugaaauauuuguuaaucugagauuauuuauaaaugaaaaaauucuugaaaaauuacucuucaaaaaacagaaaacagaugaaccuugaaaauaucaugcuaagugaaauaagccagacacaaaguaacaaauacgguaccauuccacuuacacggguuuccuagaagaggcaaauucauagacaaaguagaguagagguuaccaggggucagggagaaaaugaggaguuacuguuuaguggauacagaguuucugguuggggugacgaaaaauuucugaauaugaacaguggugaugguuacacaacacugugaauguacuuaaugccacugaauuguaaaacuaaaaaaaaauuuaaaugguaauuuuuuuuuuuuuuuuugagacagucucguucugucgcccaggcuggaguacaguagcacaaucucggcucacugcaaccuccgccuccuggguuuaagugauucuugggccuuagccucccaaguagcugagauuacaggcaugcaccaccaugcccagcaauguuuguauuauuuuuguggagaugggguuucgccauguuggccaggcuggucucaaacuccuggccuaaagugauccucccaccuuggccucccaaagugcugagauuacaggcgugagccaccacaccuggccaaaauggcaaauuuuauguuauauauauuuuuccacaauaaaaaaaagugaggggaguuuuuuucuaagugcccaauaaguguuguuucuauuauuuaacagauacaaaaauauucacuucaaaauuauuuguaaaugugaacaauuagaaaguaguuuagggagucucucugaaccuauucugguucagagggccgccuguuaaaaaaacuuuuuaaagaucugggugugguggcucacgucuguaaucacggcacuuugagaggccgaggcaggcagaucacaaggucaggaguuugagaaaagccuggccaauauggugaaacccaucucuacaaaaaauacaaaaauuagccaggcgugguggcacaugccuguagucccagcuacucgggaggcugaggcagaagaaucgcuugaacccgggaggcagagguugcggugagccgagauugcgccacugcacuccagccugggcgacagagacuccaucucaaaaaaaaaaauuuuagaaagaaauaaacuagcuaaacuauuccacaauaaagaaaugauuaaauaaauuauauggaauuuuuuuuaccccccagucuauuauuuuauaaccaguucauaaaaaguuucuuggggggugacauauuacuuacacaucuauuguguaguaaacauguauguauauguguguguacccaacuacuuuguuggagugauugcugugguuuggaacugcuggggccaaauuuaugcacaaaucuacauuuuugaguaaacuccucaugacuagaguaaguuuccucaguauuugagaauucuucauuuucuaaagcuguaccaacaucagauaucaauauuuguaagcacaaauaauguaauuuauaauaaaauugcuuucucaacuauuaguauuaacuauauaucaucuucauauagccuuauaacucauuuguacuauuccauuuuccucuguuccuuuuauuuucacuuuccguguaauguuagucuguacugaguucugaagaguucauuuaugauuaaagauguuaacagauuuaacaucuugucaagcauugcaaaaaaaaaaaaagaauuucucucucucucuuuuuuuuuuuuuuuuuuuuuuggacaggcgcgguggcucacaccuauaauccuagcacuuugggaggccgcgacagguggaucgccugagcucaggaguucgagaccaaccugaacaauauggcaaaaccccgucucuacuaaaaauacaaaaauuagccaagcauggaggcaggcaccuguaaucucagcuacucgggaggcugaggcaagagaaacacuugaaucugggaggcggaggugcagugagccaagauugcaccauuacacuccagcuuaggugacagagugagacuucaucucaaaaaaaaaaaaaaaaaagcauuuaaaacagcacugaggcuggacaugguggcgaauggcuguaauccuagcacuaugggagcccaaggugggcaaaucguuugaacccaggaguucaagggugcaguaagccaugauugcaccacugcacucuagccugggugacagugagacccugucucaaaaaaauaaaauaaaauaaaaucguauugagcugagccagguguggugucauaugccuguaaucccaucuacuccagaggcugagcaggucaaggagaucacuuaagcccacgaguucuaagccagccugggcaacauaaugaggccccaucucuuuaaaaaagaaaaagaagaagaagaagaagaaggauuaaguguaugaugcucccuguuuuuaagcaaaacaguuugaguguaaacaggaguggcuauuucucuuaggugggauuauauaugauuauucuugcuuucuguacauuugcaacaaauaugauuuacuuuuauaaccaggaaaaguuuaaagcuauaaaauuaagaaaaucaaaaaguauauucauuuaucuaaaaucuugugaucuuuguuuuguuguuguuggguuuuuggcauuuauuauagugaaacagaaguuuuaacaaguaguuuaaaucaagaauccuaggcugggcgcaguggcucacgccuguaaucccagcacuuugggaggcugaggcggguggaucacaaggucaggaguucgagaccagccuggccaacauggugaaaccccaucucuacuaagaauacaaauauuagccaggcacaguggugggcaccuguaaucccaccuacucgggaggcugaggcaggagaauugcuugaaccugggagaaggagguugcagugggucaagaucgcgccacugcacuccagccugggggacagagcaagacuccgucucaaaaaaaaaaaaaaaaaaaaagaauccuaaacuuauuagagcuagccaccccuucacaucugaaauuaaauccuuauauauuuggguugcuaaaagaugaugaaagauaugugaccaucucacuuuccuuaacaugcugucucuccaguucugcucgguacaaucacccaaguuuaaagacaaucuauauacagguuacauaucccuaauccaaaaaugcaaaauccaaaaugcuccaaaaucugaaacuuucugagagucaacugaugcucaaagaaaaugcucauuaacauucugaauuuucuaauuugggaugcuucaaccaguaaguaagcagaauguauguauauauuccaaaaucccaaaaaaauccaaaauccaaaaaacuucuggucccaagcauuuuggauaaggaauacucaauuuuguacuauacagauuccaucacuuuacuccaccauuuuucucaauccuaacuaugauauaaauuagguauguauucugauguagguaugccugcagcuaugcaaaucucccccauuacagaggcccuagcaacaucaaucggcucaccucaaauggguucaaauugaaguaagaggaaccaggacgggucagucuuucaaucugauuuuucgaaguuagaaccgagucucucuucucuauuuguuucaccuaaaauuaugaggauuaaaaacuucauuaauagaauucaauaacaaacugaauuaucuuaacaaaauguucacugauauguucaacaaacauuuauuuguguguuuaccaugugcaagacauuuugcuaaaugcuuugagaaauuaaaacuaccauuuguugaauuuuaauauaaaaaccuuacauguauuuauuaaucucaacaacccuaugugguagauacugcuguuauacccaauucacagauaagaauacugaggcuuagagaagguaacugacuuguucccaauuacccaacuuguaagccagaauuuuaaccccaacaguuugaccccacagcaggcaucaagaggauucaaagauaaauaagucacagccuuuaaagaacuuccacuuuaaugauggaagaugugcuugugugugauuauacuucauuuauagcuuuuaauuuuaagaaaaaaaaaauaggcugggcacaguggcucacgccuguaaucccaacacuuugggaggcuggggggugggcagaucaugaggucaggagauggaguccauccuggccaacauggugaaaccccgucucuacuaaaaauacaaaaaauuagcugggcaugguggcauggcguguagucccagcuacuugggaggcugaggcaggagaaucgcuugaaccccagggacagagguugcagugagccaagaucgcgccacuggacuccagccugggagacacagcgagacuccgucucaaaaaagaaaaaaaaaaaguaagagauuucucugugaggaaaaaaaauaaagaaaaaaauuuaaagagcaaaaaaaggaaaaauacaaucacaguaagacauaaacuaugagcagcauuuaaaacuguugaugggaaggaacaaacaacuccaccaccuaauucuaauaguguuagaaaaaaucccugacuuggccaggcggaguagcugucaccuguaaucccaacauuuugggaggcugagguggguggauugcuugagcucaggaguuugagacaagccugggcaacauggcgaaaccccaucucuauuuuuaauuuaaaaaaaagaaagaaagaaaaaagaaaaaucccugaccugaagacaaugccagggagaacaagcaccaggcagucccaggaaaacauucuuggugucacugucagaguuggaaugcuaguuggaaugaaucucugguaugcuauaugccaucuuuauuccuauagccaaaacaagguuggaaagaauuucauuaacauaaaaagucauuccuucuagacaucuucccucuucacucuaugaaaacaggauuuuuuuucucucuuguucacuaccguauccucaacaccuaaauagcaaacuaguacauuuccaauguucaauaaacaucuguuaaaugaaugaggccagugugguggcuuaugccuguaaucccagcacuuugggagucugaggcaggaggaucacuugggugcaggaauucaagaccaaccugagcaacauggcaagaccuugucucuauuuuuuaaaaaaaugacugaauuacccuuccuuagauauuuuuucccauccaauucaaacaaagguugccauuugguuuuuuguuuguuuuuguuuuuugagaaggggucuugcucugucacccaggguguacugcagugacagaagacagaucauggcucacugcaaccuccaccuccugggcucaagucauccuccaguccucuugccucagccuuccgggcagcugagacuacaggcagugccugccaggugucuagaccuaaauguaauacuuuggagaaacuacuauguaacaaguacuguuacaauugcaagaaauaaaagauggaugugauaugguccuuaacccugaauagcucacagccugcuggggggcaacuccauuccucaaacccaugccacccuacagaggucccaucuucugccuuguuuaacccugagaaagaugcuucugcuuuauuuuuuuaugaaacgcuuucuuauacaauaacuuuaguccucaugaaaauguuuauuuuaaaauuaacucucuugccaagcacaguggcucaugccuguaaucccaacacuuugggaggccaagacgggaggauugcuugagcccaggaguuuaagaccagccugggcaacacaacaagacccugucacaacaaaaaaaauacaaaaaucagccaggcaugguggccugagcuuguagucccagcuacugaugugggagaaucacuugagcccagaaggcagagguugugcauuccagcuugggcaagagugaggcucugucucaaaauaaauaaauuaaauuaaauuaacucucuuguuuuuacagauguggaauaugaagaucugcaaaauuaaugucuugaacaaauucaaucccggccaggcgugguggcucaagccuguaaucccagcaacuuugggaggccgaggcgggaggaccuuaagucaggagaucaagaccagucuggccaacauggugaaacccccgucucuaccaaaaauacaaaaauuagccaggcgugguggcaggcgccuguaaucccagcuacucgggaggcugaggcgagagaaucacuugaaccagggaggcagagguugcagugggccaagaucgugccacugcacuccaggccugggcaacaagagcaaaacuccgccuuaggaaaaaaaaaaagaauucaaucccaguccagucagguuaacugucuuccaagaauuuuuuucuuuuuuagacagucucucgcucugucacccaagcuggagugcaguggcgcgaucucugcucacugcaagcucugccucccggguucacgccauucuccugccucagccucccgaguggcugggacuacaggcgcccacuaccaggcccagcuaauuuuuuguauuucuaguagagacgggguuucaccguggucucgaucuccugaccucgugauccgcccgucucggccucccaaagugcugggauuacaggcgugagccaccgcgcccaaccaagaauuuuuuuuucuauccuuuuuuuccuucuuuuuaaagagacagggucucacucucgccaaaaauggagugcagugguccgaucauaggucacugcagccucgagcuuuuggguuccucccgccugggccucccaaagugcugggauuacagaugugagccacugugcccagccccuugcaauaauuuaaucugagauucugacuccaaacggcaugcuuuuauuucauuuauucauucauucacucaacaaauauuuacugagcauccacuacauacuaugcgcuggagaugcgauaguaaaggaggcucagaacaagcccacugcuguccuaacauaccaccaagcaagcuguaaccuacuguaaggccccaaacuauuucaccucccuaaagcucagguucgucaucuguaaaauggggguaauauaaugccuaacuggcaugauacacagugccuggcguucgugaauggcagaaacaaccacuaaaacaacucauuacaaaggacuaagaaacgucucgggggccaagaaggcuaagucacucccaggaagggcccagccucugccagcccccgacuccgcggacuuggggcacucugcccgcgcgcccgcacuauguuggacacacucgccaccucccucgauagaucgaacaccauucccucuuucguugccccgggggaucucccagcagcuaucagugggagacgcucacacacccccagacccccgccaccccgaagacuggacugaaggaaucgcccaacgguccaggccaggcggccacugccuuuguccacugggaaagcagauccgggagcggucgccccggugccacuacuccucacucuguguucaccucacuguagaaggucauaaaugcuuccucggugcugccuccgccgccugaagucccgcucucuccugaagccgccauuuccccggcccagccaccacgugacccuucugc

SEQ ID NO: 191420 - RNA, 36934 nt, Homo sapiens
gccgcagccagcagccugcagccgccgccggguugugccucagacugucagauaaaucggcgggccgggccggcgggucggugagcgcggcccgggccggacauggcggcgcucuacgccugcaccaagugccaccagcgcuuccccuucgaggcgcugucucaggggcagcagcugugcaaggugcgcgggcuggggcggcggccgggaacuggggacgcaggaggcgcggcccggagcuccagauucuguggggacgcccggcgggguccccggagcaggguguggcaggcccgccaggcugaggagccgcacccaccccgcugggggccggcggggcacgugcgggagccgggacccgguccaggcucccgcggccggcguguccgggugcuuagcaaccguggggauuguucucggaccccgugaggucgggggagggacagcggguccccugcuugcccugacuggucgccuucgggaucccuuugcgcugccucccccgccgccgcggucucccugguggggaccuccugccccuccugggacugaacuccaaaguugggugcugccuuggaggaaugugucgaacucgggcuccucacgggcacuuuucgaccaguuucagaaucggagguagcaaggcuugauuuuuuuuuuuuuuuuaagcaucucacuuuucggccagucucagaaucggaggcagcaaggcuuuauguuuuaaaaaagccccacagucaggcucacagauccgagggaucacuucucagcauccaguugguggucuucggucuucccugacuagcugcugaucaguuuuugcuccugaagguccaacuucucuuuuucuuuuaaguugcuuuaucccacuuuuacuuuuuaagugacuagaggugcugugaggcaacaguuaaaaagucaccaaacuggcugaagaauaauguugagguuauccaauaauccaguuugugucucugauuuggauaacucauaauugucacuuuugccucagauggucaugacuuuccauuugccaguuuuuauauaccaggucugggggaaugcaagugcuugagugcccuuuuuggccucaaaauauguauauaugauuuuaaggaaguuauguauauauaaauaauaauuuuaauccagcacuuucauuucacaaguaaaccgcaaaaucacacaguggcagaagaaccaggccuggaauucagggcuucugauucccagucugggacuuguucauauauauguuuguuuuacaauuuauggcuaguuccauauaauccauauaaguucuuacuuaacucccacaucaacaguagggaagugaugccaguauuacagaggagaaaaauaaggcccagaaaguuuaagugacucacucaagcauaguagcuaugcuagaaauaguacccaggucggcuuccuacugaaggcuguuuccauuugugacugccuuuuaaaauuauauccucauuucauuucaggaaugucggauugcacacccuguugugaagugcaccuacugcaggacugaguaccagcaggagagguagaguuuuguugaccaugaaagauauuaauaggcuuuuuuccucuuaaaaucuguaauugauugcauuucauguacagaugcuauaaucaguugcauuguaaaauacagaucuguaaucaaucacauuauauacagacuauaauugcuaaauauuuaggucuaugauccaucuugaguuaauucauguguggggugagauauacaaugaaggguauauaauacauguauuguuuccuaguuauuauccauugauugcuuaaauuuuuuuuuuuuuuuuuuuuuuuuugagauggagucucacucugucacccaggcuggaaugaagugguaugaucucagcucacugcaacccuucccucccagguucaagcgauucuuaugccucagccucccaaguagcugagauuacaggugccugccaccauguccggcuaguuuuuuuguauuuuuaguagacgggguuucaccaucuuggccagguuggucuugaacuccugaccucgugauccacccgccucagccucacaaagugcugggauuacaggcgugagccaccacgcccagccugcuuaaauuuuuaaaguucuuuuuaagacccuugaucauuuuauauugugauuauaaucuuuuugucaagaagaaaccaaucccacaacaguaaaacaugagccucauguuucaauauguacauacacagagauugaagaauuuauaagcccaaagaagauacuuuuggaaaugugacaauccugauaagaguuugcuagcucuagucacauuugaaacucacuugccauuacacuuuccuugggcaaaucucuuuuuuuguuugaaacagagucucucucucccagucagguuggggugcaguggagccgucauggcucacugcagccuggaccucccgggcccaagugauccucccaccucagccuaccaaguaacugggaccacaggugugugccaccacgcccagcuaauuuuuuuauuuuuguagagauaagauuuugccauguuacccaggcuggucucuuacucaugggcccaagugauuccuuccucguuagccucucaagauguuggaauuacaggcgugagccaccacgccugggcaaaucucauuuuuaaaagugugaaaugggcuggguacgguggcucaugccuguaaacccaacacuuugggaggcugaggcagguguaucaccugaggucagaaguucgagaccagccuggcuaacaugacgaaacccagucucuacuaaaaauacaaaaaaauuaccugggugugguggcacacaccuguagucccagcuacuuggggggcugaggcaggagaauugcuugaacccaggagguggagguugcggugagcugagauugcgccacugcacuccagccugggugacggggggaaacucugucucaaaaaaaaaaaaaagugugaaaugcagguaugaguggucagacaucuuuagggggcauuuccauagcaacaaagugauuuuuuuuugguaccaaguuugauucuuguggaacuucugugaguguaggugauccugccuugaggagagugggaucuauuuguuaauucauccauuagaccuagaagccuauuuuuaauuauucauuucaauucuuagaauaucuucuccaagauuuuaucauggauuuuuuuuuuucuuuuaugagacagggucucucucugucacccaagcuggagugcagugagaugaucucagcucacugcaaccuccccucuccgggcucaaaugauccucccaccucagccucccauauagcugggaccaggggugcacaccaccacacccagcuuuuuuuuuguaucuuuaguagagacaggggucuugccauguugcccaggcuggucuagaacucuugagcucaaccagucugccugccucggccucccaaagugcuggaauuacaggcgugaccgaccacacccagccuaucauggauguuuucaaacaaaaaaaaaagguuaaaagaauuagugaacacccauaugcccucuacuuaaauucuaucauauacacuuuacuauauauucaccuauccaucuguucaucucucucuccaucacuauaucaauucauuuuauuucugauguauuuaaaguugcagacaucaguauacaugacccuuaaacacuucagcaugcacagcauuauuuagaguuaaauauuuguuugcagcucuuuuuguguguguguggcaaaauuggcuuacacuaacaugcuugaaucuuaaaugcaucaaguuuuacaaacauagacaucuguguagccccaaacccuaucaaaauacagaauguuacugucaccccauagaguccucucaugccccauccuagacaauccccacacccuugcuuccuccaggcaaccccuguucuacuuuucauuuccaccauaaauuaguuuugccuauucugggacuucauguuaguggaaucauacucuagaagcuuuauauguuagcucuuaaauuuaggucuaugguccaucuugaguuaauucauauguggggugagauaggaacuaugacccuuuauuuacacuauacauacaaauuaauucaagauggaucauagaguuaguuuuucuuuucuuuuucuuuucuuuuuuuuuuguuguuguuguugagacagaguuucgcucuuguugcccaggcuagagugcaauggcacgaucucggcucacugcaaccuccaccucccagguucaagcgauucuccugccucauccucccgaguagcugggauuacaggcauguaccaccgcgcccaacuaauuuuguauuuuuaguagagaugggguuucuccuuguuaaucaggcuggucucaaacuccggaccuccgguggucugccugccucggccucccaaagugcugggauuacaggcaugagccaccgcgcccagccuagaguuaguuuuucuuugcauguuuuuuaacauguuaggaacauauguauauauugacaucuaccccauuccuucaguaguaaaucuaggcguaaaucaaaaugcuauucuacaucacagaaucauugaugguaauccucuuucuagagauuucuuugaauguccuucacuuauuuuacugucuuuuaaaaguaacagaaaauugcccugaaaaauaauuuauaauuuaaauauuuucuacucugagguuuuucuuuugucuauuuuaacuuuauagucacuuucacaggaauuauaugggaaaaugaucacaaagcagagaauagacuaguuuuuugugugugugugugacagggucucacucugucacucaggcuggagugcgguggcacaauuguagcccacugaaaccuugaacucccaggcugagccuccuaaagugcugggauuacaggcaugagccacugugccuggccuuaagauuuuuaugugauuuauuaguuuuuagccccaaaguacuguuuaaauuguucuuacacauaagacauucauuuuuaccuccucaugugaagaguuagacuuuuauuugaagaugauuuuucccccgggcagcuuuauuaauucacacauuuagguaauaggaccucuggaucuucacaaggcaaaggauguuuuuauuuuugucagugcuuaacucuuagagaaaucagaauuuuuuuuuuuuuuuuuuuuuuuucgagacacaguuuugcuguugcccaggcuggagugcaauggcgcaaucuuggcucacugcaacuuccaucucccagguucaagcgauucuucugccucagcccccugaguagcugggauuacaggcacacaccaccacgccuggcuaauuuuuuugaauuuuuaguaaagacaugguuucaccauguuggccaggcuggucucaaacuccugaccucaggugaucugccugccuuggccucccaaagugcugggauuacaggcaugagcuaccgugcccggccuaaauauugacaaaauauuugaucauagugucuuuuuccccaccucugguguuuucauaugccuuuacuuaugaaggagagcacagaguaagguuagcaaagauagaaucucugaguuuauauuccagacacacauacuuuauuugucaccucaaauuucccaacuauucauccgaauuaaggagaauuuauuuuuuuuuccugcuaguccauuuuaguauaauauuuugaggguguuuucuguaucugauaauuuuauuuagugauacuuggggaugucauaaucagaaauaacucacucuccauuuuagccaaagccucacuuguuuuuuugagacggaguuuugcuuuuguugcccaggcuggagugcaguggugaggucucggcuuacugcaaccuccgccucccggguucaagugauucucuugucucagccucccaaguagcugagauuacaggcacgcgccaccacgccuggcuaauuuuuguauuuuuaguagagauggaguuucaccauguuggcugggcuggucucggacuccugaccucaggugauccaccucccucagccucccaaagugcugggauuauaggcgugagccaccacgcccagccacauaauaauuaaaagaguuauuagaggcuagguguagugucucacaucuguaaucccaucaguuugggaggccaaggcagauggaucgcuugaggucaggaguuugagaccagccuggccaacauggcgaaaccuugucucuaucaaaaauauaaaaauuaguugggugugguggugcgcgccuaugauuccagcuacuugggaggcugaggcaugagaaucgcuugaacuugggaggcagagguuauagugagcagauugcaccacugcacuccagccuggggaacagagugagacucugucucaaaaauauugaauaaaaauaaaagaguuauuagaaagguacucaagcuaguguuaaccaagcauccagaccauaucucacuuuggcccuuagcaaugagcaaauuccuugggcuuaaggagguaucaguuuucagauauucuaagaaaagccugugucucuuucuuccuuaacaguaaaaccaauacaauaugcaagaaaugugcucagaacgugcaguuguauggaacgguaaguaggauauuuucaaaccuaacagugaguacuagggucuuguggaaccuuaccuucuguggccuacuaaugccauuacaauauuuuuauuagaauaaaugguuauguguaauauaucugauacugauuucagcuuucacauuuagcuaaugcuuauuguuaaggaacucuguguuuauggucacacugccaggauuaugauuauaauuuucauugagaggcuucagugaccaguauggaaagagaaagggaaagaugaaauuuuuuguuuuuguuuuuguuuuuuuuuuuuugugacugagucuuggucugucacccaggcuggaguggaauggcagucaaguucacugcaaccuccaccuccuggguucaagugauucuccugccucagccucccgaguagcugggacuacaggcacaugccaccacaccuggcugauuuuuguauuuuaguagagaugggguuucaccauguuggucaggcuggucucggacuccugaacucaagugaucugcccaccucagccucccaaagugcugggaucacaggcgugagccacugcacccggcaagaugaauuuuuauaacuuugaccccuuuguuugguaacaguugacuagucauuuugaugaaugauucucuuuuucucuuaguguuacaguucaggauguuaugugcuuguaagcauucucccaacauguuuauguacugauaauagcaaagaggccuuuucagaaauuuggaagcccuugcugguuucuccaaagagcugguucuguugcaugucucauagaagucucugcauacauacuaauggguuuuuguuauuuguuuauuuauuuauuuaaaaaucaauaguccugugcagaaaaacacuucacauaguauuaagaauugggcuucauggccgggcgugguggcucacaccuauaaucccagcacauugggaggcugaggcaggcggaucaccugaggucaggaguucuagaccagccuggccaacauggugaaaccccaucucuaggaaauaauacaaaaauuagcugggcauaguggcaggcaccuguaaucccagcuacuccggaggcugaggcaggaagaauugcuuuaacccgggagguggagguugcauugagcugagauugcgccacugcacuccagccugggcaacagagcgagacucaaaaaacaaaaacaacaacaauaaaaaagaauugggcuucauuuggucaauauaaaagcagauuuaugaagucggcaauacauuuguaccaugacuaaugaacuacaaaguaggaauuauugcuuuuuuaaaugcagugguauuuuaugaaaguaauacuuacuugacucuuuuuuccccuuuuaagcccaaaccuugucaguauugcaacauaauugcagcauuuauugggaauaaaugccagcgcugcacaaauucagaaaagaaguauggaccacccuauucuugugaacagugcaagcagcagugugcauuugacaggaaagaugauagaaagaagguaaaucucuguuuuucuugauuucuuuuuuuccuuucagagaaauuaagguggacuaacuguguuaaaaacacauuuaauaggccgggcgugguggcucaugccuguaaucccagcacuuugggaggccgaggcuaguggaucaugaggucaggagaucaagacuaucguggcuaacauggugaaaccgcgucucuacuaaaaauacaaaaaauuagccaggcgugguggcaugcgccuguagucccagcuacucaggaggcuggggcagaagaaucacuugaacccgggaggcagagguugcagugagcugagaucaugccacugcacuccagccugagugacagagcaagacucuaucucaaaacaaaaaaacaaaaaaacacacauuuaacaaagaaagauuucucaguuucuuuccugguucuauuauugaccuuaaagaagauauucauauuuuguuuucuucauucauaaaauguggaccauuauauucuaacauuucacgagaauugaauuacagugaucacguaagugaaauggugauuggcagaauucuauggaauucuguaaaggagagauuguaacuuaagcaagauggaguggcauuaccaguuuuacuaucuggcucuuuaaauguuucuaucuguuggcucuuuaaauguuuuuaucuguugaaauucaagauuacaagauuacauuagagggaagcucuauguggaaggguguaccuugagagaaucaaaaugauuuagaguuuggucauauuacucucuugcuuaaaauccuccacggguuuccaguugugcuuagaauaaaacucaaaucccuucuauggccugcaaggcccaugcgcagcucucagucucaucuugcaucauacuuucuaccucucaccuugcuccagccauccuggccacccuguagucugucugacaugcggaucucacuccgaccuuugcacugucuguccuugugccuaaugcauccuucucuagagucucauaacuggcuccucaugucagguuucagcucagguaccaccugcucacagugaccuuuuacugacucccuuagucauuauuuaucauaccauuuuauugucuucauagcaucucacauaucgaaaacuagucuugcuuauuugguugcauguuuguccaccccgacuagaaugugagcucuuuguccaucucguucucugcuuuauuuccaguggccuggcacauaguagcugcucaauaaguauuuguugaauaaaagauggcaguugagaaacucuuuuucaguggccagaggugcuuuuaagaggugcuugggcucaagggcugacucuugcuuaccaaauucauuaacuuacaauggaaggauauaacuuucuauugaccaggauacuccugccugccaaccaggacaucucuucccuguaucaagauccugaagaaucugaauuaguaaucaggagguagcacaagcagcagucccccaaaccugggucccauccgacuccuggggcuagcugaaugacccuggcuacuuacccgcauuaugcaucacuuucuucaucuuucuccaugggaauaacaguaguuacuucacaaacacauggggaaauguaauucagauagguauauaaaacaauauugaaccuggcacauaauauaacugaguaaauggcuccuguauuauuacugauaggaauaguucauuuuuacuaaucugguuauacuagaauucauuaccuuucugcuuuauaaauuacaauccugucucaaguauuuagauauuuuuagacaucuacauguucauaaacuuuaggagagagcuaaauuuagggauuaagaguaggggaucugggccaacccugguggcuugugccuguaaucccaacacuuugggaggcugaaguggauggaucacgaggucaggaguuugagaccagccuggcuaacaugaugaaaccccgucucuaccaaaaauauaaaaaaauuaaccgggcgugguggcgcacaccuguaaucccagcuacuugggaggcugaagcaggagaaucacuugaaccugagaggcagagguugcagugagccaagauuacaccacugcacucuagccugggcaacagagcaagacuucaucucaaaaaaaaggaaagcggggaggguaucuggacucagaauguguggauugaaaucuuaguucugucacuuauuaacugugugacuuugggcauguuaaucuaucaaugccucaguuuccacaucuguaaaaggggaugaucagaucuuagugcuguuacaaaggucaagauacuaguaaaacucuuagaacggaaucugguacaugaaaaauacucaguguuaucuaugaugauuuguuuuugauaguuuaaaucucagaggaugcuauuuuauuuuauuuuuuugagauggagucucagucuaucacccaggcuggagugcaguggcacgaccucagcucaccacaaccucugccucccagguucaagugauucuccuaccucagccuccagagcagcugggauuacaggugcacgccaccacgccuggcuaauuuuuuuauuuuuuuauuuuuuaaauuuuuguauuuuuaguagagaugggguuucaccauguuggccaggcuggucucgaacuccugaccucaaacuacugaccucaagugaucagcccaccucggccucccaaaaugcugggaguacagaugugagccaccacgucuggccagugcucuuuuauuucuuuuuguuguuguuguuguuugagacggaguuucgcuguuguuguugcccaggcuagagugcaauggcacgaucucggcucaccacaaccuccaccuccuagguucaagcaauucuccugccucagccucccgaguagcugggauuacaggcaugcgccaccaugcccagcuaauuuuguauuuuuaguagaggcaggguuucuccauguuagucaggcugcucucgaauugcugaucucaggugaucuacccgccucagccucccaaagugcuaggauuacaagcaugagccaccgugcccggccugcucuuuuauuucuaaaguuuauuuuuaagagacagaucugaaaaaaaugucuuguggaucuaugugcaauuuuuauauucauuguuuguucucuuuuaguagaguuguauuguuuuaaacccuuuaaugaaagcucuuaccuggggaaggucuuacaggguguuuuaaaauuaugccuuaaaugccaggugcaguagcucaugccuguauucccagcacuuugggaggcugaagugggcggaucgcuugaggccaggaguucaagaccagccugggcaacauggcaaaacccugucacuauuaaaaauacaaaaaucucggccgggcacguuggcucacggcuguaaucccagcacuuugggaggccaaggcaggcagaucacuugaggucaggagauuaagaccagccuggccaacauggugaaacacuguuucuacaaaaaauacaaaaauuagccgggcauggugacaugugccuauaaucccagcuacucagcaggcugaggugggagaaucgcuugaaccugggaggcagagguugcagugagcugagaucgugccucugcacuccaggcuggguaacagagugagacuccaucucaaaacaacaacaacaacaaaaaaaaaaaaaaaaaaaaaaaacagaaaaaaaaaauuagccaggcgugguggugcaugugugguuccagcuaccugggaggcugaggugggaagaucucuugagccuaggaguacgaggcuccagugagcuguaauuauaccacugcacugcaaugugggugagagaaugagacccuaucuauaaaauaaauaaaauuaggucuucaagccaggccugauggcauccugugguaguuccagcuacccuagaggcugaggugggaggaucacuugagcccaggaguucgaguccagccugaguaacauagugagacuuugucucuaaaaaaauaauaauaggccaggcguaguggcucacgccuguaaucccagcacuuuagaaggcugaggaggguggaucacgaggucaggaguucgagaucagccuggccaacauggugaaaccccgucucuacuaaaaauacaaaaauaagccgggcaugguggcauaugccuguaaucccagcuacucaggagacugaggcaggagaauagcuugaauccugcagugagccaagaucacgccccugcacuccagccuggguggcagagcaagacucugucucaaaaaaaaaauaauaauaauaauauuaauaauaauaaacagacuuucaggucguaucccauaaccgugaaaugaaccagauugaaguuugguuucaaaguucauuguuacguuucuuaacaaaaaauuaaaugccuaucauguaccagacacuguuccagguauuagaaauaaacuaaugaacugaacagacaagaccuuacucucacagagcuuacauuuaugugugugaaagagaaaagggugaggagaaaaauaaauuaacauaaauuuuagauauuagugcuauaaagaaauaaaguacaugacagagagugacugggaagucagccuauauugggcaaucaggagaaccucugaggaaguaacauuugaguggaaacuaggaugaugaaaaggugguagccaugggaagcucuggaggacaaaaauuccaggaagaaggaccagcuguggaaaauccuuaaggcaggaaugagcuuggcacaugauuagaacagaaagaagauggagugaaccuggggaaaaggaaggaaacaagguuauagaggcagguaaggggcuauauuuaagucaacauaggccaugaggcacacugcagauagcccacuacacuacaaggaggugugugugaagcuuugaggaguucaccugggcuguggaacgccacaaugacaagaccauuuucaccuacuuuaucaguucuaaggaugcuggaggaaaagcuggugccccuauuguaugcaugcugaaccaggggcugaagcauguuagugaaggauguguguucgccuacugccaaguagaagaaaagccuuauuggaaagauccaaauaaugacuucagaaaaaacuuggaaguaaccacagugccuacacuacuuaaauauggaacaccucaaaaacugguagaaucuuagugucuucaggccaaccucguggaaauguuuuucucuaaggauuaagauuugaugauggcaauuaugucucgauuuucugauuuguucuaguauaaaaaaaaacugcauauggcagggugugguggcucacaccuguaaucguagcacuuugggaggccgaggcagguggaucacuugagcccaggaguuggagaccagccuggacaacauggcaaaagcccgucucuauaaaaaauacaaaaaauuagcaggaugugguggugcacgccuguagucucggcuacuugggaggcugagguaggaggcucaccugagccugggaagucgaggcugcagugagccaagauugcaccagugcacuccagccugggcgagauugugagacccugucacaaaaaugcauacuugcuuugaauucauguuagcaauaaauaaaugauaauguuaaaaaaaauaggcuaugguacagaguuugaauuuuaagcuaugaugagaaaccauuggguuuuaaggagagaagauggacucauaggguaacuuacccuugggagccagugcuauggcuuuaggcugcaagauuggcucgcccauccucaacagcaaccuggccaguuuaggggucaagugccuccguauucuagacucuggguccaccuggaugucauggaugggcacuuuguucccaacgucaccuuugguuauccugugguagaaagcuuucaaaagcagcuaguccaggaccuuuucuuugacauacaugugaugguguccaagcuggaacaguggguaaaaucaauagcuauagcagaagccagucaguacaccuuucaucuugaggcuacuaaguacucagaggcuuugauugaagacauuugggagaaugggaugaagguuggccuuaccaucaaaccaggaacuacaguugaguauuuggcaccauggacuaaucaaauagauacggccuugguuaucacaguggaaccuggguuuggaaggcagaaauucauggaugauauggugccaaacauucacugguugaggacccaguucccaucuuuggauaagaggucgaugguggaguagguccugacacuguccacaagugugcagaggcaggagcuaacaugauuaugucuggaagcguuguuaugaggagugaggaccccagaucugugauugacuuguuaagaaauauauguucagaagccacucaaaaacauucucuugaucagugagaccacaaggagcccaauguugcugcucgugagaucuccuuuuuaccagaaaacaggaauauugacuaccaaaucauauugcagcugaggcaauacugcuuuucugagcaauuauucauucuaaugauuaaaauugauugugcagaauauucuaagagguuacaaauuggcaugucuaacuacauuuuuagugaagcaauuuaacaauucauguggggcccgggugugguggcucacaccuguaaucccagcacuuugggaggccgaggagggaggaucaccugaggucaggagcucgagaccagccucaacauggagaaaccccaucucuacuaaaauacaaaauuagccgggcgugguggugcaugccuauaauccuauaaucccagcuacucgugaggcugaggcaggagaauugcuugaaccugggaggcggagguugcagugagccgagaucacgccauugcacuccagccugggcaacaagagcgaaacuccgucucaaaaaaaaaaaacaacaacaauucauguggugaaauacccaguuuuuauugggagauuugauuuuuuuuuuuuuuuuuuuuuugaggcagagucucacucugucauccaggcuggaguacaaguaguacaaucuagacucacuacagccgcagccucccaggcucaggcgauccuuccaaguagcuaggacuacaggcaugugccaccacgcccagcuaaucuuuguacuuuuugucgagacaagguuucaccauggucucaagcaaucugccuaccucagccuuccaaagugcugggauuacaggugugagccacugcgcccacuugauuuuucauaaagaguaaaaauauggcugcauuaagguuacaaacagaaaugugucuuaaugccuaaggagggcauauuagcuacacuauaaaaaaaauuuuuuuuccauuuuacaguagagagaaauagaaaaacaggccaggcaacgguggcuuacaccuguaaucccagcacuuugaaaggccaagguggguggaucaccugaggucaggaguuugagaccagccuggccaacguggugaaaccccaucucuacuaaaaauauaaaaaaauuagccaggcgugguggugggcgccuguaaucccagcuacuugggaggcugaggcaggagaauugcuugaacccaggagacgaagguugcagugagucaacacagugucucugugcuccagccugggugacaaagugagacucuaucucaaaaaaaaaaaaaagagagaggauguaaucauuuacauuuaagaaacccuuuggcggcuauggggaaauagcuuauuggagguagggugaucauuugggcagcucucacagcagugagagaugaguaugucuuuaguaaaauggaagcaguggaguuagaaagaagugaguagauucagacugauggacuuacugauggguugggggauggggagcaaagaggcuuuugccaaugaaauaaaacacuucagguaaaugaugacguggccuacccauguucaagaugaggcacaagaucuaauuucagaaauaagaaaugaaaacuguaaaauuccauaauguaucagcauacucccugucuaaccugagaaauuccaaccagcccugcugcccugucaccuguccuaguguguccuccagugguuuuucagucugaaugcugcacagagacaccacagcuucagaggguggcagaagccauguuaugcuuuccuagcuuugggcccugcuccauggugcagaguuacuuuugcucaaaggagucaacuuuuucuaauucaaacagugccauggcaggccaccacgagggacugggcccuggaagcuguucacucauuguucuuucucuggggaccaucuuuccaucugagagaugguauccagcauaccacuuugugaaccauuuauaaaguauuaaaacugagguauaggaggguggguuuggggagauguuggccaaaggauuucaguuacauaggaggaauaaguugaagagauccauuguacaacauggugauuauaguuaauaaaauuauaguugaaauuauaguugaaaauuguuaagagaguagauuuuaaauguucucaccacaaaaaaacaaacaaaaacacaacugggcgaggugcaguggcucacgccuguaaucccagcgcuuugggaggccgaggcgggcagaucacgaggucaggaguucgagaccagccuggccaucguggugaaacuccgucucuacuaaaaauacaaaaaaaaauuagcugggugugauggcaggcgcuuguaaucccagcuacuugggaggcugagguaggagaauugcuugaacccaggagauggagguugcagugagcugagacugugccacugcaacuccagccugggcaacacagcaagacucugucucaaaaacaaacaaacaaaaauuauaugagguaaugcguguuaauuagcuugauuuagccauuccacaauguauacauuuuuaaaaaauaucuauuuauucauuuuugagaaagggucucgcucugucaccaagacuguaguacaguggcaugcuuacagcucauggcagccuugaccucccaggcucaagugauucucccaccucagccucccuaguagcugggacuacaggcaugcaccaccacaccuggcuaauuuuuguuguguuucuuuuuguagguggguuuugccacauugccccgaguaguuucgaacucuugggcucacgcaguccaccugccucagcuuccugaaguguacauaucucaaaacauguuuuacacaauaaauauauacaaauuuugucauuuuuuaaaaaauggccaggugcaguggcucacgccuguaaguucagcacuuugggaggccaagacaggagaucacuugagcucaggaguucaagaccagccugggcaacauggugaaacccugucucuacaaaaaaauacaaaaauuagccacacaugguggugcacaccuguaguuccagcuauucaguaggcugaggugggaggauugccugaguccaggagguggagguugcagugagcugagaucauaccacugcucuccagucugggcaacagagcaagacccuguuuggggaaaaaaaaaaaaacgaacaccugauuaggugagcaugguggcauguaccuguaguccuggcuacucaggaugcugaggcaggaggauugcuugagcccagaaguuuaagguuguaguguacuacaaucacaccacugcauucuagucugggugagugagauccuaucacuaaaaaaaaaaaaauccaaaaaacuguaaaugugaauuuuauaauucaucuucugucuucucuucucccugcugaguuuuccuuaaugagaaccguggucuugugagaauuuuacucgucuguguuugcuaacuugaagagaaacaaaacaaaaauacauaaaauuagcagcugaaauuuauuuauuuaauuuaauuuauuuauuuauuuugagauggagucacgcucuguugccaggcuagagugccauggcgcgaucucggcucaccacaaccuccgccuccuggguucaagcgauucuucugccucagccuccugaguagcugggacuacaggugcacgacacuaugccuggcuaauuuuuguauuuuuaguagagacgggguuucaccacguuggccaggauggucucaaucuccugaccucgugaucuacccaccuuggccucccaaagugcugggauuacagguaugagccaccgcgcccggcccggcagcugaaauuuauuaagcaacuuuuaugugccuggcacuauguuaagugcuuuaccuacauuaugucacuagauccuuguagcagcccccugugacaugcccaaagucacagcacauaaguuucagaacugggacugaacccaaagauucuagcucccaauaccacguuugcagccacugcgcuaaauucccucuucuuuaucuuugucuccuugucuuucagguagaugggaaauugcugugcuggcugugcacacuuucauacaaacggguccuucagaagaccaaagagcagaggaaacaccugaguagcucuucucgugcuggccaccaggagaaggagcaguauagucgccugaguggugguggccauuauaacagguaaccucaagacacaugagaugggacuagaagugcugguaggucagauguaaugcucacauaaccaucaugguacauacuaccaucucauauacauuuucuauauucucuguagguacuagucuguaggaggaagcucauuugucauauuuuauaguucauauaucuuccaaggaccagagagauuuccauaaagugucaggauuuccugacuuuguauugugucugaaauguuuguggaacuucguuuguaguguucucacccuuagaguggauucucucuccagaaaauuggacauuucacuuucugagagauacagcuuuuucaaugcauauuuagccaggaggcugauagauguccuagguuuguccugguggcaccuagucaaaaagaugucuuuucauuguuguuuuaagcguccuuucagaguaucuaguauuguuaacgguucuggcucuggauggaaugcuggcucugccagguucucugcggggaucuugggcaaguuuucucaucuguaaaaugagggaagugauaguauuaccucaagggguuguugugaagauaaauuagauaguacaugcacagugauuguuuuuauaacuggcauauagaaaauauucaauacauuucagguuuuuuuguuuguuuguuuuguuauuaccauuaugacuuuguuuaaucagcaagcauuaaguauucucacgggucagggaugcuggugggaaugaagagcugaauacaagucaugcugcucuccaagaguaugcagucugguaggaaagacagacuuauaaacagaugaucuuaguauaauguaacggguaccacaguggaaacgugucaagaaugcagacaugaggguaguaauuaacugccuugagaagucaggcaagcaggcuuggagaagagcuggcauuagagcuagaucuuaggacgaguuggaauccucagggaaggaaugggcagaggcauucuaggcugagagaauagcauuugcaaaggcauggagggcaugagaccaaauggaacccuggaaaauuguaaguccuuuuauauugcuggagcuuuuggcugggagcuggggaauggaaggaaaaagggguccugcauccugguaaggaauggaaacuugauccugaggucaggguguuagugggaagcuauugaagggaucuaugcagaggagagaccaaaucuucauuuaaaaaauuaacccugacuacuaguguggaaaaugcauuggaggaaaaagggacugggggcuaauuaaaggcuuuuuucuaagaguuuggguaagagauguuaaaacaagaaccucaccugaggcaguggcaguggaagauugaaaagguugauucaggaagauguuuuggauggagaauuaugagaaacagauaaucugaugaacagacacaugggcaagagcugaguaaguaaaggauaauucccggguuucuuauuugggugaauagauagagccuuaacugagagagaauguaggaaggggagaaaugggucuaguuuuggaaaguugaguuugaagcaugaagaauuacuuuuaggagcuuagccuagaacuuagaagagagguuuggacaugggccauagguagcacauaagaaucuagcugggcgcgguggcucacacccguaaucccagcacuuugggaggccaaggcgggcgcaucacaaggucaggaguucgagaccagccugaccaacauggugaaacccuguuucuacuaaaacaaaaaauacaaaaaguggccaggugugguguugcaugccuguaaucccagcuacucaggaggcugaggcaggagaaucgcuugaacccaggaggcggagguugcaguaaguugagauugugccaccgcacuccaugcucggugacagagcgagacucuaucucaaaaagaaacagcaacaauaaaaagaaucacuggggguagggauuauuugaaaaugcagauuccggccagauacauuggcuggcuuacacccguaaacccaacgcucugggaggccgaggugggaggguugcuugaugccaggaguuugaaacuagcaggaacaacauaaugagaccccaucucuacaaaaaacaauauuagccagguguaguggcacacaccuguagucccagcuacuuggguggcugagauaggaggaucgcuuuaagccuuggaguuugaggcuugcugugagccaugauuaugccauugcucuccagccugggcaacagagcaaggcacucucucuaaaauuaaaaaaaauuaaaaagcagauuccugcagcagucccaccccagaauuuaauucaguaggaccuaggauagaggccaggaaucuacauuauuuuauaaacaucccagaugauucuaaugcaggugauauaguuaacaccauuuccaaccacuuaugauagguaguuguuaaaaucaugcucuuaaaugauguaauucagauucagggcugagaauggaacucuacaagcauucaguauuuaaguuuuaggaacuaagaagcagcugucacaaaagugggaugaccaaacgaggagaacauuugaagaaggaugcaguaucagugguaucaaaugcugaagagaggucaaguaagaaaaggucugaggaauccuuugaacuuggcuguugaacacccaucaaagugaaaggauugcauagcagagacagaguuccagcuuuuguuucaagaccaguuuugagugaacuuauuggggcuaaaacugauuuuuagucuuguaguuugacugagauaccaguagguuaacacaaauauagugaagaagaacuagacuggccgggugugguggcucacaccuguaaucccagcacuuugggaggccgaggcagguggaucacuugaggucaggaguucgagacuagcuuggcucacauggugaaacccgucucuaccaaaaaauacaaaauuaacugggugugguggcuggcgcgcaccuguagucccagcuauucgggaggcugagguggaaggaucacuugaagccaggaggcggagguugcagugaaccaggaucgugccacugcacuccagcuugggugacagagugagacuccaucucaaaaaaauaaaaauaaaaauaaaacuagacuaggaguucaaauauauugaccugguuucuagucccagcuuuacuucuaacuagcuauaugugucuugguagauaaguugaucuugagcuauuucuguacaguagaaauaauaacuuaucuauaccucacagaauuauaagaugcaugugagacaguaaauguaaaagaaguuuuuuuuuuuuuuuuuuuuuuugagacggagucuugcucugucgcccaggcuggagugcaguggcacaaucucggcucacugcaagcucugccucccggguucacgccauucuccugccucagccucccaaguagcugggacuacaggugcccgcuaccacacccggcugauuuuuauauuuuuaguagagacgggguuuuacaguguuagccaggauggugucgaucuccugaccucgugauccauccaccucggccucccaaagugcugggauuacaggcgugagccaccgcgcccagccaaaagaacuuuuuaaacuagaagacagauuauacuucuuauugaaguuuuuuuuuuuuuuuuuuuugaggcggagucucgccaggcuggagugcaguggauugcugggagugcaguggauugaucucggcucacugcaggcuccgcccccgggguucaagccauucugcugccucagccuccugcguagcugggacuacaggcgcccgccaccucgccuggcuaauuuuuuguauuuuuaguggagaugggguuucaccguguuagccaggauggucucaaucuccugaccucgugauccgccugccucagccucccaaagugccgggauuacaggcgugagccaccgcacccggccucuuauugaaguuuuauugauauuuguucucaugguuauuaauaaagcagguaauauuuaauuaauuaaggccaagaauuuuuuuuuuugauccuguggaaacuagcuacccauccauccaggccuacaaaaucaucaccuugguagauucuuuauuaaucaagaauuauuagcucuugcauagaagagcugcugucuuaacauuggucuauuugacagacuuucauugugauguuuuguuaaucuuugauuucuaaugugugucucucuauuuuugccauuaaaagccagaaaacacuuucuacaucuucaauucaaaaugaaaucccaaagaaaaaguccaaguuugagucaaucacaacuaauggagacaggugagccaguuggaguaugugugcgcacacauuugaaaugcauacacaguuccugaaacaggaauacauuuagggucugccuuggaauuagucuguggcugucagugaaucuuauaaguaagcaguacugauauuuguuuauaaaucuaaucuugucauuaaaagauaagaacucauaacuugauuuaauagcaauugaauucugcaguccacuaaauuauaauuuuuuuuaagagacagucucacucugucacucaggcuggagugcaguggcgcgauuuuggcucacugcaacuucugucuccuggguucgagcaauucucaugccucagucucccaaguaguuggaauuacaggggcaccaccauguccagcuaauuuuuguacauuuaguagagacaggguuucaccauguugacuugaacuccuggccucaagugaccugcccaccucggccucccaaagugcggggauuacaggcaugagccaccuugcccagcuuccccuacacuaauucuaagaaguccagagcuggaugcuuuucuuugugaucucugcccauaucuuccugcaggcaggagaggaguugaucuugagagguaaagacagguugggauuaaggcaauguugccaaauuugugaggauccacacuuccuuaacauucagaaagccagcccagugcagauucuggaucaggagagaaugagaugcauuugcauguuuuuguuucauuucaagccagucuaaaugcauacuuuuaguccucacuuuccucuccccuccucagugguacuuccucuugugagcugcuuggguccuaauauccagagugucccaucuguguugguacagugggcugcuucucaacaaaguguugggaccaaccauuuuucuguuccuccaggccugggcauccugaagugaaaccaccugacacacuuccugcgaucuuugaaaucaucuccauccugaaaacuccucccauucacaguucuccuucccagccaguaguggauauaggagcagaccagcauauaggcuuaccaggacugauuuuguuuauuuagagggauacaaaacauucuuucccauugccuuuuuuguuaacuugcuuucagacucuacaagguuuuuagaacuaguuucacugauuuuuaaacuucuugaauugaaccuucuggaaugcuuaauuuagguagucagauuacauggggggaggaaccauaaagaucaucuuucuggccagcuuuacuguucucucauaagcuagucuggccauugugaagaaagggauguggcacagguuguccaucaccucugccagggcaugugacccugcaaaaacuacuucaaggaaugaacuuuuugaacacccugcuuuauaaaggccuaagccaagaccuauggcuuuagauucauuucuguuuugugcucauuuaugauccaggcuguguuugaaugaccuggaaaaagcucguucguaucuuccaguuuaaccaaccaguccuuaauguucacuuucuauuagcuuauuuuguucuugagauacugccacuauucuugcuguccauugcuauggauacaccaagcuaaaaacucaaguuuucuguucaguguuuuauugcauccagucaucagcaaugcuguuuuccucaaguagaaagcugauccuugacauagguacauggucuuucaugguguccuccagaaaagauauuaaaugaucauuuugaccaggcacagucguucacacauguaaucccagcacuuugggaggccaaggcuggugaaucacccaggaguuugagaccagccugggcaauaugaugaaacaccaucucuaaagauuagcugggcaugguggcgugugccuguaauuccagcuacucaggaggcuguggugggaggaucaccugagccuggggaaguugaggcugcagugagccaugauugcgccacugcaguugagccuaggcagugagacucugucucaaaaaaaaagguaggggagauaacuuuuuccuuaaaaugacaugcuaauuuauuuuucuaaguaauuuauaauuugaaaauuuggaaauguuuucugcugucacaaaaacuauuuucauacccauuuaaaauguuccugcauuagcauuuuuaacauucuauucuacuuguuugcauuucuuuuuuuuaaauguucauagcacaagauaaauuccacuuugcuguccucuuuacuuguuguggguuuuuuuucccugcauuuacuuugcuuugaaaaaagcauucugacauuuuuuuugacaguccuuuuuuaaugucauccaaaccaaaauuucacuggcuacccauuucuuuuuuuuuuuuuuucuuuuuuuugagacagggucucacccuguugcccaggcuggaaugcagugucacgaucuuggcucacugcagccucgaccuccugggcucaggugauccuuccaccuaagccucccaaguagcugggacuauagacaugcaccaccaugccugccuaauuuuuguauuuguagaaauaggguuucacuauguuacucaggccaguccugaacuccuggguucaagugauccuccuauguuggccucccaaagugcugggauuacaggaaugagccacuaugccuggcuuuuuuuguuuuuuuucuuuugagacaaggucucacugugucacccaggcuggagugcaguggcgcaauuauggcucacugcagccucgaccuccuggacucaaacgauccucccaccccagccucccaaguagcugggacuacaggcacaugccuccacacucggcuaauuuuuuuguguagauggggucucgaacuccuggccucaagugauccuccugcuuuggccucccaacaugcugggauuauaggcaugagccaccagacccagccccuaaaauauucauauacuuuuaaauuuaugcucuuauucuuuuauuuuuauuccccauguuuucugcaaguugcugccuaaugguuuuucacugaccuuucuauacuacuacauucucuucucuuauuuaauauugaguuauguuugauuauuuuuccuccuuuuuguuuauccauuagccuucuauuuuuuuuagacagaacacauuuuagcuuucaaaaauggcuuuauaagaugcuuuagucuuuuuuuucuaaguauccuacaacauccacagucucugucucaauauguccuaauuuguuuguugaaauuauaacaaaaacuuuucaauuuuaggaaaauauaaguuaauuucuaguuuuccuuccucuagaaaauacacuggcuacuuuuuaaucauguguguuuauuuuuccauaggcaaucaaaaaagcagccacaacagcugguggcacucaggcacagcuugugguuuauuguuucuaaaggacauucuuuuuuuuaacucguaguuucauuuuauucuccgucugaaaugugccugaaagauuaaucuguauagccuuugaggacugacucaggaccaauauguaggguuauagagaggcagguuuuggcucaacccaagaaaauuguucuuacaguacgagcuuuuguaaaagacaauuuuucuggagaaguaguaguucccugucauuggagccauuaggaaagagacugguuuuucugccuuguuacccuagccaucuuuuuucauuucuaguaguucuuacugaaccaggaauuagagaguuagugagggcugggcacgguggcucacgccuguaaucccagcacuuugggaggccaagguggguggaucaccugaggucgggaguucgagaccagccugaccaacauggagaaaccccgucucuacuaaaaacacaaaaauuagccaggcaugguggcgcacgccuguaaucccagcuacuugagaggcuaaggcgggagaaucacuugaacccaggaggcagagguuguggugagcuggagguuguggugagccgagaucaugccauugcacuccagccuaggcaacaagagugaaacucugucucaaaaagaaaaaaagagaaaagagagaguuagugaggucagucccuaacacaggauagaaaggauggguguugucaacuauuuauugguauggggggaauccucucacaagaagcaggaaggguagggcauuaagagguuuggggacaacaaaaaguuacuuacauuagcucauuacucuaguuauggguuuaaauagacucuauucaguugaagaaagacagguccuuagcagguauugaaacagaugugagacugcagcucuaagggugcuuccagaucugaaacuaguggagacuguaauagguccuuucaguacuuucuccugcacaccuuguuuuaugauuuugcauuuauuuuuguuaugcaguaauuccauccauucauuaguuaugagagcauugauucauucuuccucugacagucuucucauaugcuucauguaaacugagaggaggguaggaauauucuugucgauuauuuaugucuuccaguccuagccauagaaauguuugacuugguaacugugagguaguuuguccacugguuaggcuugcuauuuggaguuucuuccuguguagagaaauguuggcuauuagaugugguuuaggauauaagaacagugagucguuacuauauauagggaguugagaaugaguauuccagugucugcuuaggaaaaacagguuuguguuuuacuuuaaagauuguccugggaaaaguaaagagcguucuuugagaacucucuagagaacaggauuugacccucuuggcagugauuccuuaacuugcuuugagucugaggcacuucugacuggccauugaaagcuauggauccucacucuaaaaaccacccauuauauguguagacaagauuguacauauaauuuugggguuuugcagauuuccugaaacuaucccuucuuuuuuuuuuuuuuuuuuuuuuuugagacggaguuucgcucuuguugcccaggcuggagugcaauggcgcaaucuuggcucacugcaaccuccgccucccagguucaagcaauuguccugucucagccucccaaguagcugggauuacaggcaugcaccaccacggccagcuaauuuuuuauuuuuaguagagaugagguuucuccauguuggucaggcuggucuugaacuccugaccucaggugauccgccugccuuggccucccaaagugcugggauuauaggcgugagccaccgcgcccggccuaaaacugccccuucuuaagaggcucugcuaaaaggacauggaguccaucuggcacuuugacaaaauagagugcucuaaugcuguuauugggaggaaucuguuaaaagcccaaguuguugugugacucuggaguuugccaccucuuuguuccguuacuaaagcaauguuacagaauuccugauauuggaaaugacaaucugcaggccauuuguaguguaggggaagcuggcuucauuccuguuucaucuuuuuugaaaaagaacugacugcuccugggugggaauccagcagcuucucggcagauacacugacugcauugcggugcuuugggacagaagacaaggaccugaaagaugagcucugagggaagcauuaaagaaaaaugcaugagcucacaguuuauaauuuaucuggaauucuaaggaauuuaucuaaucacaaaaauuaggaugguuuuucuaguacaucacuggggaucuuuaaggaaccugaaacaguauccuuagcucuugggauguggcauuuauuuccguccuaaaugugagagaagaugcugcagggaugcugccagguuguggcuuugguucguagaguuaucugauggccaccuuaccucugcaguucagcucagcaagugccguugagcccagcauguguggugcaaugugcuugaugcuaggauuccugcccuuuaggagcuugcagacaaguggucuaggaugcauccucagguagagaaaaguuuauccauccaaguuaaaauauuuuccccugauuuuuaaauuuagcuucuccccagaccuggcucuggacucaccaggcacugaccacuuugucaucauugcccaacugaaggaagaaguggcuacccugaagaagauguugcaucaaaaggaucaaaugauuuuagagaaagagaagaagguaugguuuaguuaauuccucucugaccagaaugaugcgagggugagauaugugguaugggacaugauaauaacccuuuuuaacugauguuuguugagagccuaugucaagguugggauauccuggggagaggcuggcugucugccaagaugacuuuugggauggcauuacuccagucaguugggcucaaaaaacugauuuuucucagcacuugcagcuuccacuucucaaagaggacauuuuguuuuuuguuuuguuuuugagacagggucucagcugugucacccuggcuggagugcaguggcacaaucauggcuacugcagccucuaacuuccagucucaggcaauccucccaucucagcccacuuaguagcuuggacuacaggcaugugccacuguacccggccaauuuuuaaaauuuuuuguagagacauggucuuauuauguugcccagacuggucuugaacuccuggucuuaagugauccuuccauuuuagccucccaaagugcuaggauuacaaaugugagccauugccccuggccucagagaggacauuuguuaacugagcuuacagagacaauguauaaaaaaaccaguguucacaucucaguucacagcggagcauguaacaaacaguacacaguucuuggcaugagcuaccuggagaggcuguaaucagaaggugcugaauaagcauagaguugggacacgaggagguaguuauguaacuggaauguucagugcuguccggcuaaaagaaccuaaugucucuuucucuucucauggggauggccaugucugugggacaauaauacucaaaguucaugggacauuucuuccucuucccugaacagcguucaugugggccuucugccaugacucuuaugucacugugcuuccacugcugacaacucuuacuaagugacccaucuuuaauauguuaauauuuuaauaucuuaguuuaucuucaguauuaauacucuuuuuuuucuuuuuuuguuuuuugagacagagucucugucgcccaggcucacugcaaccucugccuccugaguucaagcgauucuccuaccucaaccucucaaguagcugggauuacaggugccugccaccaugccuggcuaauuuuucuauuuucaguagagaugggguuucgccauguuggacaggcuggucucgaacuccucaucugaagugaucugccugccucaucuucccaaaguguugggauuacaggugugagccacugugcccggccucaguguuaauauuuuauuuucacaucagaauaucuucuaucuuauauuucuaauaucuucacauuaauaucuucagaauaagaccagucuuauuauggucugaaguugucuuccauuuuuacauucuuacucugauucaugucuguuaucuuguuuucagguuuucuaaauaguaucucauuuuuaggcugggcacacuggcucacaccuguaaucccaacacuuugggaggcugaagcaggcagauugcuugagcccaggaauucaagaccagccugggccauuggugaaaccucaucucugcaaaaaauacaaaaauuagcagggcuugauggugugcaccuauggucccagcuacuugggaggcuaaggugggaggaucaccuuagccugggaggucaaggcuguggugagcagugaucauaccacugcacuccagccugugggugacagagccagacccugucuccaaaaacaaacaaaaaagaauaucucauuuugccuuaauauuauaauaauaauagcuaacuuuuauuggaugcuaacuucgugccuagcucuguuuuaagugcuuuauauguauuaacucauuuauucuuuuuuuuuuuuuuuuuuuuuuuuugagacagagucuugcucugucacccaggcuggagugcaguggugcaauaguucacugcaaccucugacuccuggguuuaagugauucuugugccucagccuccugaauagcuagcugggacuacaggcgugcaccaccacaccuggcugauuuuuguuuuuguuuuugauugagacagggucuugcucugucacccaagcuggagugcaguggugcaaucucugcucacugcaaccucugccucccuggguucaagugauucuccugccucagccucccgaguagcucggauuacaggcauguggcaccacagccagcuaauuuuuguauuuuucauagagaugggggucucaccauguuggccgggcuggucuugaacuccugaccucaagugacccgcccaccucggccucccaaagugcugggauuacaggcaugagcuaccaugccuggcccauuuauucuuauaaaaagccuuugaggccgggcuugguggcucaugccuguaaucccaccauuuugggaggccaaggcggguggaucacgagggcaggagaucaagaccauccuggcuaacacggugaaacccugucucuacuaaaaauacaaaaaaauuagcugggcgugguggugggcgccuguagucccagcuacucgggaggcugaggcaggagaauggcgugaaccggugaggcggagcuugcugugagccaagaucgugccacugcacuccagccugggcuacagagcaagacuccaucucaaaaaaaaaaaaaagccuuugaggugggaauuguuacaaucauuucauagaugaagaaugccuccaguauuuuucuucuuagggguuucugaucuccccuggcucuuuauguuguuuucugccaaguucagaaugcugugauucauucugaauagcuaagacauugauguaaauuccuuacuugcauucaucuaauuucuaccucauuuuacagaugaggaaacagacccgaagagguuaauauguccaaaccacacagcuaguaaauggcggaacaagggacuggaagucuuucugacucuacuguucuuucuacugugcuaugcuuucuccugcuaggaagguggaaauucaugggaagagaucuguguucuauccacauaacuacaugacugucaagugaaaauggcccaaguauauucucuccauggacuagaucagaauggcacauaaaaggauuuuuguaaaacagggacaagaugaacacuuguuucuacugcuuugcagagauaguuuuuauuuauuuauuauuuuuauuuuuuugagacagggucuugcucuguugcccaggcuguugggcaguggugcagucucagcucacuguaaacucaaccucccuggcucaagcgauccucccaccuccguccucuaaauagcugggacugcaggcgcacaccaccacacccagcuauuuuaauuuucguuuuuuuuuuuuuuuuuuuuguagacaugggguuucaccauguugcccauguuggucucaaacuccugagcucaaguauuccgcccuuuuggccucccaaagugcugggauuacaggcaugagccaccacuccuggcccagaguuaggguuuuuaaaggagcaaaagcagauuguuucccaaagcuuucaggaagcuuggaauacaggcucuuuagcauaaugccugcccaucucuccaaccucaucagccauucaaauaaucucuguuaucucacauuuaucugccugugccuauacuguucucugcuugguugcccuccugcucaccuuaugugccuauuguuaauacaucucaaagcucagcucacacaucaccucugauuuagaauuuccuugaagagcagucaacagaagggggucugggguuugaaaucuagcucugccccuugcuaacucuguauaugaucuuggccacauuccuuaacccuuucuaaagaucaguuuucuccucuauaaaaugggacuacuacucucacaauguuaucauaaagaucuacugaaguaauauaaucauauaaucaguuuuucugcaacauaguaaaaguucaguaauugguagcaacuauuauucucaaauauucagaaauguuaguucaggacuuuguguaauuuucaggaaagcuuuagagaaaaagaggguguggaauucccugguuuugauuuagauacggaucugcaggagagcccuggauuucauuaauuugggugaccauuuagcucucugaaagcaauuuuuuuuuauugcacagaaauuucuucugguuauucugccuuguuucccucagauuacagaguugaaggcugauuuucaguaccaggaaucgcagaugagagccaaaaugaaccagauggagaaaacccacaaagaagucacagaacaacugcaggugacugacucugcuuauuuuaugugcuaaaauuguguaccuaccugguauaccuagcugauuguauuuuaagugaucaucucuuagauuucuuuuuuuucucaaaguauuaacaaaucauguuaaucccccuuuuagguuuuuuuuuuuuguuuuuuuuuugagacagguucucugucgccuaggcuggagggcaguggcacgaucauggcuuacugcagccucaaccucccaggcucaggugauccucccaccucacccuuccaaguagcgaagaccacagccauauaccaccauaccccacuaauuuauuuuuuaauuuuuuuguagagaugggcucucgcuauauugccugggcuagucuugaacuccuggcuucaagcaauccucccaccucaaccucacaaagugcuaggauuacaggcgugagccaccaugcccagccuguagauacuuuguauuguuucacucuuggauguguucugaucuuuuccccucaaaaacaguagaauuauuaaguauguucuuugauuuuugaauaaaccagaugugauuccagaugucugaauuauagauucuguuuauccagcucaugaagucacuucacaguuuguauugcauaaagcaucccuuuguaacagugggucccaagagauugagguacacugauuaaccucuggcaaauacuuuuuucuccugaaccaaguuucaagcccuagagcuuccuguuguuuuccaccucuagaauuguucaucucuuucugacccuccacauugucugccuuagcaucugcacuuacucugcaugaaaaauagcuuauauccuguuugaaacauccuucuugcacugauuuuuuuuuucuuuaggccaaaaaccgagagcuccugaagcaggcagcugcuuuguccaagagcaagaagucagagaagucaggagcuauaaccucuccaugacagaccucaaggaggcucccuagcaacagcaaauggaguuguccaggguuaggguuggagaccuggcuguucugugggaauugcaagcuuucuuaagaaaucucuauuuuauuacaguuauccuucuuugugcgauugcagugggcugaauggaaacaccugguuugugcuguguuagacugcaugcuugaguguuugggauuucaagcucgcucucuuucucucacuauuaggacuuuucuuuuucuucuuccucuucucucuauuuugguucuauucuuuuuuuuucuuuuuucuuuuuuuuuuuuuuuuuuuuuuugugguggucacugcucaguguaaugugcagaaugauuuguuuuuuguuuuuuuuuuuuuuuuugguccuucauugcauccugccauacccaugagcaaacaguuuggcauuaauuauauaucacugccacccucugaacuuugaaaacugccaucuucagacuugguauaauggaagaggcuuucucucuccaauaaaccuuuugcuucaggguauacucuucgguuuuuuuccagauguauuauguaugaacuuuguacuauguauagccagaguuuuauuuauuuuuuaaaaaagaaacuuuuucuugauaaaggaauaaugguggucuagcuaguucuuguaaaagugaugccucuugaaaaaaaaacaguccuauucacuagcuuuuaguaaaagaaucagaucuuuucuuucuuguuaccuuggagucuuaaaaacugauugcuaaggugaaacaauucaaugcauaaguauggagcuaagugccuuuuggaggauuucuuggaagagcauuuauggagauacuuaagggagguagcaaagauuugaaccgucugucuuuuuaaguaagggcagaaagcaagguuguccagguuguacuggacacuucucuccccaccccuuuccugauuguuuuaugugauugauuuuaaauucucacacugccacuucuuuaaaaaauaaaauccuuuauuugcuuauaucaguugucauacugggcugcugucagagaauguuuuuuuacaugaaugaacagauuaaaaauggaauaauauggucgggugcgguggcucacgccuguaauaccagcaauuugggaggccaaggcggguggaucauuugagguuaggaguuugagaccauccuggccaacaugguaaaaccccaucuguacuaaaaaaauacaaaaauuagccgggccugguggcaugcaccuguaaucccagcuacccaggaggcugaggcaggagaacugcucgaaucccgggaggcagagguugcaaugagcugaaaucgcaacacugcacugcagccugggcaauggagugagacuccgucucaaaaaaaaaaaaaaaaggaauaauauuugaacuacagagcauuuuuggggucagcaugagcugcucuaguaaggacucuugagucugggaaaagugguaucacuauaccuucuccccacuccucacccacccgagcccauacacucccugcuuuucauggauauguauugaaaacaggugcuucucagaagcacuuugccucaaccagaguuauguaugcccugccuaucuucccuucuuaacccuguaggaauauggauuuacuuuuccaggaaaggggauagauuuacauuucuaggcauacucucagguccucuaugugauguuugugaaaggaauuagggugugucaugugugccaugaaacaacaaaaccaacuacccuagaaucauuuaugcaggggguacuagaguuagaaauaauaaugagggcagauaacauuuguaccucagucuaccaaaaaauuauaguacuaaauuuaacuucuaggcguuuccuggaagcagaugcucuauaauuugugauagcauucucauaaauggaguccuacacauaauuggacagagauguggaaauggugguuuccuucugauaagggauacaguggaccaugucgcuuauauaucacccuacuaggggauauaauuuucccuucuaagcaagggaaauggcagugcuaaauaguuuuguaaaguuuuugaaugagaagcuuuuagguaaagauaaacugucauaauauuuuucagaugcauuugcauugacuaugggagaaaaauuagggggaaaugacagucaugguguuuuuuuuuaauuuuaaggacugaaauucuguuacaugauguaugacaauauaaaaacauacuuaguuuuauacuaaaucuuuuuuuaaggucuuggcauuuaauauaaagcaaauucacacguuuucuaacuuuccauaaguuccaa

SEQ ID NO: 191421 - RNA, 8091 nt, Homo sapiens
gagacacgggagcgcuuggcacgcggagccagagccggagcugcagccgcagcgggagccgggggagcucaggggccgcaggagccgggccggagugagcgcaccucgcggggcccucggggcaggugggugagcgccacccggagucccgcgcgcaacuuucagggcgcacucggcggggcggcugcgcggcugccgggacucggcgcgggacugcauggaggccaaggagaagcagcaucuguuggacgccaggccggcaauccgguaaggcgagagccuggggacgggcgggaauuuuggcggcagccgacgcaccuccgcauuugccauccuagcagugguugguuuuggcugcggcuugagcugggaccaugcaggagggguggggugaggugagggaacgaagauaaugggcuguggcccaaggaccgucucucccuuggggcgcagcccagauucugaccccugcccgcggggggccuggggccgggggauuggcgguucccaugccuggagucccgccccgcccagcacuuugccccaggcagccccgccccggggaggcccugugucccaagugcgcuggagggggccugcuguucucccagagccugcgcucuguuccuuccccgcgcuccacuggacagcacgccccuuggccgguucccagggucuucaccuccucuggccucugaagggccccgggccccaggacucccauuccccuaucauccccgucugaauacaggcuucucaccucugguuugucgagcucggagcguccuuagcuauuuuucccaguggacacaaggccucacagagaaaugggacuagagucggcccuccuuaccucaucucagagcugagcguucccucucuuccccucuggccaggucauacacgggaucucuguggcaggaaggggcuggcuggauuccucugccccgaccuggccuggacuugcaggccauugagcuggcugcccagagcaaccaucacugccaugcucagaaggguccugacagucacugugaccccaagaaggggaaggcccagcgccagcuguauguagccucugccaucugccuguuguucaugaucggagaagucguugguaagcacuuuugggcuaauuaaaugaaguuggugcauggauagacuggauguucccagcaauacugacacuaaaagccccaauuacugaacacacacuacaguaagccuuuauauacacauuaucugaugcaggucuaacaacaaccuguguucucacaugggugacguuauucuccuuacuuuacagaugaugaaacugaggcauguucaggugaaguaacuugccaaagaucacgcacaacucguagcuaagggaaggccugaauuccuagaagggaagagcauuuacugaguaucugcuauguuuuccagucccuauuugaacuugaugugcacauucacccucuaaguagauauugguggcccauuucacagagaguggaaguugaggcucagagagaguaggucacuugucacggugguacagcucauggguagagagaucuugagcccagaauguccucuuccagagccuguggucucccugcugcacacacagucuugggagccagcucucugggggagcugauaaggacccuccacccugcagguggguaccuggcacacagcuuggcugucaugacugacgcagcacaccugcucacugacuuugccagcaugcucaucagccucuucucccucuggauguccucccggccagccaccaagaccaugaacuuuggcuggcagagagcuggugaggaucgcgguuuggcuggagaugggguugagagagaggguggguuagaacagggguucuuagguggcuguaauggguggauccccccuuccuccccugagugaggccaggagggugaucuggaugggggaagaggaugucaaccauggccucuguccucugggaaauccuagucugaugggggagcccuggucccagucauccaggagcucucagucugcagggaagcaaaguugaccuuccuaagaagugcaguagccaagcuucaagaacaaaugacaauggcauuaacacugcacauaacucuguggaucagcucuggggggaggggaaggccagcaaaggcugcuggaagauauaggcuuuaaccucucuuccguucacccuggacugcaucgucaccuuccucuuugugggagauggcccagccugucuuccccagaagccucaguuuacuagcugaacaaaaggcacauacuuuaauaagucagcuucuuuacauguacaaccaaaaagguggacucagaugaugacuuauuaguuccuucuagcucuuacauuccuagauauaugaggggugggguaaggggcagccauaccggccauaccuucagcagagcccagugggacccaggcccugacuuugugugggagguggguggggaggauccugaaggaagggggaagacuccuuagcuccaggcccaugccaagguggguguugggguuggguucuuccucagagaucuugggagcccuggucucuguacuguccaucugggucgugacggggguacugguguaccuggcuguggagcggcugaucucuggggacuaugaaauugacggggggaccaugcugaucacgucgggcugcgcuguggcugugaacaucaugugaguggggccccaguuucccucgucuccccuccuccucccgccucucacacccacaccuaugucugcuuugcggaaagagacugugccacuuuccagcauacgcuacagggacagaacuucccuaauggucugagcucuggcaccuggaacaccuggguccuaccuuaggccuaggccaagaacacugggagcuguaaaucggagucuucauccacucuacccacucccugauacaugucagggacuagccuugguggcuucauaccugaaguggggcgggaagaggccaguuguugcaggaguagcugucccuaggggcagaacccaagucugaaauuggucucaguuagagacaaugggugucucuuucggggucuuuguucagaggccucaguuuccccaucugugacaugauggagugaacugacagugaccucccuaaugcccuccugcucugagauuugacacuguggcauuguugugcccaggcucagccuggcauuggcgcugggcccuaucucucauggcugucugaaccaaggccacguggguuggacuucucacauggccaaagagaucacaagguuuaggggcuugagauuuuugcccuacaaguuggcuaguccuaauaggugaccuccaucugcgaccucagugagcccuuggcuuugucuccacuuccauagaaugggguugacccuucaccagucuggccaugggcacagccacggcaccaccaaccagcaggaggagaaccccagcguccgagcugccuucauccaugugaucggcgacuuuaugcagagcauggguguccuaguggcagccuauauuuuauacuucaaggucagagcugggacacagggugguggggguggcaggggaguguagaccaccugaguauacucucuaccgggguuucuuuucagauucuagcucccucccaguucuagggaaaaggguggggagaggaaaggaacauuuauccaauaccuaccaagugucagcacuucugauccucacaacaaccugaaggguaggugguaguguuuucuguagcucagaaagguucagugacuugcacagugucacacagccgguaaagcauagagccagauucaagccuacgacuguguguugucaaacccugggcaaugcccaucacauagaggcagggagcuguaguggaaagaggcaggcauuugcucugaagcuuggcucuccuccuugcuagccaugugacauuggaugaguuugcuugcucuaauggagccucaauuuccccaucugucaaauggggacggauggcggaucagaugguaucuaagaugccuuuuugcucuguccaugucucagcuccuugagaaggaggggugggaagggacugccuuauucugaacuguggucuguccuuucugcucuugcagaugugaaauaaagagcagaaaacugggaggcagggccagggcgaggcucaugcccacccagcagagagagcaccucuccccagcagugcugggugggaggggagaagggaagcugagguguuagauggugaacuccaggucugccuuccugucuuccugcagccagaauacaaguauguagaccccaucugcaccuucgucuucuccauccugguccuggggacaaccuugaccauccugagagaugugauccugguguugauggaagguaaccugggcuuuguggcucccuuuuugcucuuggcucucaagcgcuaaucagcucaaauaggguaugugugugucuggggcauccuagcacaugggcggggagccaggauccggagccccggcauaggcuggaaaaccuccuggggccccugggcugaucuugacauagagccugggcuuucagguguggcaguuccuggaaccgucccccagcccgagucuucccuucccccuaccccuaagggugccuccucugccuagucagguggcuucugggggacaucuguagcaucuggagcucuccagcccuccccuauacacuuccccaggcucuggcugccuucucucaggaagagagagggggugaggauuaugcuucucauugcacagaggggcagacugaggcucagagaaggacagucagccuuggacaaagcuacugaauccacugcagcgcaggccuuuccuacaucucagggaccaaacaaugccacacccuguggggacauggcugugcuuugugggguuggagaacggucagugguggagaaugaucuggucugcccugaauuaccuuuuuuuuuucuuuuuucuuuuuuuugaaacagggucuugcucugucauccaagcuagagugcaguggugccaccaaggcucaccgcagccuugaccuccuaggcucaaguaauccuccugccucagccucccaaguagcugggaccacaggcgcaugccaccaugucuggcuaacuuuuaaauguuuguagagauggggggggggucucacuauguugcccuggcuggucucgaacuuuugggcucaagcaaucaucucacuucggccucucaaagugcuggaguuacagaugugagccaccacaccuggcccugcaccuuggcuuucuuaugcucuaggccuggggucuugggccagggucauaggccucugcguggucagggucagucuggaauggaguaggaugcuggccugggcuuagcaguauuuggcugcaggucagagcuuuuucuccaagaauaugcuaacccagaugaaagcgauaaugaugaagaugaugaucgugcccuggguggguccaaggauucucaggaucuguucuuuccuucuuuccauucaaaaauauauuuauuggccaggugcgguggcucacaccuguaaucccagcacugugggaggccgaggcaggcagauuaccugaggucaggaguucaagaccagccuggcuaacacagugaaacccugucucuaccaaaaauacaaaaauuagccgggcgugguggcaugcgccuguagucccagcuacucaggaggcugaggcaggauaauugcuugaaccagggaggcagagguugcagugagccaagaucacgccacugcacuccagccugggugacagagcaagauuccgucucaaaaaaaaccaaaaaauauauuuauugagcaccuacuauggaguaggugcuguuuuaggcaccaaggauacugugguaaucaaaggagacuguccugcccucauggaguguccauuuuagagggagaaacugacaauaaguacauucauaaauaauuucaguguuaagaguggagaggaaauacaacagagugauagggcagagaccuugggaggugaaggcagccucagaccugcaggccaaagaggucuucuuugaggggaugacaccugaggaucaggagccagcccugcaccaaugggcaggcgugggagggguaguuuccuuuaguuuccccuguccuugccguccucagggacccccaagggcguugacuucacagcuguucgugaucugcugcugucgguggaggggguagaagcccugcacagccugcauaucugggcacugacgguggcccagccuguucugucuguccacaucgccauuggugagugcuugggacacucaggguggggugggagacaggcagccaaaggccuagugccauccccaacggguccaggugaccccagaugcucacagugcccaugcaucaagcccagccucaugcugaguacuugauacgcauuauuccaucugaucagcacaaucucauuuauccaugaagaaacugaggcugggguugggugguaaaguuacuugcccaggcuuuuacagcuaguauauggcaguagguggcagauuccuggccuuaaggccagugcuuuaccagcucuuucaggcaugagccaggucugggcugggaggcuaccuggcagaggaauggaaucugggggcuucuccauguucauggucccccauccuguucugcuggggaugggguaugagauuugggcuccugaugguuccaaagggccagaguaaauggcuucccccgcuguguccucucggcccccagcucagaauacagacgcccaggcugugcugaagacagccagcagccgccuccaagggaaguuccacuuccacaccgugaccauccagaucgaggacuacucggaggacaugaaggacugucaggcaugccagggccccucagacugacugcucagccaggcaccaacuggggcaugaacaggaccugcagguggcuggacugagugucccccaggcccagccaggacuuugccuaccccagcuguguuguaaaccaggucccccuccugaccucugccccacuccaggaauggagcucuucccagccucccaucugacuacagccaggguggggacucagcggguauaaagcuagugugacccugcucuuccagcuccugggccagcucuggaagggcuguauuugggccuaauccucagcaaauguucuaccacucgcaggggcaaagguggugagccacgggacguccaaggggaggcuggccccagcgcgcccauacugccugccucaugccccauucucagccuggcuggccuuugccuuuaugaaucugagccccuccaucugccuauagcaauaggcacgggggugaggacccucacacucucauuugagccucccugaggcagggagccaggaggcaccugaggccuaucugugccuuagucacuucagcuaugagccaaauguucccuuuccuggaggggagaggcuucuuacuagguaagagacagguuuccucuuuccuuauuuccucagcugugccaacacaaaaaacaacuuuggcacagguggugggcaggggguagagagauuucagcuuggguucugcacuaacagccuccaagcccccuggcacuucuguugcccugagagugucccaggggauucagagucuccagaaagauauggcugggccaacucuguugccuaccuggccugacccagucggagccugacaugguggagggaaagggagacaaguggggcugcacucgguccagaggccagcuaggagggaaaccgcagcuuccuggggcuugugugugaagauuccugacuuagggguggcuuuuguuuacaagaugcaagaggggaaaccuguccccgacucaucgagacaacaugcccaguuaucagggaguccugugucacaaggucugucucugccauuguaagcaagugccuugggcgagcuggccucugccccacagucucaucuguacaccgacaggguugaugccucccucacaggguugagaacaagagccaguuggccaagu

SEQ ID NO: 191422 - RNA, 65500 nt, Homo sapiens
uccuuccacacaucucagaguuauauuauuguaacaaaucagucaaaauuccauuuuacaguuaaauaguacagaagacaguuuacuguacaagcaaguugugcguuaaaaacaaacaccaagcaaacgauagugcaaagcaguuuccacccagcuccauccucucgccagcucugggaugguuuuacaucagaugagugcagcaggugucacaccucagcaugacaauaugucacaaaagauugguacccacuacugacaggcucacaguaacacuauaucaaaacgucuuccuuuccucgugcuuccuacaucaguguguuugccuaguacaacuuuaacgcagccuuguaaauaaggaccuacuuuuaccagcccaggcugucuguacccacuuugggccuuacagacucaguacggcugccgucacuuuuugucaggggaugggggaugggguaggaagagcaauuuauuuacuaucccugccucuccaggaucaggaaggguuaguaaucugggaugagacuacaaagugcugggcacugggaacccaaaggugccucccacgcugaccugggaccagcuauaaccagagaacaggagggaagaaacuacaaggacaauggauucauagcugcuuccuaagaaggcauggagaggccccuugggugcagggagucagcaacuauuuugaggagauggagacuguuuuuccagugaggacaggccaagagaaaccgcagcaggagggaauggaauaggaucaccagaaggacugccuaaccugccagugugucucugguguaugguucuggccguugugacagguuggguggggacagugcucucacagagacaaccaaugaagagcauuuuguagggcagauuucugcauccacagaggccgaggcagaaaguuaaaauaccgcaugcugcuagccuuuaugaguucccuuacgccuuuucuaagccuuucuagggccagagaacucugaugugagaauccaugcagccuggcccuugggcaagcgcccacuuucccauuuugcaaaauucaggggcaagacuucaccucggaacgcagugcagcugagcugcggcuggagagcccuuuacagugcuucuguccugccacgcacagccaguacuccccaccucucacauccugcccaccuccgcccagccuccuggacagauguccuagagccacagaggagagaugcccagcgucucaucagcguuucccucguccucccaggggagccuguggugcaggcuggugggaugcugccugauggggaguguagccccuugagaaaguauugagacccuaauaaccccacacccucaggaggcagcuggggguccgcgggggggagagggggcggggauguugcuuauaaucacagagcuaucauaaucacggaacuauaccuguaagagaccuuguguuugaaaacguuagauuaagcuucuuuuucuaaaaucaguuuuaaaaacuguuuuguuuuuuuuuuguuuuuuuguuuuuuuuuuuuuuuugcucaggacuauuugcuuucagagcacaaaacagguuacagacaggugugugccaggagucgcaagauuuggcuggauccucccaggaggcuugggggauggggcacagcuuggcuggacccaggggggacagggacauugaugucugacccaaaaugaucccucaccucaaugccuucugcuaggaccuaucuaucuggcccuccuguucucuccacaaauggaauuaugagaccaccuaggggaaaggggaccuccuauccccccucccccgcccugccaagagaacagagaguggaugcguugagcugguaaagugcauggaggagccggucuguaggugcuuuccuggguuuaagaaccugaugccauagacucaucuucucuggggccugggacccgugcggcugggggaaagccaacaguuaggaacggaggggaagcugggcuggggggacuggcuuggauguguucucaaaccaucucugccagcagcgugcuggguccugccccaucuguacaaugaggggaaccccgcucgaggguggugggggugggggacacuuuccaguucugacucaaaucuguguaaaugcagagggggcuggacccaggggaugcaggggcuccaacgaaggugcaggggucgggagguuucccagggccugaggcuuauccugugggccaaugcugccucucucuggaagagagauggccucugucccaggagacaugggucccaugcagcacugggcauagcuggagacagugagguccuuccggggggguggcaggaggcugauuccccacagaaguaugggaugagacggccaggaucugggccgggggcaguaucccgggccggggugggggugguaaccuaugccucuguacaaggauguggcugcacagaugcagccagaggcucccaccagcugggaccacccugggaccgagaccacccuggagcgcaggucccauucccgcccggagccucggagccggcccaucacuggucuugaagguuguuaggguccccgccuccagcgggaggaguccaccagggcggucaguagggccgccacacggccucauccaugcggccuggcgugcucagggccgugggugaguugcuguggcugccgucggccuccacgccaucacucuggccgcccaggcugggguucaugagguugccggcggcgacagaggcagcgcugcuggugcaagaggccagcaugcggguaggugagcggucgcccccacugcugcugccggccaccauggagaacugguaggagccagaggaugucccguaguagaggugguagggggacggguuggccuggaagggcccgcucugguucugcggggcccccggguaggguggcgggagguagguaugguggaagcggcugguggccggcaugcccgccacgcugaggcugcugaugcucgugcccgagggcguggcgcuguaggggaaggcagcugacauggccccgggauaaugcauccuggggucugggaagcggcucuccgugaggguuggcagcguggggaaggagcggucaaacuggcgggggucggagaauggguucaguuccgaggugccuggaggacagcagggaagaggucaguuccagcucgagacaaccccaggagggcuuccugaagaaugaccuugggcucugguucccaaggcccaucugggggaccccuaguucuagaccuggcucuccucuuccugcccuaggcugcccggggccucccccgccaggacuccgaacacagaccugccgggaagcugguuggagcgugccccgggccaagaggggccaugggagcccccccacagcagcaacagaacagaggagggggucuauucuucuuuuuaaauccuccuucccagccucgcagaggagaggccuaggaugcggugguggggcugagggcagagucagcucaggccucccagcagcccugcccaggcagguuccucuccccaccggcccauguuaacagcugggaaggccguggauguguaaagggcuccaaugaccgugugagacugggaguuggaacccgcuuuugaagacaagaaaauggaggcagagagagagcaagacugagucucuguggcagagaaaggacugguucucaucacaaggccucugcuggggacacacgugccucuccugcccaggugcagcacgcggagguucugugcgcucacaccuggguugugggcacugaguucacaggagcucuggccuccaccucacccugggccugugucucuggagccgacucguggccacacagugacuggaugccacccuaaccugccuuggcagcaaagugagacagcagucagacaaacuuggggacccagaccccaaccuggucacaguguccagcccagacucugccccugcucccccaggaauguggcuucucaaugggcuccaaggcaaggguguuccauccucuguccccaacuuuugucaucacagacccccaaaaccucagcauucaaaggggcucagggauugagucuaacacccuugauggggaaacugaggcccagacagggugaggcacuucccucagggucacacagcacauuggaccuggcacacaauccuagggccucugguccugagccccaacacguacuugagagggagcugucccgucuuugaggcagcacaggaucaaggcuuacuguguggcuucuggagccggacaguuauccugguuuggacacuuacuagcuuuguguccuugggcaagucacuuaaccucucugcgcaucaguuuccccauauaaaacaugagacgauaacaguucaucaggauucaguuaauucacaucgaguacuuagaauggcacugggcacagagcagggguccaugaggcuuugcaaggccacuguggcuguggugucucuuacucuggguacccaggagaacuggcucauucagggcccugccaaguugaggcccuggugcagggccucccuucuacucuggcagccgggggagguggaugagcccccagcagugguccagaggugcagucuguccagcccagcaaccccucugugucacccaccaaaggauaagggccggugcuagccggagugggcucugccugccacgccgaggcuuggcugaggacggagagcuaugagccugaggugugugugacuucggcugggacuuggaacuucucggggcuuuggggucuucccaagucagcugggguauguuucccucagcagcguacucuggcccugggcguggauccgaacggagugaugcuccuggcuuaagguaagaagauguggggacagcagucuggguggcgggggccuucugggacaucugggauguucccuaguaggucacuuggcugucccggccccuugaggccgagagccuccgaggcaccuggcugccaguuuucaucuggggagccccucggggggagagguccuguugcaggugcugggcacgucagcacagcugagaugggugggguggaagugggugcuggccgccugaugggaaccccauucucaagacgaaggaaacaaauggggaccgcaggauacaacggcaggacugugccccucagagcucacgcgggcugcagggcgcugggcugggccucccuggaccugccaccauccccuccagccucuuuccucagggccaccaccccuccuccgggguggugggggaaguaccugcccucagcacucccucagaccccccagcagcuuccuuggagcuccuguacccccacccugcggccucgcagccccaggaaacccgagcugcccggggcacugucgaguggccaaucccaacaguggaaagaaauguuuauuuucuucuccagauuguccgggcugcugcaugguggcugaaugagcccuuucagcugugagaagcccccauugugggcggcugcggcugggggcuggggcugggguaugggaggugcuggggucucugcacugcuugccagugaccaauauuggagggucaaagcacuuaacaggcaccgagggaaguggugguggggugucccaagggggauccccaggagggaguccgagggcagagggaggagggccugugagagugacuucccaagccuaggucugccagcaaccccucuuugucagggaccuccuucuccccacuucacagaugagaaaacugaggcugaguuuaagugacuugucuaagaucauacagccaaugccuggcagagccugaauuccuagccugguccagcugacugcagaguucaugcucgcccuguccuggucauccgaggcccuuucucucacccaaaggggaugggccugaggauggagaugccuggcugccuguggcccagugcuguggggggcuagcgagggacugggccaggccucaggagggagcaggcagagaagcagaagucagccacugccccacacaggcugggcuccuuuccucccagcccaggauggaagcagcagcugugccugccguggggccaggcauugauucccaagcugugcccacccagcaguggaugggcagaugugggcucuccuuccaugggggcugguggacaggaagccacuguucaccccaccuccuggauucuggcucccccgcugagccccgauccccuggccuggcucuguccauggcagagaaaggcuggcucucaggcuacugcaccucgacagaugcuggcccauggguagcagaagcagaggcagcuacgcggcaggggugggcgugagcacagcgugcagggcuccuuccgcuaccucuugagagcagaccuccaacuccugggcucgagagcugagagucucaaaugcacuagcuccugggcucagagaggcugggccuggggcuucucccaaccuuggcgucucagcaggaccaaggccaaaaguccugagcccaggccagaaggggagggguccucucuucacacugaaggccugcauccagccccuggcugcagcacuaugccuggaacaaugucaguagagagacccagucggcccccaccucagcguggcaccggaaaaggggguggggcaggcagaccgguuggcagcccuguuccaggccccuuuaucuguccccucagaaguacagaaaguucuugggagcagguacuguggagacuguggaccuggucacagaugggcugugugacccgaggguggcucugaaccucuuaggccucucaauucauucaucugccaagggguucuaaccaggcucuggggaauugagaaagaaugggcacaguccgugacggcagccagcugccugccucuguccacccggccaccaagcacccuuggcaccccacuuagcccaagggccggcugugcacacagccucccauguccccagcucacugacugagagaacagaggagagaugcagccggcagccguuuagugagcggcuacuaugcgccaggcaccucgauacuccagaagaccugccugaggccuggcugcaacugugcuugcuguauccgucuaggcaguggagauggagaccccagcucggucuucccuuccaccucagcuccuccuguuugggaggaugcucugggcagggugggagaccuuucccaggaaugcuaugugccucucuaggguuggaaugucacuuaacagugugcaaaguuugugugaguacaguaaugucauuugaaugucaucccagcccuggguggaggcauccgccccaauccacuuucagaugaaaaaucgcaggcuguggggcagggguggggaaacuguacauggcaggggcgagucugucacggcuccuuggacaagucaugccccaauuuuaauaggggcacuaugggguuaaccccauuuccccaggcacagugaacuccugguaugcagaucccuggggccaggcaccaggcaugugucaguaaugucaguguuugcugagugaacgaaugauggcuagcacacagaaagcccacaggaaccgucugcaggugccaaugagcaccagcagcuccucuacaaaacaagggggugcagugacugaucuucggacaggcuuuuggucuggggcagauuggaccacaucgaggcccuccacccccaccucaccccgcugcagccccucccuccgugccguaccuuggauuggggucuggggcuggcugcugaaguggcuuguggugcugagugagccucgggggcugggugugcucggugucacccgcaugcgcagccguuccagguccccaaagcggucagggaacggcuuggucugguccuccagcuucugccggugcccugcagagcacaggaagcccaucagccguugcuuccccagagucucaguggagacagaaaugccucacucugcugggaaguucuuccugaggucugaccuuaggccucugcugggagaacccugaggucaccgccagccucuucacagagguuuucaaaagacuuucugaacagagaauggucguuaugugccaccccacauaucuaaaccucuacaacacacggugauccaaaccucuacaacacgcggugaucuaaaccucuacaacacgcggugaucuaaaccucuacaacacgcggugaucuaaaccucuacaacacacugugauguaaaccucuacaacacgcggugaucuaaaccucuacaacacacggugauccaaaccucuacaacacacggugaucuaaaccucuacaacacacggugaucuaaaccucuacaacacacugugauguaaaccucuacaacacgcggugaucuaaaccucuacaacacacugugauguaaaccucuacaacacgcggugaucuaaaccucaaccacacgcggugaucuaaaccucuacaacacgcggugaucuaaaccucuacaacacgcggugauccgaaccucaaccacacgcggugauccgaaccucuacgacacacggugauccgaaccucuacgacacgcggugauccgaaccucuacgacacgcggugauccaaaccucuaugacacgcggugauccgaaccucuacgacacgcggugauccgaagcucuacgacacgcggugauccgaaccucuacgacacgcggugaucugaaccucuaugacacgcggugaucugaaccucuacgacacgcggugauccaaaccucuacgacauguggugauccaaaccucuacgacacacggugauccaaaccucuacaacacacuguuuggcagaagaggaaacugagggccaggugcaguggcuuacgccuauaaucucagcacuuugggagacugagaugggaggaucaguugaacccaggaguuugagaucagccugggcaacuaucgagaccccugucuguacaaaaauuaaaaaaaaaaaagaaaaaagaaaaacuuagccaggugggguggcacaagccuguagucccagcuacugggaugacugaggcaggaggaucacuugagcccaggagguggaggcugcagugagcugauuguaccacugcaucccagucugggcaacggaacaaggacccuagaucuaaaaaaaggaaacugaggcaacagacaugagaaaguggcucaugcccccaagggaggcagggagauaacccaggagcacugccacccucugccucccagcaucccagccugccuugcacacugucucccaugucuacaagaacaaugggagguggccccaggaggggacugcaggcuuuuccagcccuaagucacucugggauccccagaacaugccuucuucucucugggccucaggcagaaaaauaacuccaccaggaugcugggcagagguguagggggcuugcaugagggacuagacagccaucucugccuggaagcuggggucaggggacgagaugucacaccuggagaaaacugccagcauuuuccacucccuaucugccagagcccacacaggaagaaucccagccucacauccgaggacucagaggugcugggagggucaagguggccaggcucccacccuccugcggccugcugaggccgagggacacuucuggagugauaucaagcuugcagggaccucccccgccacacacacuuuuuuaauuacuaauuuuacauuucacaagcaacacgugaauauuuacaaaaauaaaagcauuacagauaaggcucuguccaccgcucuaagcuccucuccagaguccccaccgugaccaguuucuuuccagacauuuuucaucuuccaugaauggaaaacgcaaaguaggcuucucauggaacucucuugaacagccucaguccgggugugucauucuguaacuugcuuucuuaguagcacaccuuggagcucaaacucaguuucccuaucugcaaaauggggacaguaauccagccccacagaaaugacggaguucccauaaaacccuggggauccucccugcuacggaagggauucaacaagcauggcgagaaugacgcugcucucccucuuuccugcuggccacuggaggcacaguucacuccgcaguccucuccacccacauuucaguccuucucaagcuuccccuuuaguucccuuacaugcaacacucccgggaacgucccuguucgcacccccuaguggcugcagcuucuccagggcugacccgaggaaaggacggcucccuuggaggacugugcacuccaggguucggcugaucaacccuaacacggucacggccauucuaccucacgugacuuggugggaggcugccagucaggcaggguggccaggcccucuuuuacaaguaagagaacugcaacugcggagaggcgaggaagcuuguuggaggccacacgccgaacaaggggugggauuuccuggaccugggacccuuuagaaaagauggaggcuaggcaugguggcuacgccuguaaucccagcgcuuugggaagccgaggcgggcggaucaccugagugaggucaggaguuugaaaccagccugaccaauauggugaaaccccgucucuacuaaaaguacaaaaauuagccgggcgugguggcgggcgccuaugaucccaacuacuugggaggcugaggcaggagaaucgcuugaacccgggaggcggagguugcagugagccaagaucacaccacugcacuccagccuaggugacagagcaagauuccaucucaaaaaaaaaaaaaaaaaaaaaugugggaggggguaagggggaggagaagguuugccuaaggccuugggucuagaaugacaugugcguuuucuaguuuggcagagggagaagaggcaagauguaggugggagguaaaacagaacucacugcgcuucuuggggccugaacaagugauugcuggggacucgaaaagugggaaaagccugucgaccacuguagggcaugaggggacagagcccgaggccucgcaugggccugauuucugauuuucagaaugggaacgcaauggauucugguacuuguaggcccccaagcucccuacgcaucccuguuggaagcucaaacagguaucugggagccucagaaagaaagcagggggccugggagccacaggggcucagccagucaccaagaaccagggagccccaccuucuccuccaaugaggccccagaccaggaauccaugggacacuugguggcaggaauaagaccauuuggucucuggccaggcccccacugcugccucccagggcccuuggcaacaaaggggaaaacaugggcugggggcgaguuuagcuggagcuggggcugcaaacucagaugcccauggggauggggcaagucacgugaacgaggcaagugggauggguggggccuggagcggauggggaggagaugccuuguggaaagcaccugacugcuacccugaggagggcaggcccaguacggccagagcuuccaauuccagaccgaguccucagcccuaacaggccuuggaggaaauguuguccuugcuccugaggccacuggaaauggcagggagauguggaugagcugggggacaagugagcagaagaaucuuaacaggcaugaagccugccggguggacguggggaccacagacugauccgacaacagccugagugcaaaggaucuggguguuuuagucagccacaagcuugaagggagccaauagggcuggugcaaaaccucaggccuuguuacuuucgucacaggagaauaaaguccccuguuucugagucacaccauguacaaagaguguuuacaguuacuccugcggccuggcggaagagggcgggguugacagccagccuggguucgaggacggguccugucacuugcagucugguggccucacucaagucacacuccuuucccccaccccgagcugcgguguccccaucacacugucuuuguggguugaggugcuggccuaagguguggacacuuuccagucacgugggucaccaccaucaugaccaucgcuuuuaucucugcucaugcccaaaggaagcagaacuaucauccccaugcuggagaccgggguguggaggccaggaugcugaagucgugugaggaacacagagccugagcagcaaggcaggauucacacccggaucccccgacuccaagcccagggcucuuuuccugacacuuucccuuuuguucccauuguuuagacggggccaccgaggcuucaccaugagaccgacgcugagcgccuguuccgggacccaggcugugggucagguaaucugaccccggaacccacgcucccaccacaugcucccuugcccuccguagggcagacuucccggaggaggggaguccaacagcacuucggaaauagcuuccuuguuacuguggaacgcuggagccacugccagggaggggagaggggagccaaggcggccccacguggccagggcgccagagagucucagagccacagggccagggcucucacacugggaauaggacagaaguuccagugccugaggaaagaagauggucuucagaaaaagccucuuucauucgguuacccagagcaagagcugcguggggagcucuggcucuaacccacuccgucaccuugggcccaguccugcuacgccucaguuuccccucugcacagucugcucacugaggccccuuccuuuugaaagucccugauuuaagguagcaaagaucagccgcuggucagaggggccccagaaagaaaagaaggcagggcugcuggccccagggcccacccacuaccacuucuuccugcugcugcuguucccaguauuucuugaauauucucugccccccacucuucagagccucagcucaggacagccucugccagcaaugcuuucuguccugugaagcccaguccaggagccccuccuccaggaagccccccuucucccacaguagauccccaucacaccucugcaggcuagggcuguccuuuaaagcagucgccagcaggaguggaaaucaucaaaacggcagcagaugcuugcugggugcuuccuccacggcagcgucuaagcagcugacaagcaccaucuuguuucgccuggcagcauccccuugaguaaugucugccaccauccuaucauaugggugaaaaaacugaggcucuggacagccagugagcucaaggucaagcagaagacacacagccaccugcucucccuagagccugugaaaacacaucuauuguggcggaagagggcgggguucacagccagccuggguucgauacaucaauagauguaucgggacuccacaauagauguuagggccccguccagccccaggcccagagcugcuaucugcaggcccaggaggauaggacuugggagaggaagaugagaaggucucaguggacuccaccaggggcccuucccugcucugaagcucaggguugagagugcaauuuccaaucauacccugcucuagaccaccaagucacucucugccucugggccacaguuuccacaucuguaaagugguuaucauacugucuaaccccugagggugccgaugagcuggaggacaggccacaugcuuuuaaaagcagaggacugagauggcuggggaaagccccgcguuggcccucagggccuguccuggcugcugucagccuccagcugcugggcucagaucagacagcuccuccagcauggccuggauuagugucuaugacccucacuuaugggagggcagaucccagccugccccucccaagggcccaguggccccaagcucauaccaggcagcucucacccaccaguggucacugucuugggcaagccacucuugccuucugggccucagcugucuuaucugcaaaauggggaucacaccucuaacccccgagggucaggaaagguuucaagaauuacacagcccaccaggccuuggccuuugaggaagguguucuggguucccauucugacuuggccaucugcuccuaggcaaacagcuccucucugaugcgucugugcagugggggugacccaccucacaggcauaugauaaaggccaaagugggagcaggaaugcugggccccagccagucuggggacucaccagggucacgcagugugggagcuagaggaccagggcuggauucuggguuggcagcuccuuuaccacuguccccagggaauccuuccccaccaccagccuggccagccugggguccuacccccgccagguaccugaugcuucugggggaaccaagagaccaucaggguuacccccuugccuccaugcaggcccaacacaagccccugucauaggaguggcaaccauuuuagcaggcauccaugaugugccgggcacugugcaaggggggccaugcaugucgucuccaagggucauaucccucugacaggcugugacuaucacccccguuuuacagauggaaaaguggaggcacacggucaaggucacacgguguguggcaccccugagauucaaaccuggaaaggucacacauggagcucagcugcuaaggucaucgcuucccaagaccuccaugagagaagagcugggucaccuggccguaagguccagcuggcaagaggccagcucaguguucagccucuugggaaaagcagagucgggcagggccacaggaacagcaucgucugcuggggacagugugggcuccaaugaccaggcccgucacccaucugaagccacucggcagccuucuuggccgccuggugcggcugugacccagacacagcagccacugucuacccagcagcaggguggggcgccgggcccgaggccggcucugcggccugucaggagauuuacacccgacucuuaacagccucgcggaaucgcaggcgggugccgggccugggguggucugcugugaaucggcccccugugagcagaugaaagccgggucgguggcugggcagggaaacgggcuggccgggggccagcgggcagggaggcgagcgguucccucccagggcugcaaguggggcuuccagaggccugggguugauuaggagaacccaggaggucugugguuaaccccuucccuccugcugggcagacuccgcuagcccugccccuagcgcaggagacacuccuggggguuguggggaucuugggagccagggaccuggagcagcugccucuccucagcccaggaagaaacuacagaaacucuaaggccuucaaaggcccaacugcgggcucagggucacuucuccugcccacgccaaacccucggcagccacacucugcuggcugcucacuucaggccccugcucaaaggucaccucuucaggaggccuccccgccccaucccuuguuccaucccuugcacgcuccacuccuucucccagcuuuguuuuucuucauaggacuuccuacuacccgaaaugacauuaaugaaucauuugcuuauucaucaacgauuuauggagcagcugugaagggcuccugcccacauucucagggucuagcuauaccagggccuggcaaaccagagcaaagaacucugcccuuguagagcauaaacaacagggggccgggugcgguggcucacgccuguagucccagcacuuugggaggcugaggugggcggaucacuugaggucgggaguucaagacuagccuggccaacauggugaaacccugucucuauuaaaaauacaaaaauuagcugggugugguggcgugugccuguaaucccagcuccuagggaggcugaggcaagagaaucuccugaaccugggaggcggagguugcugugagccgagaucuugccacugcacuccagccugggcaacagagcaagacuccaucucaaaaaacaaaacaaaacaaaaugggagaaaugaauaacaaaugaaacaaacuaucggacuagauagcaccuuagaaggugguagugguaagugcucgggguaaccuuaaagccaggaaggaaaagggggagaggugaggaaggcugugugugugccacuugaaacaggcgggcugcugagaagugcagaggcuuuagggugugaaggagugugccaugcaucuggggguguccggggaggaguguuccagauagaaaaaagagcagugcaaaggcccccgaggcaggagugucccuggcaaguucaaagaccagccaggauaccaggguggccagagcaggaugugggagggagggcaggggguaacgggcacaggcuaggggggcgugagggccuuucccccaccgugguccaugccagacuugccaggugucaccgccccuccugcugggauccuggaccuggcucagcaaccugcuucuuaaccagcccccagugacucugagggacaccagcacugagaaccucagaaaccgaggccacacaggcaggaagccaccaagccagccuucaaacccagcuggccaccuggcugcaggccgggcacgcucugcagggcaccagaggggaacgacccggccacagaacccacagccggccucagggaucuacagauucccaguccuuggcucccaggaccagccccuacucccacuucaccccacagcgggcucagauuucagagggucggagguggcaaaacaggaaaaaagccgggaaaggaaguccaggagcacaaaaggccuguaacaaccugugaagguugugggggcacuuccuggggccaggccccgguaaacucagucaaccuucacagcgacuccccuaggcagacaccaauaccauccauuugacagcugagcacacugaggugaaaaggcccuuccaaguggcccucacuucccgcagcccccgggucggagcccccagggugugcugacagucaccuugggcaaaagguuuugcgcccuggccucuauccucuccugggguugcccaagagaucaguuacuggggacuuugcacagggccugacgcaagggaggggguugcucagugaccaggagccgcugagcuggucccuucacucuuacagauggggacgcugaggacccgaaaggccaaggauuuguccagggccaaagacaaaggaguggggcugcaacccaggguauggggggggaccugaucucagggccaggauaugccagggacaggaacaggcagguccuaaggaugggggaccuaguagacugccccccgacuccaucucugcucuguucuguaaauaaaaccacugauccagccgcugccggggcccagagagggaggucaccugucucagguggugcagcaagccuggcuucugacgccgugggucuccaggcccagccucugucccucccucuuguugccucguccugagccacgcauuuaccuuccagcucaccccagaaggggccaucucaggucugggagacccaggcagggaagagcaggcaggggauucugcuggaaucucccacaggcagggcugagucuccaugcucauccaggggucccagcagggcagagugggcggcucuggggugggcugggcugagcauggagggcucucagaggggccaaccuugcccggucccuuggaucuucccaccaagcgucaagaccccgucccgugccucccucuuucuggaguggcuccccucuuucuggaguggcuucugagugccgcauccccacccagagcccaacugaggcuccuguccaugcugacccugccccuggagacauagggcagggcugccaccuccuucaauggagacuugauaccugcaccucuauuaccaaggcagccacccagcugcugcccaugagagagcucaccguugacuaauggugguggugggagugcaggaagggggcuggguacugaggacgacaaaacgcugcggacccagugacucaugggaccccucugugcuacggccacgugcuguccacaugucgccccugaucuccagguccgcaggguggguggcaucaucacacuucauggaggagggagcugaggcccagagaggucagugacuugcccuaggucacacugcagauaacagcccuggcuaaagugacggaucccuugcuaacccccaccgcuaagugcuuucuauagauuaagccacuguuuccucgcaauagcaucaugagguagcugcuugugcgaauaucauuuuucaguucaggaaacugaggcacggagaugacuagcccaaggacccacagccaggaaggcuggcuuggaaacugcucucuacaccaugguggucuauggcucaugagggcuucccagccaucaccaccuugagacuccuggagucacugauccaguucucagaugacaaaacugaggccacaaagaagacaugacuugccuagggucaugaagcccaaggccaagggcaugggcuggucuaugucugaucucagcaggagggaaccagcaggaguguggccagggcaagugcuggcugggagcugacggugcaggccugaggaugcgugccggggcucagggcuggcagaggugacccugagagcccuggagggaaacucuuccagggcugcuggacucagcuccaagccuuucccaaguggccagaugcugggaugggcccaggaauuggaugauggggugucaggcccagcugacucccaagaagggaggggccagcccagggcuaggccuccugccccaggccuccugccccaggccugcucagccuagaaucuugccucugggaagacugaagccuggggcgccuuccugcuccuugcacagcauuagguccuauucagguacccaacucccucaggccuggauucucuccucacuggaacuugggugaccccucuggcucugcugucaucaagaucccauucaauagugacugcuaaaaggucuucuaaacuacaaagggucacauuucugagaaagagaggggugggccaaccuucagugcaccaagcugaaaaugccuuggggaggugggauggagcucaggaagcuggcuggcucuauuucauucauucauucauucauucagucagucagucagucagucauucauucauucuguggacacagagccucagccuacccucccacuuccccagccuuaaucugaccuucagcaagcagagagaauuaaacacaaacucgcuuugauggaccagaacucccugcucauagggucugggugcccggacucugggugaccugagcaagucacaugcuaagauucaaagacucaguuuccaaggaagaggccuggccucacagccagaccagccccugacuuuugaucacuccugcccuccaugcaucccucagccacccgcagagaagcugggggcagaguaaagcaagccuggcucaaccuccacccagaaacacacaagcacccgacaaaugccauaucugaaagcuuucuccauccuuuuccuuuccuugacucccucaguagucuccauggacagucaucuccacucccagccuccucgcuggccucccacggucucaggcuaagcccagaggguuuagggguuugccagcaggcacgcagugugugggggcacagagccaaggacugcaaccccccgaggagggcuccaucugucugaccuagcugcuguccuucccgcacuggacccuccucccccgcgcaggggcucagggggcucgguggcacuuacgucugggcucccgggguccguccacggucaccuugauggcucggugguaggucgccacuugggugggguuggugaacacagugauggucagggugaaacucuucccuggggagaguggggaauagaggcaggugguuggcaccuggagcuuccacaauacccugcucucccaccuguaucuaccccuggaagccccuaacugucaagaaggggcacucuguccucuuugaacaugggcagaagauagggcucugggugaaguucaagcucuugggcuuggcauucaaggccccugggggucugacgccaacuuugucaaccccccgccccaugccgugaccacccuggcucauguuccccucuucuuggccuuucugcugucucuucuauucagagacccacacgauuuugugguggggagcaggauggguauauucuauuuucugaaaguaauuggugaucuuuguagaaaaauucaagaacauacaaaauauaaauaaagaagaaaagacaccccccccccacgguuccacuagcuggagauagacaccguuaccauuugguguuuucccuuucagcucuuuuuguauggguuuguauauuuacacagucgcagugguacuaaaauacagauuuucauacuguuuuuuuuuucauuuaaccucacaucagaagcacuuucccacgucauuaaaacuccauaaacuucguuuuuaauggcugcaaaauauuucaacucaaggaagccuccucaucuuuuauuuaucuaccuccuuacucucggguauuuacaucguugcuaauuucuuauugaugugugcagcuggagcugaaaaaggacugauuugggagcugcagacauuucuucuguagacacaacuguuauuuccagaauguucuauuuuuagauagacauuuggcuccaaagucuccauucaaaauuccugagaggggaaaaaacuuuuaaaauacuacuuuuuuuuuuuuuuaccauuuaaaauaaaaugaaagugaccuucuguuuauaaaaaucuuugucugcaucucugcuuauuuccuuagaagagauuccaagaagcggugagugauuucacggcagcagaggguugggacauauuacgggcgcggaucccucuuggagugagaugacucuccggagagauuuagucgucacccucgcgugugaggcugcgucacaccccagggaugugucuaucaagauggaagaucuuuuacacgcucuugauuuuguuugccuuuuuuucuauuacuagugagaaugaaacuuuuuauaugauuauuauccaucauaauccaacacaaauuacugcuucauguucuuuuacuuuccugugaagguuuuagugccuuuuaaaaauugcuauauauuaagcuuguuaauacuuuccaugcuguauuuguggccaucaguuuccccgggcacaggccugcacauuuugccuucacacgcugggugguuuuucauuuucacuucuauuucucguucuucuaucguuuuauguucagacggguuucuccguguagaaagcaguuuaugaagauuuacuuucgacagucuucucucuacuuucuacagugaauucucugaugugucugggaguuugggggucuggguaagaguccuccucucacccuauucucuauuacgauccacagccucaugcuuuaugagauugguggccgggagcgggggagauuugcggaucccccaagccagacuuuaucccccuaucccugccucuggaucccacguacaggccugggaacucccuguggguaggggccaauggucucgcacucucaccuguaccccagggcuggcacaggauggucaaggagagaggcugcccaagcgcaucccucuggugucccccugacacgccuccaaagugagcagguagguuucaacagccccacguugcaggugggagaugaagcucaggguggagaccaguaucucacaguucucuuugcauggccggguacuuguuagucaacugaucaagugaaaauucuagccccagaggcaggagaauccggaacaaaauuaaaccagccaggcugccaggagccaugccacaggacccaaggcccucugagacaccagggggaauuuaaagcucaagacccacugagugucacuccagcugggaaaugaggggcuucucuggaagccuuuuccuaagccagucggcugaggcagggauagaaauucugacugcacuugcccccggagccccaggucagaacagaccuggucucccacucucaggucacaggggccacuuuguaugauuucuggaagcagaagugcagauggucuagggaagugccaggcagaugccucgggcucccugcccgaccccuccuacugccuuuccucacucugaggucauuucucugcuggaccucuuucuccuccaaccagcccagcacucuccuggggucccugagccucugacccugccagcauuguccagcaccuucuugguuaugacggggaguuuaggcagacagcccagagcccuaggggccagacuggagacacggaggacuaaugggucccagugcccugccacagggccccgggcccacagcagcauuugaaagcuuacuaaaacccuccuucaggucgcccaccuucucagucaggccuucccuggucacuuuaucugaaguaggcauuuuuaauuuuaauuaauuuuuuugagacaaggucuugcucugucacccagguuggagugcaguggcaugaucauagcucacugcagccuggaccucccgggcucaagugauccuccugucucagccuccugaguagcugggacaacaggugagcgccaccaugcccggcuauuucuuuuuuucccuuccuucuuuuccuucccucccuuccuuccuuccuuuccuuucuuuucuuucuuuccuuucuuucuuuuuuuuuuuuuucaagcuuuuacuaugugcccaggcuggucuugaacuccugggcucaagugauccuccugccuuggccucccaaaguguugggauuacagucguaaaccacuacaccuggaaggcauuuuuaacuuggcuccguagaguugaaugagccugagaacuaggguaggaaaaaauuacaauuguauugucccuaaccucuaacugaaauuuagcaucacucucaaguacgagcguaggcaacaaaccacagagguauuaucagccguaccugugaccuugucaccaacagacgucacagauacuuacauaucacauuacaguugcugcagauugcucuaaauaucuuuuaugcucaucacaacuucaaaaccaugguugucauuaggcccaaugcuagaucuuauuuaauacauugaauaaagcagcacauuuaccacaauuuuuaaaguauuuugcuauguuuuaauagaaaugguuucuauuguaauacuuuguauuugauuuuauaccuuaaaaauaucauuguucugagaaaggugugcgggcuucaccagcuaucagaggggcccacagggcaaaaaaaaaaaaaaaaaaaaaaaaagcgcuaagcagcucaaccugaaguaucacaggcccuaccacucccuuucucuauucccugcaccugcuggaauuuucucacaaugcauaugcuuuuaauaauccaucuacucauuuugucuccuucuacuagauuauaaccuccccaggggcccaaguuuuugucuuguucaugcagugucuccagccccuaggacggcauccggcacagaguaggugcucaacaacauuuguuaaauaaauuaagggcagagauaauggcucccauuuugcacacagguacuaacgucccgcuccugagaagugagaagcccccacccauaccagguagcaaaccacaugccaccccugaggucaccagcacuccucggccgcuuccaccagcuuccacgccugucaccaccccucccagguacaaaggagaggaguguggggccuaagaggaggagugagagggaggggcaggaguccuggaccucgggagacagggagccuggggagcaggggugggagaaagcugucucccugagugccccucagcuaccccggcccugcccagcucucucucugccuggcaguggcaaacccauccaucccucucucucagccucuagauauaacucugugcaggagucccaggcaaaccugcaauccaucaggagcccaggaaguguaaacccaggcucucugagggcuggcccugguugcaggggagaagucuuggucugggaaauggguuuccuuuagggcuccagaaacuccuccaggacccaucaucaaccagccgggguggcagcagggccucaggcaaguccuugagcauucucugccuggguuccuauguguauaagguccccgccccacccacaggagcugcauggguggggggaggggacgugucucagucucaggggaccucgggguuuucucagcuucagccaagaagccauucaucucucccccaaccagcgguuccccucagccugcaccggcacacugcaccccgaaucucugucgacacacaguugcuuuuuaaccaguugaucacagcucgagagcucaugugcuuuucauuuucacuuaggccaguggccgccugcuagaggggcauuuuugggauuugugguggcguguggucaacauaguguugggguggcacugccagcguuagggguggggugcguguauguggugggggaugccagcacccaacgcugcccaggguggugaagauucaauucuuccugggagggaaaaacuugcuuauaaaaguucucuggcuggucgcaguggcucaugccuguaaucccaacacuuugagaggcugaggcaggaggaucgcuugaguccaggaguucaagaccagccugagcaacacagugaacaacacccccaucucuacaacaaauaauuuuaaaaaaucagcugagcaugguggcgcaugccuauagucccagcuauugaggugggaggacugcuugagaccaggagguugagacugcagugaucgcaccacugcacccuggccugggcgacagagcgagaccuugucccaaaaaaaaguaaaagaaaaaaaaauuaucugagucaugaaccuaacucaguuuuacauaaaacaaggguuuuuuuuguacuuuuaauaucuacugaauuuuccagaaggaaagacaguucuuuuuuuuuuuuuaauuuuguucagcgcuuugccaacagguguugacaacuucagaaagucaugguauuggcagcaaggccagguucagauugagcccugccacccugccuguucccucugcugugggcuucugcauggagggcauucguccaccucauggaguccuguggccccaacguuuacauauucaaaucaguguuuuauuauaaauuacuuucccuuuuuuucuccaucauagcuauggaauaacauaguuugcaacugcauguaaauagguagguuucauuauuuauacauuucaacguagaauaguaaggcuugauauaaaauauguauuguaagaaaggcuccucgugucuggcagggcagggaccucagcccuaaucacugcaggagacagcaaugaccugguuuuccucccuuccuuuucuugguucacaccuucagcccuguuguuaagagcucugugguguuacugggugcgugucuuucauggaaagccaucuuccuggaauucagacagaauguagaacuaaaaauugaggcaacaagcagagguuuccaucagacuucuuaguucuggcagaagucaagagacccaggcaaggguucugggucccaacccccagucuuaacucccaaagugucccaucuccuaaaguggcccagauugucacugucaaccacugacuguucucucaggugggaauuucccagucagcaggaugggcacugcagaugugugucugcaugccagcggacccggcacccuccuuccucccugccaaccgccuccaccucucccacucagcaguucacaccuucuggguuucccccacccccgcccaaaccacacaguaaucagagaaucaguggcugucaccgcucaaagggaccucaaaguccuccuccagucccaggcauuugaaguaacaaaaucucuaacauguauccagcucucaauaugcgccagcugauacacuugugucaauuucccuaaccuucccaaaaucucaugagguagguaccauuaucauccccaucucacagaugaggaaacugaggcacagagugguuaagucauuugcccaaugucauccagcaagucauuagcagagcugggacucaaacgcaggguggcugauacuagaaugcaggcucucaaagaccucgagccucugaaggcugaacgccuuagccacaguuccucagacaucggaacuccuccucagaucacuuccugccucccaggaccacugagacugguuauggaccucugagaggagauggaugagagaaugguuuauaaacucagccucuugcaucucccagagccacagucccagccucggccauuccugcuacaaggacaagcucccaaccaacgccuuggaaacccauuucccucccugcaggccuggggaggggggcucaaggucugugggcaugaaaaccccuaaaaaaaucauucucagugugcagaauggccagacaaggucucgguaacucagaaaaucgucgucucuucucuuucucucgcuucccaggagagagagugggaagggagaaucaaguuccugaugccuugcugggcucccagaucgacagcaccuucugcccgccucgcaacaggcagcagcuauagugcuccugacacauaccugggcuagcagaccuggccacugccccgcagucagcagagcucaucagccuugucugccaccgaccaaggaccagugacuguccucucaggguugggauuaagucgcaaaggguuugagagauuggggaugacaaaagggacuuggagacuaauuaggagcagcaaugaaagcuuaauucauaaaagcaaacauuuuccauccaucaaccugcaaccaguuaagggcaccguuugaaagaaaucuguguguggggaagggagccaacaggaacaggaaauguuugaaagaauguaaacuauuucaguuucauaaaaaguaacaaguaaacaguuauuacaugcaaauaauguccugguuuuaauuaaugcugaaaagucaaaauauggcugacauuuguauguauacaucgaacggcuggaaaggaaaaaauggugcccagaugccuguuucagagcggggcuggcagcucagagggaacuagaaccuugagaagguccuguuuauuggugaugaaaagcacgguucugcuucagccacuucagccugcuguggaguuggggagcagagggaacccagcuuacuucuuaacaaagcuagaggcgggccuggugcuugggaagggcgacucccacuucagccacuucucguaggcaggcuggucuuaaagggccaguggacccucaggccuccguuccacaggggcaggguuuccaggacuuucccauccaggaguuaagugaugauggguuucaggucccagaagccucccauucaacagccccccacccccgucccgccuuccuucugcugcucaaggucggucagacaggcaggguggcacacccgccuugacucuggggcaggagauggcagccuucgagcugugcuuuccaacauucagcugcguuagcuuccguucuagaccaccuagggcucaaaggcgcugggaaacugggucugggagaccacagcuggagagacagccucagagugugggggauauucugcccccuauggagagaguggcuggggugcuugggccccacagaucagggacuuguccugcaaccgccuugcugaaagaccuauaagcucccuuuuugagcuuguuaauccaccaucuccugccagcauuuuuugugagaccaggugugcuuaaccgggaaagaggggguggcaugaacgguuucaggaguugguaaacccuagaaacugggagaaaauugucuuuuucuggcaagagaccauaacuuuccucaccuccucaaagcgaucuguaauauccuacaggauuacaaauugcuguuuuuagacagagcugcaucuggagaccuguuuuucgggauucuaaggccccucuuucaaccuccuucccugcugccccugccauugccaaugcugaaauggcgaggccucccuuccacuuaccucgcccacugcggcccacgaagcgaaggucguugaaccuggccaccugguucuucaugacggccgaggcauugcgcagcucagcggaguaguucucgucauugccugccaucacagucaccaccguaccauccggcacgucccccaaugccaccaccugaagacacggggcggggggaugcagggggacagcuuagaaaggaagagggugaccagggaaaggaggggaggggcugggcugggcagcucccccaggucccaggcacacugaguauuucuccaaugcaggguggagaagaggcuuaaaaacaauaaagaccuucccccaaauaucacgaaaacaagaagauggaaucucgagcuuccacaccaaaauccuagaucaacugcuuacauaaacugugucccaagaaaucauccuuucaaugaaaucuaagccagagcugugaaucagcucagucacuaugauguggggugcaguuccccuguugucuucggcugcagcgaaagaggaaucaacaugcuccuagcaacgaagucuccaaaugagaaagaguaacaacaauaauaacaacagggcugcuacccccacucaauuuaugcaagagcuguuuagggcaugaaauuuggcccugaaauguggaccaggcccaguuuauuggccucugcagagccuaaauucguuaugcagagaaaaugcagaaugcaaaacucacugguguuuugaaaaaggccaccagaaaaccccuuuaaagugagaguggggcuuuugauaauggaaggaugcaccugccgggaauugcaggauggggguggcgaugucccccuaaacaccaucucccccaaaucccccacccccaggagcacggagaggcggaugccuuuugaaaaagaaucagacuuuaaacagagucacaacuauuuaaacguggccgccgcgugcagggacuggggauccauaugguaaaaauuucaaggagaaaauguuugggaucugauuaagaagaccagauuuccugucaacauccugucuucuuuuaauuucaaagacuccuuuuaagcuccaagugacaguaaaaccuccgaucugacgauuaaagucacacgggccucccgccccucccggcgagauuucccccacugguauuuuaagaugucacccgggagaccucaaagagccacucuuccuuuuuuucccauuuagagucgucuuaaugggagcagggacggccucagcuuccagccaccucgggcagcaccacccccagccgccggcccuuccugcccugcccuuuucucacggcagcugugagagguuuaggggaaaaccgaggcguuuucguuucaucucgcugcccccuuaaaaaaaugaaaaugaaacagucgccuacucccuggcauaaagaaaaagguccucuaaauggcugggggcugccaggguuaggggucccccaaucucaacucgccauucgggacgcauaauauccccgagcaaacgucuggagagcagugccccgaucccggccuagcgccguccgguaaaauuucggaagcccgagggugugagcaggaagcuuuugcgaagcggcgcgggaggaggggugcuggaggcggaggguaggcccuuucaccguucgcaccccacccgcgguguccuugccccugucccgggauccucuucuccguuacccgcagggcuguaucugagcgauccggguuaggggggcgcaaaaccccauccgcccauuuccgcaccaacgucucuacgcaaggcgccccaaaacccagguggagcggggcaaccccguuaaaagucauuccugcagggcgcauccaaaacggaacgccgaggucccggagccgagcgcgcagccagacugaaccgggugcccgggugucgccgcggcgucucgggcaccucccauccccacugcucccgaggcucuggcucccgcagcucagacgcccggagccccagggccggcgcccucccgccccgggucccgcacucaccuugaaggcgacgggcagcgucuuguugcagcgccagugcgagggcagcacggagcagaggaaguuggggcugucggugcgcacgagcucgccugcgugguccgccagcacguccaccaucgagcgcaccucgggccgggcgcgcccuccgggccccacggccgccugcgcgcucagcgcgccgcuguucucgcccaucuugccgccgccgccgccgcaggggaaggccggggagggaggugugaagcggcggcuggugcuugggucuacgggaauacgcauaacagcggccgucagggcgccgggcaggcggagacggcgcggcuucccccgggggcggccggcgcgggcgccuccucggccgccgcugccgcgagaagcgggaaagcagaagcggcggggcccgggccucagggcgcagggggcggcgcccggccacuacucgccagggcccgcccgcugcgaggccucgcuggcccgacggccgcccgcagccugcccggcuagucccgcauccucggcgcgcggccccgcgugcggccgccccucguggcugucccggcugccugggccgcggcggggcccgcgcggggcugugccgcugccgccgccucccgccccgaagcucgcccgcggccgccccgacuccgcggccgcagccccagaacaaauccuccagaaucaaguggcggggccgcggccgcccgcgcgggguuaguacccccggggcccgcggggcggggcuggcggagcgacgcgucgcacagccaaucggcggagcccccaucgcgggcaccucgguggcguucgcggggaggaacggggccugccggaggccgcccaacggggaggggcggaaggcgccaccccgcggaggaggccccagugccacagcccagggcccccgagagcucugggagcccggggcaaaugcuagaaauuugcuuagaacguccgggucccacggaaggcgcccuugccgcccucucucgggucguagcucccugacgcuggggcgcaaccccuucgcuccuccuccccgcuggccgcggccgggcuuccccagcucuugcugcuucgggccugugacuucugcaaccccgggcugggggccgcggggucucagggccggugacgccgcacugggagccgccccaaagagguuacucaccucccucgucccgcacauuauucugacccaagagccuccaccccacacgggauuuugcgcgucguccacgcccggccggcggccuuugcugcucccagcccugcgcggcuuuggucccagccucgguggccccugugccaaaccggggacaggcggaagggagucuccuagggacccuaaguagccuggggccaacaaccccuuuccucucugcucuccccucaaaacaaguuucaggaucuugcaggccucgcggcgucguucuucguuguggcggccuguggcucuuugaaaaacacgacgaggccugcaaaaugcguuuuucuuuuuuuccuuuacgcauguaaccacgguccugcaucgugaaacgguacgcgcgucgguggcaaaagaaaaacagcaguggcugcaaagcuaagggcccucgcuuucagaggagagaauuuucuuucuccaugcggguggaaaguggccucugcggguccaaccccacuucuucuugggcccgugcgcuccggcugcgccgcagggaccgcggacagcuucgccaaggcacugccugcccgcccggcuccggguccccgcucccacucccagccgcguggcccaaccucuccugggcuucacugcaaaucaccccuuccucucccgccuccuaagucugucgagcagaccuaggggccggcuacaguugggagggcaacgggaaagaucaagccacaaucauuccgaauuaucgccccagacaccucccuagacucuggggaacgaacgcgugcugagccuccccgccgcuuuggagacggggcuagauuuucguugccuccggcucucgacaggugcaaaacaaugaauuccaagccucggaagcaaagaagcuuaggauccgacgguggccgcaagaucucaucauggaucugaccccugcucagcgcgcgccauuucgucguugccaaacgaaaucaagccccgcgugcgcuccaggggcgaaggacucuggacucaccccgaccaccgggagagcuggccccuacccaccucgggaccucacagcacgcccucaggccgugucgaaaggaaggacggcaaaggucccuuacugaaccuuuuaagagagccugcgccuggcaguugucgauugcggacccaggcccgcgcgcccucggacgcgcuggcacgagcagcagaacuagaggaaagcgagugauccagccugggcgcucccaccuccgggaacgucuccgagaaggcgcagcgcgucguggccagguagggcccuggccgggggcgggcaacacgugcugcccucgagcagguugcgggaccaugacccgcuguuucagguggugguaaauuccauuugucgaaugguuucgguuugcaccgugcccuuugcuuguuccuccgccugauuucucccucuccgcuuacgauggguucacagacaaguuuccagagaaugagggacucuugugggcccuggcaccuggcgcagggcccggcacggcuccggcucuccguagggcgcuggcuccccgugggcaccagauccaagggaccagggcggcggggggagggggggcgggugcaggcccuuggguccccagaccaaggucgcggggccgccuggcaggcacaguggcgggagccgccgcuaguuggcgcccgcgcccugccagccgcggaggugcgggcccggccgggcuacagaugcgcgccagcugcggccccgggugcaggcgcggcgaccgcccccgaggagcugcccuuuccuugccauccaugcggccaggucucagacaaaccgauggcuuugugucaaaccaaggccgccuuccucaccucugauaagauggacgccuucugucuucgcguuuucaggcacccggggaagacccacagaacaggcuagcuuguucccaauuuccaccugcuuccuccccaucccggaccgacaaaaauugucgucuguuugaugggagggagaacuccgacucccccaccuggggcaugcagacacccucgcccuuccccaguuggcauggaccgucgucuuuucucccucuuccaucagaucgauggacaaacaggccaguuucuccccaguggcccccaccuaagagcacccuaaguuguccacagcagggcuaggaagcagaaggucaggacacuccccuacccuaccuugacuuagagcuggguaaacccagaacccauccccgggcaaauagagccagcuccuuugccccaggaaggggauucgucucccucuggcauuuaggagugcucucuaagugcguucuuggcagugagggugccgccuucccagggcaggugugauucauguggacucuguggcgccugggcagggauccccagguauaccagacaaggggcaggugugcccugggaaaccgccuaagagguccaugggcuauggaaggagcugggguccacagucccucugccugagcgugucuuuuucccucacccacagcgcucuagggaaaguugccuaaaccucucugagccucauuucuuucauuuguaaaguggggcacucauaguggcccuucauagaauuguguguaaagugcuuagcacaggccuggcacauggagggugcuccagccuccgggagccaucacugucaugaaaaaauaagaccucucaauccuugcugggggccuuugacccaccccuccucucucugggccucacacuuccaucugugaaauguccaguucucauauucaaagcuuacuaggacuccaagccaguccaugcuguccugaucccucaauucgcccacaggcugccugggggagguaaggacuggcugugaccuaccuccacguggagucagcucauagcgggguuuccagcaaccaucacagggcggccagagcugggucucgaugauugccugucugaccauuccucucagaaccucacuuucgcccccagccggccgcccuccugugggcagacccuuuccugaguagcaacugggccucagcggacacugccagggaccccguuuccuucccaggaggccucuguuccccauaucccgaaucacacaggagccuaguccagcgaagagagcagaggacucucuucuagaacugaaaauuucucccagccuggcccuaaauccccuguccagagggacccguggugaaaccuaucuccugcccagugcccuagaacucaaaggggacauucaugccccucacugagccucaauuuccucuucugucaauggaggucauucuaaccacuccauuucacgggagggggauuaaggauucccucuaggaggggaggggcaucauugugauugaugaucgauuguuugaagaaacagaaagaaaaugcugcugaguaaacuaggacucaucugcauccugauuucagauaaugaucucugaauauauaagcgagaaauguuaaugaaaaauggcaauauaucuggguugagggguugucuccuguaggccggggguccagcuccagagaguccagcucuggggucaucuauccugggcagccucucuggaaggauucagaaugugugggagcacaaaugugcuucucaaauuacagagaucuuucuuccuuuuuggaaaguuccagacuuggaggggagggagaaggagcaagggagagcaggguggugaggguguuaggacccagaugcugccugugcggucugagacuuuugccugguguccacgcuccccugagccuugguccccgaggguaaaaugggaagaacaguaacagcugggggugcugaggcuuuaccuugugccaggcgccgcacaugggcauugcucaugguauucaauccccacggcgucauaugugguagguguuaugcccauguaagcaaagaggaacguuguccgaggucagccaggcuagagagggccagacccggguuaaaagucugcucugguucaaaauguggggcaugaacgcaucaccuggccaagcaugucagcacucuccuccuaguggcugaguaaugggaagagcuagcaucuagauacagaggaaagagcuauugugauggggagagggagcuggguuugguaaauccugcuaagcagcccugggcuuggaaaucaguaaacucuucaaaucugcagggagucaggaaggacuugccagggucauucgggaggguccugugauagucaaggugcacccaccaccugcucuccuuuggccucagaaccagucugcgaggaggcaggacuggcaguaguccccaguuuacagaugggaacacugaggcccagaaaggggaaagggcgugaucaggaucuggaaugagcuccagcaaggccaggagcaagcaccucgaggcaaaacgcaguuggacaggaccuuugccuugcaggagacugcagcccaguccugggccucauacacuagcacccugaugccacauucagugccucucgcccaggggaagugcuaaucagacguguuucccucugggccucaguguuugcaucugaaugcgggggugcacuuucaaggccccucuacaugccaugcggguuccauaggaccccaggguuugguugugacccgaggccccuccuccccacccaccuccucuccaccucccgcggggcgccagcucccuugcguccacaugaccucggauccuuccacgcccauccccacccuguucugcagguggguggucagagggugcucugcuuugaggaugggagagagaaagggaggcaaggacggagaaaagagacuucuuuugcgggagcgcagagcagaaaaaccgucuccaucgguuaccagggaagggguuucugguuucagaucccaucacuugguggggccuuccuaccacccucccugcuacucgcucuugucaucuguaaaucagggaaauacuucuggaagacaguuaucuggucugugacuuugaucauuggucuaugacuaauaauugcccuaauuuuuugaacaccugccgcaugcugggaguuuuccgccaauugucgcucacccucaggugccucugaagggcagagauuuuauucuuuccauuucacagauggggaaacccaagcuccgaaaguaaagagcuuuuccucugugggccucagaaucugagaaguucaaacagguucucaggagcccuuccagcaccccacuccucgaucagggaggggcugucugcacucugaccgcugcucucagcgcagagcucuccauccaaagcagcaggugcgugcagagcuaccugccagcagagccaucaaacacggacucuucuacugggagccauggaguggugagagagaccugggcagcuuggagccaagggggcuucugggaaacaugugcccuucccccagggugggguucagcucuggcgggcagggagagaaagggcucuucugaguggcuguugcuuuacacacauuuuugcuucacaguauucuuagggaguagcgacaguuaucacucccauuuuacaggaaagaaaacugaggcuuagagagcucaaguaacuuguccaaguuggcaccacugggaaaccacagggguaggauuccaacgaggcagccuggccccagagcccauguugcugcccacuacacucuacucuuguggacuaaaaccagaugcucagaguuacagucauggaauagaauuagaauccuggcagaagaacugugggcaggauucggaauuuuacaaugucagacucgaaagggcucugagauaucaaauccaaauccccauuucucaaaugacagaacugaggccuaggaaggaagagucucacucaaggucacagccagugccagggacagagucugcacccccugccucuccagcuaccucccgcugacuccgcaccuuccucucucgcaggcccuccucuccccacugcccacccagcagcuucugggcccagccaggcccauuagggauuuuccaccuccccaaaaagguccugaugacugucaguccuugugaagccuuaauuaaucucagaggccgauggcucggaggagacugggggcuuuggccuuacgcagaugaagauugcggcucuauuucaugugguggugaaagaacgccucagacauuccugccagcaauaaaagccacauggcuuuccagcaucgcccuuggaaaagaaaaaaaagugcagcccuuugcggaaauaaaucaacuaugugcuguacgcauggcaugagauacaaaugggcauacggaggugggcaacagucggucuuuuaugccgccucugauguccacugacaguggcagggccagcggucauggucccagcugcaauccuggggagagggagugacccccaguguggugggggaagccucagcuucuccaccugaacuggauuugagccacccuagauaucccagaggcagggccggcuuucuggccugugacccaugcagucgcacagggcccuggucucagaaggguccugagcuuguuuuaaugcccugccaccacugccuugaacuucugaauacuugcucaacaaagguccugcguuuucauuuuguacugggccccccaaauuauauagccaguccugaccacaaauccaccccucaucaccaauugucacgucucuccuggccccugccauguacccaaucccggggaguaggguuucuugagugccuacuagccaguuugcuuauaucaccugagaugaacuucagaaugacuuugugaauugggcagauguggaaaauugaggcucagagaggcuuccauauggcaaggaagccuagacuugaacucaggucucccugacuccaaagugagugcucuuagcagcucuacauucugcauuauuucaucuucaccaugcccagggggauggggauacacacaguuaggcugcucuauucccagauaacagaaggcauaacugaggccagagaagugaagguucucaagucagugucaaaccgagggccugggcaacaguggaccugggccuggauccauagggcuggggauggagucucaguuuuauaguuguuugugccacuuguaaauuuauuagcucuuuccaugcaggucacugccuugagucuggucuggaauguggcuggagcccuacccugucccccucccccacagcucuccauucuaaacaucuggaaguccuuccuugugucuucuuccacucuuucacgcugcaguuuuccucugccacccucacugguugggaagcaguuggaucuggcaccuugauaaacucaaaagaguccaaauucuugaugaaaguuggggcugaacagagcccauagauugccauguccuauaaccaggccugggccuaaggcucauagagccaacugcuagauccagggcagccauuuccuuguuccuugcuggguaaccuugagcaagucccuucccucucuggcccucagacuccccuucagggagauaaaugcauuggaccacaccugagccccaggaggccucucugucuucaacauucuagaauuccauauuaaucuacaacaggucuguucauuuccgcaucuaauagcuggggaaaccgaggcccaggaaggaucagagauuugcccaccgucacagaaggugcuuauugacaaguggacuugacucugaggcuccugucagcuggcccgguugccucugcacaaacuuucggaggaucuggccucagcaucagcucagcuugcccuugucccgccgccuuuagcccagguggucugucaggcacccucaguguccaggccuggaaaucacagcuaagaguccuuggcaggcaauaaaguuccucuucuauggcuugaaugucucccaaaagucauacauuaaaacuucacccccauugugaugguauuaagaggcaguggggggccuuucgggaagugauuaaguggugaaggcucugcccucaugaauggauuaggcccucuuugcccuucugacuucaggacacaauguucuguguccuccggaggacacagccagaagacacugccuuggaaacagggaguccaggaccucaccagaugcggaaccugccagagccuugaucuuggacuucccagucuccagaaccauguguaguaaguuucuauuucucuauuuauaaauuaucccgucucagguauuuuguuacagcgacacagagugaacuaagacacucucuuuagacaaaagugggccaggggauggcagcaacccuuuucuccccaaucgcauuugggcugugucaguguuuccguaauaaaggccccuuuuccagggguuauaauuuggcuggaaaaugaggaggaaagaccagacuccaggacuggaggggcacaugaaguaggaggcuaggaugggaaaagucuccacuggacccugggcacgcagagugcacacacacacgcacacacaucuauacccuacaugugugcacucacacacagcacccacgcucaugggcacagucucucacacauucacuggcagcucacacccacauggacaagcccucauggaggacagcauuguuacagugcagccacaggugcaaacaguuaagugcaggugugugcaaagaugcuccuaggagaugccucugucugcaucaucaugcauggaccuauugguauagaugcgcagauagaugcacagauaggccccauuauaugagugguguggacacacacaugggcagaaacccacaucacagcuguguaaacagcagaccauuguguggacaaaucuuuacacacagaggcaggcauggaaucagggcucagagcuuuggauuuguucuacagagcagcucugggaggagucgaacccuggcucuggaaguuucugcuucuccucaauucagaggcauggacuuucugggugguuugccccccuggggcuuccaaaccauuccccagcaucugaguuuaacccgcucccucauuguucgauggggacaaggagagccugucuuccugguccagagaaaggcagugggaggggagaagugggaggguugcagcuagggugccccacggcagcauggguggaagggcagggcacuagccuaggggcccagagaccugaguuuggguuuagguugagaugcccuaggccaacacauggccucucugggcuucauccugagcccccucuguuagggccaugugacacccccaggggccucagcauggggaagagcacugaaaccaugucacaugaugaacuauuaaagcaacuggagacuuugcccuggaggagagcaggcuugggggguaagagcuccucuggcagaucuaugaagagcucccagguggcagggaccauauggaugcugggggcuccauaccaggaauagaaauauugagagcuggcuuggaauagggacacguccccucagagguagagaucaaguugagaccaggauauugugcagggaguucgaguguuagauggggcaggggccggaccagauacuagugucucaaacgcucagcucauagcaaacacguauugaacaaaugagagagcgacugcagagcuccauuucugagccaaucauccgugauucagagcauaccagcucuggguucccaccuugccaucugcaugaccuuggcccucuccaaaccucaguuuccucaucuaugaaauggggagaacaaauuauuuccaagagcuccagcaagucacauccccuauuguuggucuuucaggucaucccagaauuucugcucuuauaaauagaaaaugacauugaaggugaaaagcagacagacaagcaagagaauaguuaauacaaaaaucauagcuaggcgugguaacuugugucuguaaucucagcuacuuggaagggugagguggggggaucuacuugaggccuagaguucaagacuagccugggcaacaaagugagacucuguaucuaccaaaaaaaaaaaaaaaaaucaggagagugguccccaccacuugccaccugugaugaguagggagagggaugcagucagggaagggacacuggugggagcccuaaggucccauuagugcuuuguuuuuuaaagccaggugguagguagauagaugucugcuuuauucuucuucuuuaaacaauacuuauauuuuauacauucuucuguacauguauuuuacauguuuaaaaauauuuuaaaggaaagcaaaagauaaaauauagaaaaaguuccccugccccaaaccucugaaaaaauggacaauaugcucaaaugugcauaauaucguacaauuauucaugaugcagcaaagcugcacuguuucauccggaugguccuguguaccaucacacucucaguugaaucucugcaggcccuugcagcuguccucaucauggcaacccccaccuagguaagcacuucuagguaacagccccugcugagcacgcuccccaagcacuccucauggccgaccaguagcccuucagguaugugucagugggcccacuuuacaggcaaggaagucccuugcaccuacauaggaaggggcagagcugggauuugaaccagcucugucaaugccaaaguugugcagcaaccucacccgaggagccaggccccuugauuauaguaacuagcguuauguacacucacacaugcuguugaauccccggagccacuuuuguauuagguacauuuaucaucauccccauuguaacaguaggacaacggaggcauagcaaggucaggaacguguucaaguucacacccuaggugaguaucagagcugagccuugaaccucagcagccugaucccagauuguguuuccuggccuggcuguguggggagcucagacuucauggaaacaaaagacagaacgguggcuccaggguccacagcggaucccaagggaccagaggccagcagggggguuggcugggguuggaggaugcugccuaggagaucugcucccagagugaugcuagcccugugugaugaccugaguccccgccuccuuacagggucauggcugcuggggaggugcugaggcuguggguacagccaaacggagcuagagcaggcuuuggacucccugccuggcaaguccaggugacaggcucagacacugggcacucugucauuugcuguuggcauaaguuuccacuggcaggaaugugacauuuaucaccugagugggcuuccagaagcccacugaauguccucagaccugggguggggggcccucucacugccucaccucugagccuuaaucaaauccaggguggcuggaugaucugaaggcccuuuuagcucacggaggccugggcuugccccugcccccauccguguccucaggggaaaagguucccaguccugcccuuagcagcucugagcuuagaugagggggggagaugagauggaaaggaaaaggagaaguaagaaacagacagaggaaaaggaguuggcacuagauugaagcagucaacacacacuuauuaggcaccuagggcuauuuuaggugcuggggauacaagcaauggaccagaaagccauggagcuccuugggggcuuugauuccagcagggcagacagaagacagacaaggaggcaaauaaauaagcacgccaauauuugauagugucuugggacacucaagaaaacagauggggguaaagucagagagagugacuggguggauggggagagaggggcucuuggcaauacuuuagacaggguggucagggaaggucugucggagcaggugacaugcgagcugagaccagaggguugagagggacccaggaagggagaagggggcugguaggagggcccacugcacaguggaacuggcuuuacccaccugccuucuccccacuccucugcacugcuaguauccccaguuccuaaaacucuuacugcccuuucucucuguugcuucucccacaacagcccugagagccagauggggugagccuaaguagccugaccugcagugcaggaaacugaggcuagaguggggagggucagcaucagcggugcccuaaugccaggaccugacccgggcucccgccucccagccuggugcuccucggagccugcccauugccuggcauguuauucaaccaccccaguccaggcaggcugcagccacuguggagccagcccgugggcaccgcuccugagaggucacaggcuggaaaugugggcagcuggguagggucuaggagggggcagcggcucaggacugggcggggguccggagcggaaggcgcccagcccugauuggaacaagguggcagcaccgggagccgagccgggugucauugaucuugcccgguguuccagccaccaggcgggaccagcgccgggcagacugccgguuuucccagguguggggacacccugagggaaugacuuuucaugugguuguggggcaggcaugccacccagcacgugggggaggccagggcuuugggagcaugcuggcagcaggguggaggggggugucuggagacucagaaucccacagccagcaaaugugaggcuccuggagacagggucauggacuugaggcucugagacccugaggauguuagaaucuucaucgcaguagcucccacugauggugugcucacggugccaggcacgguucugagaacucacacagcuuaacucuucauccuugcuccauccuaagaggggguucugugaucauccccacuuacaguuggggaaacugaggcucggcaagguuaaguagccugccaaacacacagcuaccagguuuuugucuuaggaaauaagagcccuggaacaguuggccagugcggagaggacccccgaagaucucugaggcuaguccccuugugucggaaaaacaggucuggagaggggaugugacgugcuggggcccaggggaguccaaagucaggacucauucuucccccaggucaucgugggaccuccgcuggucccugaaugucaggcccccugagggcaggguccucagccaggaccuaggcucccagauguuaccaaccuuaacugacaguuuucugcuagcacacaggaaguucuuuugaacaucuaaccugaaucccucguuugcagggaaagccucuuccuucucaucuugcaguacucuaagaagaguuuggccuuugauguuagggaagaucaccaguucccugguguugugggaggugagacugugccccucucugccauaaaauaucucuuuacuguccaucgcugggccuaaacauuagcgacuuagcccuuggggccuuacagaguuucuuauuaaaaugugaguacuccuggaaugggugucagcuuagcaggacagggugguacuucaggggcagggcuugggggccguugaggggcaggagagagcugauucuccccuucuagccaggcuugauggggucuacaugaccugccacccuccaccucucugaccucaucugcuuccacucugccccucccucacccugcuccagccacccugccuucaaauaugcccaucauacucccaccacagggccuuugucugugcugcccuuuaccuggaaaacccuucccauucugucugccuggcucagcuacccacuucauucaggucccugcugccuccuccaagaggccuucucuggucuccugugguaggcagaauaauggccacagagauguccacauccuaauccccaaaccuguggcuauguuaccuuauauggcaaaagggacuucgcagaugugaugaaggauaaagacuuucagaugggagauuauccuggauuccccaggugggccccauaugaucacaaggauccucacacauggaauagggaggcagaaaaggacagucggagggagaugggguguggaaacugauuagggaaccugagagauggcagcgugggaaaaacauggcucaaagcugugggcuuugaagguggaggaaggggcuaugagccauggaaagcagacagccuuuaggagcuggacaagacaaggaaacaaauucuccaccagagccuccagcaaggaacacagcccugcccugaccuugaucuuggccaagggagacucauagagaauuucugaucccuggaacuguaagauuauaaaugcauguuuuuuuuaaggcacuaaaaguggguuaauuuaugauggcaggcauaggaaacgaauaugucucccuuccuugauugacaguuccucagcacauuuauuagugccugauacacaauagcuugacuuaugaauugucucuuuucucucacagaaggucagcugcaggagggcagggauuuuuugcuugcuugguguuacauucgcagauagaguugucacauuuaacaaauggaaauauaaaacacccaguuaaauugaauuucagauaaauaaugaacuccuuuuuaguauaaaguugccccaaauauugcaauuauuuaucguuuaucugaaauuaaaauaauuuaggagucuuguauuuuaucuggcgaauucauccccaacacauaaaaccauuccuggguauguauuaggaucucaauaaaugucuguugaaugagugaaauagauaagcaaaugaauucacauuaacuucuagcuuaaaaacccucuuuggcucccagaaugccuacaggguaaaguguaaaucauagcaaaugauaaaagcagacaguuucauagccgcuucaauaugccagacccgggcugagugcuuuacacuuauuaacucacucgguucuugcaauaacccaaugaggugguuagcccauuuuccagaugaggaaacugaggcccaggaggcuuaguaacuuguucaaagucacauaaccauugagcagcagagccaggcaauuccaggccuuugaaaacuuggcucauggaauguucuaauguuaucucccuacccauuccccugaacacuguggauccucucucucuaacagcccccgguuccuuuucaggguaugugcuuccgcauucucugacugcugaacuccuccucauacaucaaagcccuguccuacuuuucucucuuugugagaccaucucuaaaacucccaggaggacuuggcccccucucuuuccccuccccaccauggccccuugucugaaugcguuguaaggacuugcuauuguguccuuuacguucccugacugugaccucccugagaacggagaugggccccuuucagcucuuuggcauggggcuucaaacugagucuggcuuuagggggguucccagaagcauuugagaaugaaugaaugaaugaaugaaugagugagugaaugaauggcugagugaaugaacgaaugcuguuuguuuccacucugggccucaguuucagagucuauaaaaggggaagaacaauccugaaccgccccccauuccuuaaaacaaaacacauuuuuuucugauuauaaaaauaauacacauucauuaaagaaaaauuggaaaauaauaaaauuaugaagaagaaaauuaaaaccauccauaauccugccacccagaacaaugguucccacuggguguucagccuucugcucuucuuacuguauguauagauuuauuaucuucuucucuuccccgcccucccucccuucucuccuuccuuuuuuuuuugaguguugggaacauacaguaugggguccuuuaaaccugcuuuugaaaucccccaacauguguguauguguguucuccuguuuucuuaaagccucccugauggcaggggacaaguggcugcuagacaagccugguaggggccaggguguggaaagcccauucccccccuacucauggaccaccauaguucccuugugaugggcuguuuaggggguuuccagauuucugucagggaacacccugcguggaugucuuagcugcaucccugguuccuuccuuaggacagauucugggacugggguugcugagaccaguauagacacugagaggcuccggacaccgccccacauccuccccacagcugcucuccagccccacucccacuggcagccuggacuucucagcuuggcagaaagccgggggcaguauuccaccuccuccagagaaaagccuugucuacacccaaggccucacugauuccauccaacgcugaaaauacccauuuacucagcuauuucuccacguuauggucuaaggcccagaugcuuaguuccaaccaaaauagccacagaggucacuguggucugaggguccucuggaccucaggccuguguagacaucauacuugguaauaauuaacccacggagcucaccacgugccagacccucugcgucucuguguguccucacgguaacccugaagcuagggauggcugucucccaucuuacaggugagaacacugagggugcuccagagagcugugggcccuaggccuugucaccugggggugcaaaggcgcugccccaguaguccggcugccugcuaccuggcugccugcuacccaauggggcaaagucccagcacuaccccgaaacaaggacaagcuuuggccuagaagcugggcagccagguccugugccuguuuuuucuccauaugugcccugggcagcucacccucuccgucugugaaaugggagagcagggagucagagacagccuccuaggccuguggcggcucugagcacagugggugcagauacucagugcugagucaaagagagagagaacccugccagaugggccagcucaccacaagcagccaagcccggucuuugagggguuggagugggcaggccuuugaccaaggcugagcuaggagggaccugacggccccagauggaggcuggcccacccugccccagcagaugggaggcuauuuuuuaaccccacaggaagaagaggacagaaaugauugcaggggguuaaccuaggccccuggggacgcucccuguuugcauccuccuuuccccacaacccagagagcuaugugggcuucaccuggaguucccugaauccuucuggagcuccccgcagaucacagccggagcuggcagggccugaguggccccugucugccaggcgagggacccagagcccagagaaguuugaccaggacuggcuuccucugcccucucugcugugugcuuccaccaggugaggcugccuccuccgcuucuaccuuucuuccuggggugaccuggggaggccccaccuucucccgggccaguuuccccaucugucagacaaugggacccuccagacaucacugaggcuucucccagcugggaaaccuccuucugagcuggggcccugacucugucacaucaguccuggauuccuggaggccucagcccuccagaagcauccacccaguggacaggagcucguggcaggugucuggggacccccaggaagaggaaggauuuccuggccagagauaagaagagcagcguggguagggguuaagcauccucccccugcagccucccucagaccacgccaccagguggcccuugguccccccaaaaggaguuccugaaaagucugugucuguugcagcaggugcggccugugaaguguguguaugcuugugugagggugguguguguucacaugcacauggugggggugggcacacaaggcgggaggccuaacaugguggcagggacagacuuugguugcugagcugggacagccugugacagaggccccagcacacccgcaggucuuaccagaaacccucagauggugcuggucugaccugaaggugggcacaugcagggaagggguacaugcaggacaggggugcaugugggggagggccauguacagggcaggggugcauguggaggagggguacaugcaggaugggugcaugucggggagggucaugugcaggacggggugcauguggggggugcgugcaagacagaggugcaugggagagaaggguuuguacauggcaggggugcauugggggugcaugcagggcaggugugcaugugggggaggggcauauccaggacaaggguacauguggggaggccacagggcucaaaugcugucagggccucugggaagcugggaccccagugaaugcuugaggggagccaacucugccugaccuccucuuaugauugucuauuuaaacaauacuguaaauuaaucacauuaaucgaacccaccucccugccuccugcugcuugccccugugauacaaauaauaugagcacaaugaaaaaucuuggaaaauacagaaaacacauaaaaaauguuaaagccugaagucuuauaaccacagugaacacugcgagugucuuugaggggaugggggucugcaggucuucuugauacaaucacauucauucccacauacuggagcauuucccacgggcggcuguggagcugagcacuucagguuugucuuagugaauucucuaacagccugagagggagguacuguuauucuccccauuguauggcugaagaaacagcaaaaaggagguuaaauaucccccucaggguguaagaagcagagccaagauuugaauccaagucuggcuaaauggaaagugcaaaucguccagcguccagggcugcacuccagccaugccccgccccccgugagcagaccacucauuuauucauuccuccaggagcauuuacugagcaccuccugugacucagacccugcccagcacccacaccaaggacuuggcggaugugaacgagacagagagaggccccaaccugacuccccaagcggccacaaacugagucccaaccuugaccacagcuugauuucuaguccaaguugucacugacccccacuggccuucaucacugacugaacugugaccuggccuccugcacucugcaguggccucugugagcuuuucauuccccgugaugugugugaaagccaaggccagcagcccaccucacccagccuaucauccacgcggccugggccagggaggccgucaggagcccacccaccaccucuggccugccacucugggccaggccucucuggagcggggguuuggccuuggcccuuggcacccugcuuggcagaagggugggccuuggcucagagcauggggccaccccaggaggggucagcauagcugagcucaggguaccugugggcggggcuuccaugucccaggguccucacacugcagccuccucuuuuugccugggcccuggaaccccaggagaccccaggagccguugcucccuccucucacuugcagaaacucaacagggcagcucaucugagcucccccgaugccugcacuguauuucuggggguccugcaugucucuccaauccucaggcagggccaguuaccuacuuuauaggacccagugcaaaaagaaaauacaggaccccuuuucaaaaugcaggaacaaaaguuuuuccuuucuucuguggacucucaacccacggugguguuuuuuauuugcuguucaaugucacacguacuuggaccuggggagacuugugcagaaagugcagacccucacagaugcucaggggccaccccaaaacuuggugugcagauuccaaccccuuucuccuccccaugccugccucaguggagggcggcagugcagguagugggcugcugagaacccaucccuggaggcagcaggaggcagacuggacccgggccccaaguccccaggcaugcugcacuagcccaucaggcuucauuuacaacacacuaauucagagcgaaaaugauccagcauuucaauauggcaacugcugagcguuaaauucaagcacaggaggugggggggccagguagcccuggaacauagcagucucacagguggcugggcgugggguggaucucuguucuuggaguagagggauguggaguaccucccucugcuuggaguaucugggguaccuggacaagcacagggggccaugaacagggccaugccugugugccugccccucgcucagaagagggcaccugacgggaauaccagggcauaucugcaccaugcccgggcaguaggccugggcaugacccuggaucaggcagaccuguaguagguggaagggccccaggagagcugaggagccuaggggagaggaacccagaggucccugccaaagugcuugaugugcugccguaagaagggcagcauaggccgggcgugguggcucacgccuguaauccuagcaccuugggaggcugagguggguggaucacgaggucaggagauugagacccuccuggauaacauggggaaacccugucucuacuaaaaauacaaaaauuagccgguugugguggugcgugccuguaaucccagcuacucggaaggcugagguagaagaauugcuugaaccagggaguuggagguugcagugagccaagaucaugccacugcacuccagucuggcaacagagagagacuccaucucaaaaaaaaaaaaaaaaaaauaaggcagcaugggugccugcugagagagagagaaagaagcucuuucccugcauguguugccaugggauucuggcccagcucccuggggugcucucugagcucagcuuuggcccugucccucucucucugugccucaauuucucuaacuaugcacugagcaaggagaagaccaccacaccucaaguaccuucugcaugggccauacacugaguuuuaugaaucuccccucucuuguuccacaaaugauuacuggcccauuucucagacgaggaaacugaagcccagaggaggcaaugacucacccaguaagaaggugguggagcugguucugccuggcuucccuucaccccuugagucgcuccagccucucuagguuuggguggaggacgugggaaccaagcucgugggggcaccaccagcucuugccagaaauggggccaagagaagaccaaggaugcuccuugaccugaggaaacguccauuaauucauagcuacugugcuuuggcgagccacgcaggcucuggaugcaggcugccugggugggugaccugagcagaugccuuaaucucucugggguucaguuuucucaucuguaaaauaggccucauaagagcuuuugucuuauaggguugugaggauuaaaugagcuaagguauaucacuugagccugggaggcagagacuuuagugagcaagauuaugccacugcacuccagccuggaagacagagccagaaccugucucaaauacauauauaaacaaaaugagcaaagguauggaaaacacuuagacaguggcugacauagaguuaagagcuauguaaauguuuacugcuaauggaacuauuuaaaaguugagucauaauuuauauuuucuagacugucaauuacgaauugauucauuucaauguugugcuuuucccuuuuguauuuaggauccagcaaauuuuccuuugaaaucucaauacaauuuccuagguccuugagaagauaauuuccccgcccccacagugcuuauagcccaugguggauccaauagcucucucuagagcagcuuuuccaaaaguggacuuugcacacaccagccccuuccagaugcaucaucucaccccaagagauaacucaauaaacaguugagcauacacuauuuuagaucuccauggcccaacaagguagccauuagcauaucaaagacucugacaaguccugcagcaaaacaccauugaacauuguuugaaacaaccaaucccaaucuuguuugaccacagaguuccauuauuucugcucaacagcugauaacaucugaacacacguugggagaugccacccucauuuccugcuuucuaggaaauggcaaggggagucagagcugugaggaacacccucucgcagggaugaguggcuccaccucuacagaaaucaucuccagucaugugcaccaucgcuaggccauuccuccuguucucaccuuccuugucugauucagcccccacagcggccuggagaggucacuagcaucaaugucuccaucauacagaugaggaaauugagguucacaaagguuaagugggcacauagccaguaaguggcagauccgguagacaaacccacagcuucugauucuaaaccccacauucguucuucuguauguugacuggaaaaguaaaaauagauccuauucuaacaggaucaaucuucccccaucauaggcuuuuaaaaaacucagguauuuuuuuuuuccgguagcauugaaugcuuuaaaaacuuaaaauuuuuacuaucuuucuuuugauuacuaaagcaguacgugcuuguuauguauaaaacuuuucaaacauuuugaguugaaaaaugaaaaaaaggcagggcgcgguggcucaagccugcaaucccaucacuuugggaggcugaggcgggcggaucacgaggucaggagaucgagaccauccuggcuaacacagugaaaccccgucucuacuaaaaauacaaaaauuagccaggcguaguggcgggcaccuguagucccagcuacucgagaggcugaggcaggagaauggcgugaacccaggaggcggagcuugcagugagugcgauugcgccacugcacgccagccugggcgacagagccagacuccgucugaaaaaaaaaaaaaaaagaaaagaaaagaaaagaaaaaugaaaaaaaaaaaaaaacagaucugcauagcccuacaaaguagccauuagcuuuuaaaugaaaauacuuaaaugcuaucuaaaugaaaauaguuaaaaugaaauaagauaaaaaauucaguuccucaguuacaguagccacguuucaagcgcucgggauucacgugccccugguggcuacuguguugggcagcacagacaugggacauuacuaucaucacagagaauccuacgggacggugccguucuagauucuucuuagacauauccuaacaccuauacagguugauuaucccuaauucaaaaaucuaaaaucugaaaugcuccaaaauccaaaacuuuuuuagggccaacaugguacucaaaggaaaugcucauuggagaauuuuggauuuuggacugaaguauaauccaacuauuccgaaaucugacaaaaucagaaguccuaaauuugaaugcuucuggucccagccaucuuggguaagggauguucaaccuguaaugacuguuaaugugugguuuuuuuuuuuggagaccaggucuugcucugucgcccaagcuagagugcaguggcacgaucauaguucacugcagccuucaccucuugagcucaaguuauccuccugccucagccucccaaaguguugggauuacaggcgggagccgccaugccccagccuauugauauucuuguugagguucucagacauaucugcauggccucacacauggaggaaagagacccacagaggcaaaaacaagacaugggguaaaaauagacuggaaggaaacacaccgaaugauagugguuuuuucuggguguugagauuaccgagcuuauuuuuaaauuucuuagauccuucagguguucuacaacguaaaaugcagacaggguggggacguugguuggagucauguuuucccuaauguucuuacugguucuaaaaucuucaagcuaugcucucacccaaggcuucacuuauuauuauuuuaacacuguggauucauaaagaauggaagcccacacaaguccagggaaggaaggaaaggcagacagaggcuuauuuucaggccugggcaguugcacagggucccuugcuuagaagggccucaugcuugguuucguguucuguggucgcuguccugaaauucuuacugauuuuugaacaagggauccuguauuuucauuuugcacugugcccugaaaaucaugccgccgucacuagcccugggauucuccccaggacagguuucccuucagcugcucuaagccuucgcccuuguccuuguccaaccacggacguggccauccacggagcccucuacgugccucagagcaagugugcuucggcugcucaggugugugucuagagacugauaaaaacagggcucgugagugggugcgggaggccccuguggucucuguucacacacguaccuacccucaaggccaugucuacacuggccuauuucagagaaccgcccugugcaucaugggaugcuuugccccacaucacggcccagcuugguucaguccuggagcccuguguccugaagccaugaccaaccccaggccuggcccaccuucuuccucagucuccucucccucaagcccuccacaggacccauaaaccuuccaucuccauguaauccuuuugugugauccuucuuccauaccuuugcccaugcuguucacucugcuuguaccagcaagguuccuuccuccccagaucugcccuuucuagacccaucucagauuccacccuuucuagaaagacuucaggaaguauuugagaagggccugaagaugcugugguugcauagaggaggauaugaaucaccucgcuuagagguaucggggagggcuccauggagguggugcccucaggccaaggaagagaagauaucuuccgggcagaagggagaguuugacgggcugguuugaugucagacagaccacaggaugacucaagguccucuuuccucuucuuaaacauuaguugcagcaagucccaccaucugccugagucuguuuucaucuccacaauggagguggugaugcccagcacacggagcugugaugaggauuuaauggggaauccagagcauuuauggaagugccaggaggccaagauucugcauagguaggaaggaccuaagccagagggguguggguggccagaggagagagccuaccuuaguagggcuugguaggcuaaggucugggcugaaucucgaggcucuggagcuuagaacagcaucugcaacucccuggcugucgggguucaggcaaggacugccuccucucugagugucaguuuccccaucuauaaauggaaagcugggacacugaaaaacacugggggggagggugguuccugaggcagucucucuccacacaucacaggaauguggcgccccagggagaaggcaucuuuguccauuguguucacuucugcaucuccagugcccagaacagugcuugcaugcaguagaugcucaauaaauguucauugaaugaaucagcagcaaccaauucgcccaccucacauccuaaguccgcuggggacguaggcccaccucuccagggaaacugucugcagauugggaccacaccucaggucacaagcauuuccugagcaccuacuguaugcauggcucugcgcagcccggggcagacccuugcuccacagcccgacagggcagagccaaggaggcaggugacagacacagugauuugggaagaagaacagagagcaggguggccagcagggccuugccugggugggagcaggccguucccaggcuggagcucaggcugaugggagccccagcuugccuguuccugggagggugggacugccucuuccucuuucuuucucugaaaacaaaaauuguuuucccuuaaauuuacaaguauuaaaaguuuggaaaauacacaauaaucaaaagaauauaaaauaaagguuaccugccaucauggcggaccacacaguauuaacuacuauggacuuuucaguguuucccucuagucuuuuuucugagguggcuuugcucucagagguggcuuucucucccccugggaagggauauagcugcucuguaggagaugugggggcaccaggcucucuccaugggcucuuuaucacuucugacuuggagguccuuucuccacccccccuggaccuagcaccucuucccgagacacaggggugcgaagagcugggggagguacgucagcaggccuccccuccugccccugcuuaccccacggagguggggugggacagaacucaggcuugaggaaggagcacuggaggccaagccacaggugcugguccucagcccuggugcccaggcaaguuggguuugggaauaggggcaugaccaaaauggaccccuccuuuccuccccaccccuuuccacuccauccgccuuucccuuugcguucuccaagcguuccgucccccagaugcccucuguuuccucugcuccagccuuuuaacuccucucaacaaaggccaaggaaucaggcagacuguggacacucaggugugcaugaugggaagggaccugcauuuacaaaagcucccccccacagggacugcaugugcugguggaaucucagucaccaugucccacguugaaggauguuuggagggggcugacuuuggucacccuucaaaucauaaguuauaugcgucugcccuuuccgcccacacguaagucugaaccuuuugccaaaaacacuuuucccagacucgaaagaaaaccccaaagaggaaccuaaaccuucacgcugccugcaccgauuggaccggagugcucaggcucgcgccaacaaguguuucaaagaagaagccagacagugaagggggaagugagggagaagcuggaaaacucucaggcugaccaaucgucagcccauucauucguucauccauccauccauccauccauccauccauccauccauccauccauucuuucuuucuuuccucuauccauucagugagaagggcugaauaucaccugugagccugccccugcucccaagaacacccuuuggacaccuguggggugaguagugaggggcagcaauggcagagcacccccaccgccuggaggggagaaagggaagggcugggaaggcuccccaagggggcggccaugaagcugggccuugagaagacaggccaggguuucucaccuuccacauccugcuuagagucagacagaaggcuuuugcagaggaggaggaacauuaaauaguaguaauuucuggcauuccaugagggcuugucugugccgggcccugugcugugcacgugauacacacuaccucauuaaaccuacccaacaugccuugagggggugcuauucauuuucuccauuuuacagguaagaaaaugaaacacagagaggugaggcaccucucccaacgccacacagcgaggaaguggcagagccuggcugcagcugaggcuuauagccgcauuuuacauugcuuucucuccgaagagugccuuccuuuaucccugggagccauugacaaggggucugacagucccucuagucuugugccugcucagcccucucuagcccugaaaaaaccagggcuuggcgcuggagaaagagcaggagggugagauguggaaacaucuguugaguggcaggggaucacgcuggcgcagaggggcccgagccgaucaggaggccggccugugccaggccagugcucccuguguaccaggugccacaugcggggcucaggguagggccacaguugcuccucccaaccacccuuugaggucaguguuacuagcccauuuuacagaggaggaaacugagaccuuaagaggugaauuaacaugucaggucacccagcuaccaugcaguuuaagccuagauuguucugacuccuaaacugugugcaaggcggaugauuggaccccagggaggcaaggaaagucaguuuuccugcugcugaauucaauguuuuacaagaccacacaccucuuuagaccucaguuucgucauguaugaaaugaggaggggaacucucugccuccgggcucugauaugcuccuggacugauucacuguuccuuguucuugugacuucucaaagcaagaccagagucccacucccagcccuaggcccgagauucccauccccacuguguccaggggcuucaggaggugcuauuuuagggcagauggcaaaggccugggcuguagauccacugagggcuaaaggcaaucuuucuucccuccaccccucccuuccuuccuuccuucucuuuacuuccacuaagcaagguagggaacuacucgcugagucucagggcaggcccacggacugaagcucaggaggacagggcuccccaguggcugcaggugucccagcacugacuccuagcagaggggguguuuggguucagucuggaagauugggugagauuccccaacuacggggggugggggcacacucuggguggcagauuugaggaagagucugcagauaaggcauccccaggagauggcaauaagagcugguguuggggcugccccacugaacccagagcccaggccuguuuccccacccauggaggaguccggacuggcucaguggcaaggccggggucagaggcugccacucuccuccugccucucacagcccgcuggaaggucagguuuucaggcucugcuuauccgucucccggccuccucccuccagguaaccgagggagccuccgcuuugaugcggccaccuccaggcccaggcgucaaugagcccucuauaugaccaguggggcugcugggggccuccagcccgccagagugggugcggugaggccuggacacacagucccgcuguguggggucggcucaugccugccuagacccugugggcaguggggggcuccuaggaaugcuuuuccagccuggggggcacuuuggacaggcaggguggucuggggagacgggugugugcagggcagccucagaagccgccaucaaagggaccuagcagacguggcgccaggcaagcgccauagugggcacggaagggcuggcggucagucuguuccucucccagggauggcggggagggggaggccccauggacacaugugcucagggugaccagccaucagggguugccugggaugaagggguuuccugggacguggagcuuucagugcuaaaacagagaguccccuguuauuggaacuuccuggaccuucggaaaggauacagugacugaccucucuggucugggcagccuccucccuguccggugaccucugagucagaccaucucggccagaccugcccagggccauuuuguccacccccugccuccacacaggccugccucauacccaagaguccacuuuccauuucucccaggcaucuucaggggaggagcugccggccaacuccaaccacugcuagggggaccucggccagacccacaccacgcucccagcccucccuguggcucccgagccagcucauacuuuccugcuuccacaccuuugcccaggacguuccuucugccuggaacauccuuucccugucuuuguuaccucuuuacccuuagggacccaguuuccaagucacuccuccagaggacuuguucucucuuucccaaggcugggcuaguaccccucuuugaacucacagcccugguucuucucccaaaaaaccuuugucacgccccagggcaauuuucuguugacccaucuuuuucuacaccagauggugagcucuuaggauggagauccugacccaguuucccccgggcucccaguacaaggccaugcucaugguguucaucaaauggaaaaugcuuauugagcaacuacucugugccaggcaucaugcuccuuuaauucucuccauagcucugcaagguugguguaaccccuacagaugaggaaaccagagacagagaagugaaguaacucaugcaggugacggcagagggcagagucaggacuugaaccuggagagccuggcucuaaagcccaagcuggaaucucgauacucuacaccucgauaaguuuuugggaaaugacugacuaaacagaugaacgcguuugcccccccgccgccccagagcccccuuaaagccuacauguggcaguuugggcccauuuccuuggcuucccucccuggaggggcacccacugccagugucccuggugaguguuugccuguggggguacaagugaggguucagcaaaggugaccuggugugaggggggggugccccagggggugcagaggagggccucaugaggcagauucagaaugaagguucuggcccccaguggaaccgugcaugggcaagggguccucagggccauuggcccauaauugucagacggggaaacugaggcccagagagaggaagggacuuguccuuaguuacacagagugucuggaucacagcucuuaggucucagcuuccccauuugucacacagggagaauaaaucccccuuguccugccuggggguagaccccagggggccccugugcccucucacaccuuccauuccagcuucuagaauuccaccauccaugcaccagcccugaggguaggcguugcccucuucucaccuccugcucacgccucuacugcaggaugggaaccaaaugccucuccacccuuuucccacaccccuucucuccacagugaacugaggggaguuucugaucccuuagcucaaagucagagaaacugagaggggagggcugggugggagccgugggaaugucaugcacaagcagucggacucuccaggggucuggaucucucccuugcugccuugaaggccccugcacaggcuguggcacuggcugaguacaggugccugaaggcagaggcauggaugggaugcuucauucucagccuguuuuugccagugaagacaaaagggaagucaucuuccguuggucuauggggacccugagguaguaggagcucggugauaauucuagggaccacccuggguugucaggugggggagacagagaagcccacauaggaggcaccaaaugcaacucacucgugcccuuuuacucaugagagaacacggauccagagaugucaagugacucagacacagucucacagcacacaggcggcagaggcagguaggggacugggcuucccuggcagcaguccccaagccugccugagaggcacaucagaaucgcuuuaggggauuugcaaaaccacaccugcccaggcccaaacccuagagauucugauuccgcagucugagguaggaauggagaauccuccacagccugagguaggaacugggaauccaguguuuaaaacucucuaggggcggugauuucagaaaaccugcuggcuccaucacacuuugcucagggacugagaugggauggcauuuggaagacacagguaggaggaagaggaggcaguggggggcacagggagacccuuccccuucugguaaaagccuguggacgagagaacagcccgaguaagauucugagaacccgagacccggauggaccuggaguuuuugucuugcguauaauuuagggggucugugacacugggcuggagauaaccgugucuuuccuuucccuggccucuagcugaaauuuagcaucauauuccauggcgauuuuccaccaguggaaaucacagguguucucugguaucacagcggggucagggaugaccugaaauauuguucaugcucaucacaacugcauggcccaccgcggggucuugucacucagugaguucuugaagaggcacagacaaauggaguucaacaaauggaaaacgugagucaauaugucaccagcuugcuuucugaguuugacaaugguauuuccaucgauuucuuuuccuuuguaauccuuuggauuuugucuuacgcguuuaaaaacgcaacuccgaggaggaaccugaagguucccugagacugccaagggucgguggguuagggacccuguagggggcagcgugggguuggcacccugcaaaugggacccuggggcugcgucucuuugaggaaggaauuggcagcuggagcccuguaagccuccagggaugggauuugggagacaggcccccauggcgagcacgucgugagcagaaaugaacaggagagagaaggcugaagaggggagacaggucuccacaaaaguggagggaaggcccucgggccacagaccccagauccaaacaucuccacagacccuagccuaugaggcgccuucugugccacugcuggccaggaucagcccgcucugcccagcggccuccugucucugggcgcauacaugacauguugggccaaagccaccucucccuuugugcccuuugugcuacugccagccaccucccaggcuccgaggaucaggacccagcccaggccgaccggggcucuagcccugucucccaagguuccuuuguuuuaaacccuacauuucuccaucuugcgcacggaaggagaaauacagauuacaaagacccggcaaauggauuuuauaaacucuuauuuucuugccacagaacugccuuuaauuagcuccgaggacuacaaagggaacaacguuauaauagcagcaacuccaaggaagcagccacagcucucagcucucagaccuggggcugccgcucaucaucagcuacagcuagguuugaugggagugcccccauuucaggggacagcaggcccccuucacuccccgacucaguccccaucugcagcagcacagccuuccuuggccucaccagggaagaagaacaggccccgcucucagacaagccuucccagaagccugaggacucaaacacccaaaugugucugggucccugccccgagccggccacccaggcagcagcccugaaucacucggucagccagcggcagggcaggccaaugggcuggaggguaggcaggcaggcagacccaccucugcaucucugcugacugccucggcugaggaaaggcagcaccagcccccaacccugaaguucuagaucucaugcagccucucuguucuggaaccauccagaggcacugcccuuauacaugguccacccccaggcucagacaaugagaauuccacaagcagaggggacucuauuuggggcacagagagguuaaguaacuccccuccuaaggucucucagcaaggaagccacugagccgugggacuugagcucagggacucuugauccccagucucaggugucacagccccaucugggcuccugcuagggaggaggaaggcagcagggggugucugaggccagggugcaucagcccuaaaugccagacagaggcaggagaagucuccccaugagucccagccccauuagaggcuccaggucggggaucccagacccccuauccuugcugggagacacaacccagaacucugcaucccugcagccaccaaaaaaggcaaaagcugcccagaaacacuuucuccucuuccguggccaaauccacgaacuuucucgaggucugucccccugccccgugcagguccagcuucagugcagcccagcucugugcaguuuuccacaaaagccuguggcuuccuucuccucccucugcuucugauaccccaggaguuacacacaaaauguuggcgguggucuccaggaagaccccugcaucccacagcucuccccagaaguugccagcagugaccuccugagcccagguggggagucccaggcaggacaggggcuggggcugcaggcccuggggcccuguuagugaagcagcaagccgagggucccugagaguuucccuuggccccucugagggcugcccuuugaggucuugaggucuuggaguauccaucgcccccacggcuuacuguccccaccagcggaggaugaaagugccacagcgauguuccacgccaagagaccacagagaccaccaaccccucuucccaccucaggcuuucagaggccagcggauuuaggcggacaggcugugcgcuugagggcagccagggcggucaguggagggacgugguccggggccuggccacagcuccccacccagggcccugggcuauuguuacucaccgcggaugaaggucggcgaguaggucgggaaggagucgaagaugcuguucgaugccaugccccgcucugaagaaggcgagaauuuucagcccuucaggggguuggguugggauucacuugguuggcuguuguuuuauuuuuuuuuccucuagcuacuuuugaaaauaaaagggggggguguugcuuuuuguuguuuuuuguuuuguuuuugucucuuuuuuccccccugcugcuacgaaaaagaaaaaaggaaagaacgcgagagugugugugagugagagagagaaaaaaauccccaaggaaaguaaguuucuguuuguacccaagaauuuggauucccggucccacaggaaugucuagccacaaauucucaacagaagcguaugcagaguguaucauuagauggcgggaaggggcuuucggcagccaggguggaggagcuccgaagcugacagagcagagugggccgccuccagugccacggggaaugaaugaau

SEQ ID NO: 191423 - RNA, 33041 nt, Homo sapiens
ccuagucccagcccagggggccgcucucgccggcgucgagggcguggcggcgaggcugcugcugcaggcggcucccggcucugccuucggccccgcccgccgcccaccaggcucccagaggccccgcagcucgcgccguccggcuccccgcagccccgucgggcagcccgggcccguccgcugcccucccggcucccguccugcggcggcggggcgugcaggugaggccccacggcgcccggccucuccagcagguuugcacccagcgcggggcggggcggggcggggcgggugggggggguggugcaugaaaaguuaaaaaaaaaaaaaaaaaaaaaaaagccgccccgagaaguccgggaggggugggcacuccgagccgcgggaccgggagaugcuaccgcgcgcgaccucgccucccgcgaccucgccucccgccgcacccuucucgcgcgcggggucuagucuggcagccucgaggguggugucccggaaaacaaaacaaaaauguuuugucuucuccaccaacgauuuucucccaccaaguguguuugaccuuuugaaaagccgacaggcccagccugccugugaaggcaggagcgguguaggggcgccuggaagguggaagcccccugucuuucucccuugccccgcuucccccacggugcguggaucaccaucgcauuagugacucccuaacuucuugaaacuugucugucugcuucuguccgccgccuggacagguagggcaggagugaucuguuccagguugauucuucuagcuuccgugcaaaaucugaucaucuccuuuagagauuaggauucuaguguaggaagcaauccagauccguguuucagauacaaacaaggauuauuuaaagugauguuuuccuguagugcugaaagccaaaaauauucgcuuccacuuguuggaagccaccaaguacaccacauuuauuugaacuuuucauagaagucucugauguacuauuuggcaaaagaagcaauugauuuaucuguagcugugauuacauacgauguaaaguaauuuguuuuaagacuauuucauuggcuuugguucaauaucuuaaacucuguaaacacauaauucaggagccagauaugcaucacacaaauguguucuuuuugguggggauuuaaauugaucuagaaaugggcuuuccauccaggaagacugugaaaagcuugaaaacugagucucuucuuuagccaggucaucagcuuuacauuuuacugcauuggcaagccuugccuuuucuuuucucuucucuucucuuuucuucuuuuugagacaaggccucgcucugucauccagcugaagugcaguggugcaaacacagcucacugcagccucaacuucccaggaucaagcgauccucccaccucucagcguccugaguagcugggacuacagaugccggcuaauuuuuuguagagauugggugucacuauguugcccaggcuguucuugaacuccugggcucaagccauccgcccaccucugccucccaaagugcugagauuacaggcaugagccaccgcacccagccaaaccuuuucucucuuagccugaaaacagauuucagugcuuuucuaggaaacaagauuuuuccugcuguugaaauauaacguuuguaaagguuucaaacaugugaacauuagguaacagacaagagcagauuuuauaugguguuagaguuguugguugaaggacuuaaagcaugaaaaauagugugacgcggaaauccauuagccugaagccugugaaauaauggaagcucuaaaguucaacaccguuuguuacuuagaaaaaaaacacagaagguggaggucggacagcaaucuccacuuuuccccuagaauguagagguucuauccagggaaaagaaauuauacacagcacaacaaauagcaucagucuuauauaucucaacuucaguuauucuuuaaaaccuguuguuuucauauguuuuguaggcugguuuuuguuguuuauuucuaucugucucuugcugacaaauuccugguggaguggaacuucaauuauaacaggaccaauucuagguuaucugugaaaacaagacaugggucauugaaacauacaaaauacaaaaaucaaauuuucacccguuuuacuuuacugucgcacgaaauuuuucuuacacacagcuacuaaaaaauaguacaguucuaccuguaagugguaaaugaguagagaauagaagguagggcuucgugauagccguucagaacuucgcauugacgauccuaaguggcuuuuuguuguugcuuuguuuuuuuuuuucucuuuuuucuuuuuuuuuuuuuuuuuuuuucuuuuuuuugagaucuccuucuguugcccaggcuggagugcaguggugcaaacacagcucacugcagccuuggccucccaggcucaaguauuccucccaccacagccuucugaguagcugggacuacaggcgugcaccauguguuuuuuuguagagacgggguuuuuccauguugcccgggcuggucucgaacucuggagcucuggcagcccgccugccuccgccucccaaagugcugggauuacaggcaugagccaccacaccaguccaaguguuuuguuuuguuuaacuuaguugaaauuuuuaauuuagaaauuuaaaaaaggaacuuaguagcccaaagcaccuauguuuauuuuauauauuuuauacacuuuauguauuuuaucuuguucauuuuauaaauacagaaaaaccaagggauuuuucccaagguuauacagcaggacacuuguagagcugauaauggagcacuuguuugcuuccaguauuguuugguagcauuuuuaacauacaaaaaaagugaaaaguacaucuagcuaagauacugaaauguucaccaaguugggaagccuauuaauuugaaaaauuauuauuauuuuaauccuggaggagaaagaauuugcguuuuccugaucagaacagaaaaugcaagauccaugccaugugcuugacauuuugccuugauagaugacuuuugucacaggccuguuguggcagagcagauggucaugcuacuuggaguuuuuccacucauuugauauuuccaugaagaaacaauuugccagaagccagccguaguuagaguugugcuggagaugacgggaaaccuggauuagcacagacuuuugcuuacaggagcuggaggauaucgguucagcccuuucugcugggccagucaagaguucccuggauugguaaacugaggaacaguuuagucuugugauaguuggaguggagcuauaauuauaccacugcacucuagcccgcaugacagagacccugucucuaaaaaaggaaaaagaaagaaauauagauaucuugggacaaacgacaaauaauuugacaauaaucuaaagaaaaauugaaggaaaauagcuaagacauuauuaggauaacugauaaaauuugaauccagauuaugcauuugacaaauuauguauuagauaauaguauuauaucaauguuaaauuuccuguuuuugauaauuauccuauggguuauauaagaaaaugaucuuguucuuauacacugaaguauuuggaaguaaaagggguaugcuccaucuuucaauggcucaggaaaaugcaugucuauaaaaauagagaaagauaaagcagauggucaaaacagaaggaauuggugacucuggguaaaggauacagcauacccgaguuccuugugcuauucuuauaacuucuguuugaaguuauaucaaaaaaaaaaaaaagguacucaaaauugaagguagaaaacaggaaaugaaggugugauauucuaagaauuuuuuuuuuuuuaagucaggugaaggauuauuuccuguguucuguuuuuuaaaaucuuuuuacggguuagacgagggaacuugaaacaaacaaaucuuaucaagaauagguugacuuucucaaauuucaaaaucuagucagccagagcuccccaacuuaccagccuccaaaaacccgggcacaguauuuucucuaccucuuuuuaauggguugggaauaggauagaaacauuagugccucuaagagauaagauacaaagacagcccaccuuuagagauacuaaaaguuaaauugcacuugguuuuaucauuucccugccuaaaaacccacaauggcaugcugauauugacaugguuuuugugucaaaacucuguaacccuacuugcuuggcaaccuggcccauaccugccuuuccgacugucucaugccacccccaccaaacaccuugcacccuagccaugccagaucacgugaccuuugugcaugcugguccuacugucuuccugccuuuguucauguccugcuggcuuuguguggaaugcuccccauucuuuuccuccugaaauucuguucauccuugaagucucaccauugccuccuugggaagcuaucucuaaucccaugcagaauucaauuuaccuuugucugugcugacauaucagugggguaacuaaaauacuaccugcuguuauucagccucccuuauuaagcauacacugugagcgggaaacuaugccagggccugggguuucacagauacagucuuguagcuaggagugauuuguaaacaaauaaucacaauguaaguguauaacagaaaaaugaaccaagcacuguaagagcuaaguccaccugacaacuuugucuugaagaaaagauuaaugaaagccacagugagauacacugucacucccugccccgcuuccgcagggccccuuuccagauuggagauuucuggcacgauaaaugaguaaguuaaaaacaguuguuguaccugugggccacccagauagauauauucaauagaaagugaaaaauacggcuaggcgugguggcggcucacgccugcaauuugggaggccaagacggggggaucaccugacgucaggaguuugagaccagccugaccaacaugaugaaaccccaucucugcuaaaaauacaaaaaguuagcuaggugugugauggcaugugccuguagucccagcuacucgggaggcugaggcaggagaaucgcuugaacccuggaggcagagguugccagugagccgagauugcgccagugagccgagaucgcgccacugcgccgagacugcgccacugcaccccagccuggacaagagugaaacuccgucucaaaaaaaaaagaaagaaaaagugaaaaauacaagacuagaacucaggauugagagugagucuugguauauaaauuugaauguacccauauggaugacugauuuucaggguauguaggcaggaaagaccaacagguagaucacaggcucuuggggacaugguacuuuuccaaacuacccauccucuuuauugcucaagguucugcucuggcuucccucccaacuuuggugacauucauccugucuuaaggucguugcacgaaaugagagccaguauugacacaggugugugugaaccacagggaggcaggaacuuaguugagaaccucuggugauuaggcagcuaaauacuccaguguggauaaagucacgcaggagagaaagaugaaaaaaggaugaggauguggagaaagaggcaguaaaaaagauagagcuggugaggaagaagggccaggaagaggcaagacccagaaggcagggacacagggaggucuaagaaugaauggaauaggcagccaggucaugugcuacagagauaggcugagaccugacacuggguuucaacuacaggcuuguucggggauaucgcggguuucguuacagauaauuguaauaaagccggucacacgaauuuugguuucccagugcauauaaaagucuuguuuacacuauacuauagucuauuaagugugcaauagcauaugucuuaaaaaaauuuauagaccuucauuuaaaaaauacuuuguugcuaaaaaauacuaaugaucgguuggugugguggcucacaccuauagucccaguacuuuaggaggcugaggcgaguggaucacuugaacccaugaguuugagaccagccugggcaacauggcaaaaccccaucucuacaaagaauacaaaaauuaaccggacaugguggugugugcuuguaguuccagcuacuugggaggcugagguggggggaucaccugagcaugggaaggucaaggcuacagugaacaugaucacgccacugcacuagagucugggcaacagagugagaccccaccccaucucaaaaaauaaugcaaacgauuaagucguaaucuuuuuguugguggaagaucuugccuugagguugauggcugcugacugaucaggguggugaugcuguaguuuggggugacuguggcaauuauuaaaauaagacaacagcauuucacgaaagauuucucuguaguaugugaugcuguuugauagcauuuuaccuacaguagaaguucuuucaaaauugcagccaauccucuaaacccugccauugcuuuaucaacuaaguuuauggaauauuguaaauccuuuguugucauuucaacaauguuuacaguaucuuccccaggaguagauuuuaucucaagagaccacccucuuugcucauucacaggaagccaacucccuuccauucagguuuuguuugagauugcaggaauucagucacaucuuuaggcuccgcuucuaauucuaguucucuugguauuuccaccacaucugcaguuauuuucuccacugaugucuugaacaccucagagucauccaugaggguugaaaccaacuucuucccaacuuguugauguugcgauuuugaccuccucccauaaaucacgaauguucuggauggcaucuagaaugaugacuucuuuccagaaaguuuuccauuuacuuugcccagaucuaucugaggaauugcuaucucuggcagcuguauacuuacgaaauguauuucuuaaaauaguaagacuugaaagucaaaguuacuccuugauccaugggcugcagaauggauauuguguuagcaggcaugaaaagaacauucaucucccuguauauuucugucagagcuccugggugaccaagcgaauugucaacgagaacaauguuuugaaagggaucucucuuuuuuucuuagcaguaggucucaagaaugggcuuaaaacguacaguaaaccaugcuauaaacagaugugcggucauccaggcugaauuguuccguucauagagcacaggcagaguagauuuagcacaauucuuaagggccauaggauuuuuagaauggugaaugagcauuggcuuuaacuuaaagucaccagcuauguuagccgcuaacaaaagagucagccuguccuucgaagcuuugaagccaggcauugacuucuagcuaugaaaguccuagaugcaucuucuuccaauagaaggcuacuuagucuauauugaaaaucuguugaguguagccaccuucaucaaugaccuuagcuagaucuucuggauaacuugcugcagcuuccauaucagcacuugcugcuucgccuugcacuucuauguuauagagacaguuccuuuccuucagccucauaaaccaaccuccacuagcuucagacuuuucuucuucagcuuccucagcucucucauccuucauagaagugaagagaguuagggccuugcucuggauuagacuuugguuuaagggaauguuguggcugguuugaucuucuaucuagaccaaucagacuuuucguaucagcgauaagucuguuuuugccuuuuuagcauuuguguguucacuggaguaccacuuuuaauuuccuuugggaacuuuuccuuugcauucacaacuugacugauuggugcaagagacuuagcuuuuggccucuggggacguaucuuccucagcaggcuuaaucacugcuggcuuuugauuuaaagugagagacucaggaugcuuccuuucacuugaacacuuagaagccauugaagguuuauuaauuggccuaauuucaauauugucgugucucagagaguagggagcccgaggagagggagagagucggggaaauggccucacucaguaaagcaguuagaacaccuacaacaaauauuaagaacacccauggccgggcgugguggcucacgcuuguaaucccagcucuuugggaggccgaggugggcagaucacaaggucaagagauugaggccauccuggccaacauggugaaacccugucuauacuaaaaauacaaaaaauuagcugggcaugguggcguguaccuguagucccagcuacucgggaggcugaggcaggagaaucgcuugaacccgggaggcggaggcugcagugagccaagauagcaccacugcacuccagccugggcgacaaagcaagacuccgucucagaaacaaaacaaaacaaaacaaaaaaacaaaacauccacagcauguauugguuaaggacacccacaacauguauucauugauuaagaacacccacgacguguauucauugauuaagaacacccacgacguguauucguugauuaagaacacccauguguauuggugaagaacacccacaacacguauugauuaggcacacccacaacacgugucgguuaggaacacccacaacauguauugauuaagucugccaucuuauaugggugcaguucauggugccccaaaacaauuacaaugguaacaucaaagaucacugaucacagaucaccauaacagauaaaacaauagugaaaaaauuugaaauauugugagaauuaccagaacaugucagacaugaagugagcacaucccguuugaaagcgguacugauagacuugcucagugcaggguugugacaagccuucacuuuggaaaaaaugcagugcagugugauaaagugacgcaugauaaaaugugggaugccuguugggaagccguugccauccaugaggaggacagcugcagccaaaagguaguguggaggccaaacugcaccuaauucaggagugacuagagcagagggagcacggcaagaagagaucacauuucccagaagcugguaggaaggugaaggagaauuagggggagcaugaggggaggguagaauccagaugguagggcucgcaggaacacauguuugcugaggaagaggaacaaguggagaaggagaaauugaaaguacagcugacacuuugggaggccgaggcgggcggauaacuuaaggucaggaguucgagaccagccuggccaacaugugaaacccugucucuacuaaaaauacaaaaauuacccgggcaugguagcacaugccuguagucccagcuacuuggggggcugaggcaggagaauggcuugaaccugggagacgaagguugcagugagccaagaucguacuacugcacuccagccugggcaacaggauaaaauucugucucaaaaaaaaaaaaaauuaaguacagcugacagcugauggaacgagguucuuuaggagauugggugcuuagcauuguugaagaggagaaaugcuggcuuugcugggagugccuugaggguaggaaccauguuuucuucacuccccaacaccaagcaguaggcacucagaaaauguauauacaaaugaguaaagauuuuacuucuuagaaguagucuugauugauauuguagaauaccaaaaaaccucacuauuuuuauuccauaauuaccauucuguauuauacuguguguaagcaauguauuugugaccuucuguucuuugaaauaaaagggaaaaaucacaaaucaggugguauugagguaguaaucauaaucacuuaguuugucugugccugcuacguauuuauuaaauucugccuccgcaucuugaaaugugucauguccaaggcucucugcuuggugcaugugaugugcacuucauuggaagaggcagacaugcauagaaacagccuaugagagacagauucuguccuguuauuccacccagggacacugucagcuccagacauuugccuuaaaauugguuauuuuuuaaaguuuggaaaaagggaccaggcgcgguggcucacaccuguaaucccagcgcuuuaggaggccgaguugggcggaucaccaggucaggagaucgagaccauccuggcuaacacagugaaaccccaucucuacuaaaaauacaaaaaauuagcugagcguggugucgggcgccuguagucccagcuaccugggaggcugaggcaggagaauggugugaacccgggaggcggagcuugcagugagccgagauugugccacugcacuccagccugggugacagagcgagacucugucucaaaaaaaaguucagaaaaaggacaccuuuuuaauuuucuuuaauuuuuuguaggggcaaggucucacuauguugucaggcuggucuugaacgccugagcugaagugauccuuugaucacugccucagccucccaaagugcugggauuggccagaugugguggcucacacccauaaucccagcacuuuaggagacugaggugugcagaucaccugagguuaggaguuggagaccagccuggccaacauggugaaaucccaucucuaccaaaaaaauauaaaaaguuagccgggcauggugguacacgccuguaguggaggcugaggcaugaaaaucgcuugaacccgggaggcggagguugcagugagccgggaucgcgccacugcacuccagccugggcaacacaacacgacuccaucucaaaaacaaaagugcugggauuauaggcaugagccaccguaccuggcccucuuuuugauuuucuguguuaaauuuugccuaccgcaaauauuucuaacauuaacaaagacugaauuuauagacagcuuuugauucuguguaacuuaauucuuucaaguguauucaaaaagaacaaauugguuaggagagguagagucagcucaucacagaccauauuucaggguacagauggugagagaauuaguguggguuguauuuggcugugccaguuacaguguuguagauggaaaaccccaaacaaauauguggaggcucuucugguucacauuuuucuuucuacugcuuauaaacuagaauacauauugauaugaucucauuuuauauuacccuuuuuucccuagguucacuagaaaacguuuugccuuuuuuucuuaauaaaucauugccagugaaauauguuacauaaaauaugcuaagcaaaucaaauuagcguaucuagaauucacuuacgaggacuguaaugcauugauuuaaauauugauucaucguucuaaauaaaauugcuucauuugaugaauugcagccuggagacauugauugauuggaacauuauuuggucuucggaguuuuaccucugcauuuucuuuuuuuuuaacagugggugccugauagacauccuaggacuauacagaaggaaaaggcccacuuugggggauaaugcugagggacacuaugaaaucuuggaaugauagccagucagaucuguguagcacugaccaagaagaggaagaagagaugauuuuuggugaaaaugaagaugauuuggaugagaugauggauuuaagugaucugccuaccucacuuuuugcuugcagcguccaugaagcaguguuugaggcacgagagcagaagguaggcaucuauccucccuuucccuacauuuguagcauguuaaauguguauggauuuggggaaacagagcuugacuggucccugacaaauuaaguauagaaaguguauguccacuuuuaggccgggcgcauuggcucacaccuguaaucccagcacuuugggaggcugaggugggcagaucaccugaggucaggaguucaagacgagcuugggcaacauauagaaacccugucucuacuaaaaaugcaaaaacuagccgggugugguggugcgcgccuguaaucccagcuacucgcagggcugaggcaggagaaucacuugaacuugggaggcagagguugcaaagagcugagaacaugccacugcacuuaagccugggggacagagugagacucugucucaaaaaaaaaaaaaagaaaguguauguccacuuuuagauguugccgcagaauuuuuauuguauuuuuagaagaguuucagucugcagcaguuaggaaauguuucaaaaccaguucuucuccauagacacuuuaagaagcacuggcauuuagugaacucugagucaagucuuauucaauccauucacuuauuuauucacuuauucauuuucggagacuacaauuaaagaaaaccuggggaucuuuagccgggcuuccuauuacuugggagugcauucacaaaagaaggaauucagcuuuuuccuggggcugauuuacauaaaaccuauuaggacuauuuaugauuuugucguaacaaaauuguucacguuucuuguauuaguuucuauaacuggggaaaaugauugagcuuauuauuuuaaagauuccuuuaguucauuuauuauuuaccuagaaagagaggugugugugugugugugugugugugugugugugugugcuuuguuuuguuuuuccccgucaugaccucacaaaaggcuauaggucuuagucccacaaaaguaaaauagcucugccacugggaugugucuuccuuguucugagcuuuuucucaaaacccuaucacuggcccuuuaguuuucagccgauguacccaaaauauuucccuuccgaugacuuucuuggagcagaacuucaauaccguuuaacucaggacauacuugagugccuacggugugccaggcgcuggugccaguugcuucaggggauagagugugagucaugcagcuucugccucaugguguccagcccugcagcagaaucaaggccaggcagcagggaugacaagcaauuauguuaucaaauggaaucuuagugccuuuagaaacacuugaaaguggccgggcgugguggcucaugcuuguagucccaguacuuugggaggccaaggcaggcagaucacgaggucaggaguuccagaccagccugaccaacauggugaaaccccguuucuacuaaaaauacaaaaauuagcugggcgugguggcaggugccuguaaucccagcuacucaggaggcugagacaggagaaucgcuugaaccugggaggcagagguugcagugagcggagauugcgccagcguacuccagccugggcaacagagcgagacucagucucaagaaaaaaaaaagaaagaaagaaacacuugaaagaacagggccaggcgcaguggcucucgccuguaaucccagcauuuugggaggcuguggcgggcagaucacuugagcccaggguuucaugaccagccugggcaauauagcgagaccccaucuccauaaaauaaaauaauaauaauaauuuaaauagugcguugagguaagaaaggaggaaggaucacagccaguuggaauaaaagaucucacagggagguggcauuggagaagggcugugagagcuggguaggauuuuagcagggaagggaaagggaauuuuggccacggggaacagaaugagaaaagagcugaaucgggagagugugggccauuucgggaguagcaagccauucugugugcuuagcacauagcugauauuuggccagagucaggagaaaucggacuagaagagugaguaugcggccacccagcaaaaucucaugaacaucuagcucaggagcuuguccuuuugugggaaacggucggaggguuucugagcacagagcggccaucagagcuccacgucaggaagcucagcccacagcacguggauggcagagugaugggagaagagggcagagcagggagccagggagcucucggauugcacccgccuggagaugacccaccccaagcggagcagggaagggggcugcacucgccaacuuugugucuuucaggguuguuucauuuacaaaugcuauuugcuuucccaaguucagucauaauuuagacauuuugaaaucauccuuuugaguuucaugcuaagagcucuaaguuuuuauguuauaaauaaguuaaccuuguuguuuauuguuguaaaaaaccagaugaauugccaauuuauguuaaaauuauauauguaggaauucucucaagaaacgucacaaucuuuucuauuuuuuuguuuuuuuuuguuuuuuuuuuguuuguuuguuuguuuuggugagauggaguccuucucugccucccaggcuggaaggcuggagugcaauggcgcagucucggcucacugcaaccuccgccucccagguucaagcaauucuccugccucagcuuccugaguagcugggauuacaggcacaugccacaaugcccggcuaauuuuuuuguauuuuuaguagagaugggguuucaccacauuggccaggcuggucuugaucuccugaccucaagugaucugcccaccuuggccucccaaagugcugguauuacaggcgugagccaccguauccggccaaucuuuucuauuucaaccuuuucuuuuuaacuguagccugggaaauuuuuaaccugcaaaaaggguggguccuuguuggguuucauuuuuuaaaccauuuggggauuauaucuaacguaaauuuauacuggaaaucaucccagcagaaauucuaauaacagcaguucagcggacuuccuaguaaauuguauuuaauacccuuaacaguaauaucugaaaugacaaaauauaaaauguuuauauuaugguuaucuauagaucaucaguuggauauaaaauauggacagaaucaaggccagauaugauggcucaugcuuguaaucccagcacuuugggaggccaaggcaagaggaucgcuugagaccaggaguuugagaccagccugggcaacagagugagaccucguuucuauuaaagaaacauuuuuuaagauaugggcagaaucaaauguuuccuuuacauuuuucuucuaucagugucuuauuuuguuguaguuucuccugaaaucagcuguuuauucagguuaucuaugaaugugcaaaaaauaaaacaguugcuuuuguuggauuacaggcagaauaaucccgauugcaauuaaacacuuuaauuucaaaaaauaauuucuggcugggcacauuggcucacacccauagucccagcacuuugggaggccgaggcagguggauugcuugaacccaggaguucgagaccagccuggccaacauagcaagaccccaucucuauaaaaaaauuuuuuuuucccagcuugaaaaaguuuuugucuuuauaagcuucuaacuauuggaguaagcuuuuacauucuuccgaauaguagaauaaauaacacaggugccauuaucauguaaauguaaucuuugcucuagaucauuagauuuuggcucuauguuuuuaucaauauuucuuaaaaauaguguuggagggauaauaaaucauagaaaaauaaacuguaagaaaaauagguggagaaaaggacuuaucuuucaauguauauuucucagcuauaggguuguuaauuuuaugcauguacucugcuaaucaauagcuccaucaggagugcgacaggcuuagugcuucauuuuucuuugacagauuuggauuugucccaaugugauuguauuugcuuguuugcugucuuuaaccccaguuuuuuuuuuucucugucuuuuaaaaaagcaacagggucuugcucugucacccaggcuggaaugugguggcaugaucauaggucacugcagccuugaccuccugggcucaagcaauccuccuaccucagccucucgaguagcugggacuauaggcaugcaccagcacauccagcuaauuuauuauuuauuuauuuauuuauuuauuuuggagauggagucucacucugucacccaggcuggagugcaguggugcagucucagcucagugcaaccucugccucccggguucaagcaauccucccaccucagccucccaaguagcuaggauuacaggcauccaccaccaugcucggcuaauuuuuuuguauuuuuaguaaagacaggguuucacccuguuggccaggcugguaucaaacuccugaccucagaugaucugccugccuugaccucccaaaaugcugggacuacaggugcaugccacuacaaccagcuaauuuuuguauuuuuaguagagauagaguuucgccauguuggccaagcuggucucaaacucucgacuucaagugaucugcccaucucagccucccaaagugcuguuauuacaggcgugagccacugugccuggccugauguuuuuuuuuuuuuuuuuuaagagacaaggucuugcuauguugcccagacuggucucaaacuccugggcucaagcgauccuccuaccucugccucucaaagugcugggauuauaggugugauccaccaugccugaccccuccagaagcaaauuaaucuugcuucugguuugaacaugaggaguuuucaaaauauaauuuagguuuuuauaacaugagaaaugggacuguuuuuuucugccuuaggucuugguguuugaggggacucaguaaauguuaguguuagcagucuucucagcaggacauccuguacaaagaaaugcaguagaaucuaguccccuugcaaaguacugcccuuuguauauaaaacuguuuaucugaccuccucaccauaggacauuugauuuguguuucugauuauggugguugagggauauuaagacaucacuacuuguucugcuguccugcucugugaugggugacacugagcaucucauugaguucccagugcaaagcaacaccuguuaaauguuuguugaaugaauggauucuguaagaugguuguugaggcuuagugaugcaaugcuaugaucgagaaacagaauugugagcugagugaggcaaaauaguacguaggagauuuaaucugaaauuaugcucccagauacacuggccuaaauucuuuuguggcuuguauaaucauaugcacaauuuaaaucuuccuuucaagcuuugauucuguaccuuccauuuaaagaaguaucaaaaauauuauuuaagaaaaguaaaugauauuuggaagcugagugaagugaucuuaugauuuuuagacuaaaucaauuguuuguacauucuagcauagccuucagcccagaaaaaguagaauccuuuaaggaaagugauguuuuaaauuugggaauuaaaaaagaggauucaaaggaagaauaucucuguuauaguuaacuguguuuuuaacagagcaugaaacauccuaagguuucacuaaguguuuguuuaauugguuuuauagugcuguucuggccaagaauuaguaauuuaguuagcuuugaggcucaauuaaauacuagagaaucauaguuuagaauuaagaaauccuagucaagucuguauuuuauacaguggguuuagaguuauagacauugcuacaaaacguuguugaaagaaauuuaaagaaggcacaaauaaaggggaagacauccguaucuauggacuggaaaacuuaauaacauuaagaugucaguacauacaccguggaauacuaugcagccauaaaaaaugaugaguucauguccuuuguagggacauagaugaaacuggaaaccaucauucucagcaaacuaucgcaaggacaaaaaaccaaacacugcauguucucacucauaggugggaauugaacaaugagaacacaaugacacaggaaggggaacaucacacuccggggacuguugugggguggggggagggggaagagauagcauuaggagauauaccuaaugcuaaaugacgaguuaaugggugcagcacaccaacauggcacauguauacauauguaacaaaccugcacguuguacacauguacccuaaaacuuaaaguauaauaauaauaaaauaaaaauaaaauaaaauaaaauuaaaagaugucaguacuaccuaaagugcucuacagauucaacucaaucccuaucaaaaucccaaugauuuuuuuugcagaaauagaaaaccuacccugaaauucauauagaaccucaaggaaucccaaauugccaaaacagucuugaaaacaaagaacaaaguuggaugcacacuuccugauuucaaaacuuuaguauaaagccaugguaaucaaaacagugugguacuggcauaaagacaaacauagagauggauggaauugaauagaaagcccagagacgaaccuuuguauauauggucaaaugauuuucaacaaagguuccaagacuauucugugggugaaaggacagucucuuuucaacaaaaggugcugggaaaacugaaauccacaugcagaagaaugaaguugcauccuuauuuuauaucaaauaaaaaauuagaauggaucaagcuacucaggaggcugaggugggaaaauugcuugagcgcaggaguuugaggccagccuggaaacguagugagaccccaucuccuaaaacaaaacaaaacaaaaaaccaaagacuuaaacguuagaauuaaaacuauaaaacucuuagaagaugcaguagcaucuucagagagaaggcuccucuaugugcuggaacugugcuacccucuauggcacagcucauaauagcaugcuuuuaaaaguaucauuuaggcugggcaaaguggcucacgccuguaaucccagcacuuugggaauacaaggcagguagaucaccugaggucaggaguucgagaccagccuggcaaacaugaugaaaccccaccucuacuaaaaauacaaaaauuagcugggcauggugguauacgccuguagucccagcuacucgggaggcugaggcaggagaaucgcuugaaccugggagguggagguugcagugagcugagaucgugccauuguacuccagccugggugacaaagugagauucugucucaaaaacaaacaaacaaaaaaaauuuuuuuaaaaaagaaaauagaauauugguugcugggggggguggggaaaauauuuacaguuuaauguauugagagcuuguaugggaugauggaaaaguucaggagacagauaguggugauggucacacaguaagacuguacuuaauaccacugacuuguacauuuaaaaaugguuaaaugauaaauuuuguguuuuguauauuugaccacaauaaaaauaaugcaaaaagagccuauuuuucuugaguuuaguguucuugguaauauguauauaccaagaauauauuuuuaaauauacacauacauauauuuauacacacacaugugugugcgguauguauguauuggacaccuguuuggcuccacuuuaacccucuuuucaccuagucauugcuggagcagccagcugugugcaggugugaccucacaccuggccugagcugccgugucuuuccaucccagcauuucugugcugccugaacaaggaugcucagccuuauugaugcaugcacagacuuggaagcaugagggaguuaaagucccauaggguagcccucaaccaguggaaaacuaaacccggugaauaagcuccucuguguucugacacugaagccaacaguucucaggcagguucuuacuggcuccccagcagaucaagccccaguugcccacagaggugaccagcuugaaaacgcgaccuggagggacagagaaugggcuugcccuccuucccggugccacuguucccaggccuccacgcuugucucauggggucacuucccaaaacaaacacucagcgugugugccuuugccuugccucugcuucuccaaggagcccagguaaggcacagguaacgcuuccaaguuugguuaugguuauuccucuuauguaaggcgcuguuccagacucucaaaauaaaaaaggcaauuuuuagguuaugcaaaaaggauagacuaauauaaaaaacacccacgugcccacccaauuuagcaaauaaaauuuuacuaauacaguugaaucccaugucuccucccagagauaaccaucauccugaacucagguuucucauuuuccacgaaaucuguaaacuuuaauagguugaaccauaugaaauugcuauauuuguuggucaaaaguggucaaauaucagcauuucuucugauugagccugauauucuguguguauguacacacacuuuuuuuuuuuuuugagacagagucucacucuguugcccaggcuggaguguaauggcgcaaucucagcucacugcaaccuucaccucccggguucaaagaguucuccuaccucagccucccgaguagcugggauuacaggcaccugccacugcgcccggcuaauuuuuuguauuuuuaguggagacggggcuucaccauguuggccaggcuggucucgaacuccugaccucaggugauccgcccgccuuggccucccaaagugcugggauuuuaaauuaucuguauuuggagucgacaugauugucucuuuagaacggaaucuacauaaaagcuguuagaacgaauaagugaguuuaggaagauugcaggauguggggucaauguccaaaaucaacugucucuguaacaguaaacauuuggaaauugaaauaucuauggauauuucaaaaucccuaaauauauauacacauauauuuacacaaauauguauacacacacauauauaaagguauaucaaaucuauauuauuucuaauacacacacacacacacacacacacacacacacacacacauauauauuuuuuuucuucagauggagucucauucuguuucccaggcuggagugcagugguacaaucucggcccacugcaaccuccccuuccuggguucaagcaagccaccaugccuggccaugaaauaauguaauauauuuugagauaagcaucuucaauuaccuucaacgauauuuguagcuuaaguauacauuaacaaaauauguguaugaucuguaugcugaaaauuauaugcuaaacuguaugcuaaaacacuaaugaaauaaauaguauuuuacaucauuuaaaauuuuauauauuggccaggcgugguggcacaggccuguaaucccagcacuuugggaggccgagguggguggaucacccugaggucaggaguucgagaccagccuggccaacauagcaaaaccccaucuguacuaaaaauacaaaagugaguugggcauagugguggugcacgccuguaaucccagcuacuugggaggcugaggcaggagaaucgcuugaaccugggaggcagagguugcagagagccaagaucgcgccacuucacuccagccugagagacugagaaaaaaagauaaaaaauaaggaguuccaauaagucagaguuuguguuuauaaauacaguagccauuaaaacauaaaaauccaucuugaauagcuagcauuccauauuuucuugaauuuuaauucaguuacagguuucuuucugaucuggaaaaaugaugauggcaacauaaauaauaaagguuaucaaagguuuuugcauuuuucauauauucugcuccccucuagcacuuuugacuguaggucccagaauuuuacaaguacucagauuaucaaaguaaaguuuuuaaauucaccaugucuagcuguaugugcacuuuuuucuguuuaguaaaguccaucucucuggcuguuuuagucaguggugauugaugagaaccaaaagcacuuugccuacccccaggcagaaauggaggccuugccuuugauauuaguggaccugcaggcucuggacacuggagaaauggaauuuucuagaucagauuuacagaaagacguagaauauaaaucucuugccuuaggaugcuaaagauaauuucacugcugaauggaucaagccauuccuucucaagaguaaaaucguuccuccuacucuguuuauuuuguuuucuuuuguuuuuuuuuuuuuuuuuuugagacagggucucgcucuguuccccaggcuggagugcaguggcacaaucacagcucucugcaaccuccgccucccagguucaagcaauucucgugcaucagucucccguccucccacucuuuaauguuuaauagaaguggugggcuccucauuuuuuuuucaguccaaagcaaagguguguggcaaaaucauguucccaguuuguucuucagugaaacagcuaaaccuugccuucuccgaauugggauggggcaacagaguggagccaugguggauccagaaaggucaggaaauacacacuuggcugccauccucaucuguugcuccuugaaacugaccuucccauauggccuuuuccacuuuucuccuuuacugaugccuauuauccagcugucaagcacucuuucuuaaguucccaagaagguugaugguuauguguuguucuuagcuauuuuagguacaagguauguacugucauuuugaugacugacuaacugcacaggugaucuuagcauaugaaggcagcuucuggucuguauuuuguggaaaaccuacuuacaucauaggaaaaagccucaggcauugguuuuuaggcugcauuguuuguguuaugccuguagacguugugcugccagagggggauacuaagugacuacagaaaaaguuaagugguuaaugaugauuuuuauuuuaauggaauccccauuaucuuuucucaaauaaauaugcggccaucacccaacaggaugauguuaauuuuauaucauuagagaauucagaaauuucuaaaagugagcuauuucugaaauaauucuaaggagaaaaauagucauuugguuuuugaaugaacagcugcagauccuuccuguuuaucgcaagucauuuucaguccauuuucauagauuauguccuuccccugccgucugcaaucuucuaaaucccuuucgugcuaaugccggguuaucaggggcagccucaggaaucuacauggggaugucuguggacucacagaagggcaaagcuaccagcugagggcucguaaccauuuuucacaaauaggaaacugaugguuuugccuccaaguuaauucuucaugcuuccaaagcaccucacagcuagaauucacguauuucauaaccauauuuaugcuacuucaaggggaaaauggguguggaggagagagaaagaacacaaaacucaguaaaagcuugcuaaucgguucuugcauggcuucauuuuuguauaauucuuuuuaagagagagagacagggucucacucuguugcccaggcuggaguacaguggugagauuguggcucacugcggccucgaacuccuggguucaagcaaucuucccaccuuagccaaccgaguagauaagacuacaagcguaugccaccaugccuggcuaauuauuuaauuguuuguagagauggggucuugcaguguuguccaggcuggucucaaguuccuggcaucccacagugcuaggaugaaugggccacugugccuggccauuuuguuauaauucuuaauccuaucacagguauuggauuuuggaagagagagagagagagcgccguauaacccauugcugucaucugcauguuacauucaguuacaguguauuucuggaauuugaaaaaaaaauuaucuugaagggaaaugggaagaaggauaugauuaucaaguaacuguuugcaagauagcuucugucauacgaugcguugguacuaggaagaauucguuguggggggcuagggauaauacaugagccuuuucccuugggcaaggaaaauguuuaauguacagaauuacaaaguacuaauauuuuauaagcuauucuuucuuaauuaguucuuccuuaauuuccauuguguucaauguuaauauuucuuaacuaucucacauaggaauuuuaguauuuucuuaauguuuaaaauacauuuaaaauaagcuaauaccaagaaccaaaugggaugugauuuugcaaaaucucaauucuaauucucuuuaaaagcgacaaagcuagccaccuuugaaauggaugcuaaagaaacuuugaaauguauccagaagcaauaauaauuaucagcauuuaauauacuuacauauucaccuucccuuuuaagaacugauaugcuacuuuaaaauccuuacuauaucuauauaauauuuuguuauuuauguauauuacuuuuuuuugagacagucuugcucuguuacucagguuggagugcaguggcgucauuuuggcucacugcaaccucugccucccaggcucaagcaauucucaugucucagccuccagaguaacuaggacuacagguguguaauuuugcauuuuuaguagagaugggguuucaccgcauuggccaggcuggucucgaaguugauccgccugccucugccucccaaaguguugggaauacaggcgugagcuaccgcgcauggcuuucuguauuacuuuaauauauggaaacacgauaguaaauaagaguaggauuaaucuuaaaacugcccccugcuggaagcagcuugcaguccacugaaaagccagacugaguagaaggucugacauaauauauuuuuuuaaaugaauugacaaaaaauacauaguuuuuaggauaaaugauguuuccucaauaaugaaggauauuugaacacuggaagaauaaauauuggugcacaaauuauuuuauauuuuaucuaguuggagaaauguugcaaaguggcagguaaauguucaaauugagagaaguuaauaaaugagggaguguauaauuugcacuucaggaucaacagaucauugaaagaucuuuacauaggcgaagcaagaacaaagcuaauuuauagguuccuuuuauuguguuaccauugccaagccuaaggaauauuucuaaagguauugagaaguuucuuggauccauuuuauugcauuucauuuauuaaacuauugccuaaauauguuuucuguaaagaaaauuuaauguugcuuuucuucuagugauugaaauuaggcuuuucauuaucccaauucauuaauaaaugggaaaauaauuuuuuucucagccucaugaacgacucaaauauugcucucuuucuuuuucucuaguccaucucaaaauacucaggagauauacacguacugcaaauuauauaaaauaauuugugcucagauauucuuccaaugcuuuucaccccaaaaugcauuuuuuguggaauuacauagucccaguaugaauuuugagaaaaagguuugauuguuuugccuuugugaaagagaaacuguggcuauagggaguuaggcaucuuuaaagaaguugccaaacguacauuagcaucuuucaugggaauuucauucaggggaggaaaauagagaaagagaaaaaauaguuggaaaaaaagaaaaaaaaaaaaagaaaaaaagaaaaaggaaaugaacacagaaaaucugagacaaacagauaaaauaagaugguagacaucccaaaauaucaguaaucaacaauggacuaguuccucuagugaaaagacagugagugucaaacuguguuuauuuacauacaggcacacacaugcauuauacacacauguauucuuuuuaugaggcauaucuaaaacauaaggauacagaaagguuagaaguaaaggcugaaaauugaucuccaugcaauacauaaucaaaagaaagcuacaccagcuauauuaaugccagacaaaauagacuuuaagacaaagggcauuccuuuaucuggaagacgaagagggucacuaccuaaugauuaaaaguuccauucaccaggaagagaaaaaaaucauaagcuuguaugcacaugauaacuuagccuuaaaagguaggaagcgaaagugaccaaauguacgaaaaaauaacacauccaccuaauagugggagaaucuaauagaucuuuccugauaauaguugaaacagacccccaaaaaaucaggauauagaacuuguaaagcacaggagcuggauauacugaacauguuuauaauacuguaccaaacagcugcgcaaacacacucuuuguaagcacauguagauuuaugaaauuugaugacacugaaccaaaagcaagccucaaacugucaaaggauuacuaucacuguggauagccuacuccaaucagagggaaaaugaguuagacauuaaaaagauaaaaaacucccaucuauuugcaauuugagaaacauacaucuaaauaauucaugagacagggagagaucauaagggaaauuagagaguauuuagaaucaacuggcgcaguugcucacgucuuuaaucccagcacuuugggaggcucaggcagaaggaugcuugagcccaggaguuccagaccagccugggcaagacauugagacugugucuguacaaaaauaaaauaaaauuagccagguguggccaggcaugguggcucaugccuguaaucccagcauuuugggagggcaagguaggaagauugccugagcucaggaguuugagaccagccugcgcaacauagcgagacuucaucucauuuaaaaaaagaaaaaaaaagaaaaaaagccaguugugguggugccugcuacucaggaggcugaaguaggggcggguggcuugagcccaggaguuugaggcugcagugaacucugaucacaccacugcacuccagccugggugacagagagacucugucucucuuuuuuuuuuuuuuuuuuaggacagagucucguucugucacccaggcuggagugcaguggcaggaucuuggcucacugcaaccuccgcuucccagguucgagcaauucucccaucucagccucccgaguagcugggauuacaggcgcccaccaccaugcccggcuaauuuuuauauuuuuaguagagacaggguuucaccauguuggccaugcuggucuugaacuccugaccucaagugauccgccuaccucagccucccaaagugcugggauuacaggcuugagccacugugcccugccuucuauuuuaaaaaauaaauaauaaaacauaucaaaacuguucaggugcugggugugguagcacgugccucuacucccagcuauuugggaggcugaggcaggaggaucacuugagcccaacuuaggcaauauagcaagaccccaucucaaaaaaaaaaacaaaacaaaauuaaacgaacugguggagaacagcugaaacaguacuuagaaauggaugucuugcuggguguaguggcucauaccuauaaucccagcacuuugggaggucaaggaggauagaucacuugagcccaaggaguuugagaccagcuugggcaauguggcaaaaccccaucucuacuaaaaauacaaaaaauuagcuggaugugguggcaggugccuauagucccagcuacccaagaagccgaggcaggaggauugccugaacccuagagguugaggcugcagugagccaagauuguaccacugcaccucauucugggcaacagagugagacucuuaucuccaaaaaaaaaaaaaaaaaaaaaaagacagucacacacaacagcaagggagaaccucaggagcaagaucuaagcaaaaaaagcaaguuguggaagaauaccuauaacaugauaacauuuuuagagauacaaauagauguuguaaacucuaaagaaaagcaagggaaugauaaaauuccagaaaugacaacuuugaaggaggaaaggaaugugacagagggaaaaaccaaccuugucccaccggggacaucagaacaauagcaguguucuagaauugggcauguuuguaucauucucuuauaucuugcauucauuuuauaaccuuugaauauggacaauauuuaauaaaguuaauuacauuuaaaauaagugcacgacccagcuugguggcucacgccuguaaucccagcacuuugggaggcccagguggacagaucacuugaggucaggaguucaagaccagccuagccaacauggugaaacccaucucuacuaaaaauguaaaaauuagccgggcaugguggccggccccuauaaucccagcuacuuuggaggcugaggcaggaaaaucacuugaauccaagagguggagguugcagugagcugagaucacaccacugcacucuagccuggauaacagaaugagacuccgucucaaacaaauacauaaaguaaguguaauugcuaaauuacaggauaccuguucuuguauaugugcaagaaaaguauacuuuuuuuggagaaaagguuaacuuauaaugaguucuuaauuagguuucaugauuuaaauuuccccuucuguuaaagguuuuucuuuuuuuuuuuuccuccccuucccuuugccuugcugcuccuuaauuguaggaaagauuugaagcacucuucaccaucuaugaugaccagguuacuuuucagcuguuuaaaagcuuuagaagagucagaauaaauuucagcaaaccugaagcggcagcaagagcgcgaauagaacuccacgaaacagacuucaaugggcagaagcuaaagcuauauuuugcacagguacuucaccgugcagagaacacuguucucuaaacuuguuuuucuccauccaaaaauauuuuuauuucaccguuuucuauauuauuauagcagagguguguagagugaaccaucucaaucagcaaauaauacaaaaauauuuucccuuuauuuuauagauacauaauuucguguauuuauuaagcacauuuaccuccuaaguuguuuugcugagacuaguaguugaaggaguugauuuuucuggcagcuuugcucaacugggacucugcguggguuacgcccugacacccuaguguucggaaacuaacuucucuccugugcaucuagaaugguauacaugaaauaagacaugaaauccuugggaaaacugagaaaauggucucuuaaaucauuuccauaauucauaugaggaaccagggaggucacggaacuguacaaaagggcugucuucgacuuugaaauugcagaggacccuguaggguaccaaaaauuggcuacgcuuaguauauucuaauccugcauuggugugacucucugagaaaccaauuucuucugagaagagugggcaaaaucaggagauuacucguguauuaaaugcacuguuuuauuuucaaaacauuuuuuucagucucccuuacaaauuaaaaaaaaaagguuuguuuucuugccuuccacguaaaaaccuaaaugaaagagaugucuugacguuucuugguagagucucuugagauggaguacaaauaaguccauauaaccuaaugucuucuaagauuggaauuuaguaguugcugucguucauuucucucuucauccauuuauuuauuuauuuauuauuuuuauuuuuuuauuuuuugagauggagucucacucugucacccaggcuggagugcagugaugcaaucucagcucaccacaaccuccgccucccagguucaagugauucucccgccuccgccucccaaguagcugggacuacaggcauaugccaccacaccuagcuaauuuuuguauuuuuaguagagauagaguuucaccauguuggccaggcugaucucaaacuccugaccucaggugacccacccgccucggccucccaaagugcugggauuacaggugugagccaccacaccuggcccauccauuuauuuuuuaugcaguuaauauucaugaagcaccuacuguguguggccaugugcuguacacugaguggccaguggugagccaaacagacccagucccacccuuuuggagauuauagacuguuuacaagaaauaggccaggcacgguggcucacaccuguaaucccagcacuuugggaggccaaggugggcggaugaugaagucaggagaucgagaccauccuggcuaacacagugcaaccccgucucuacuaaaaauaugaaaacaaaauuagccgggcguggugacaugcaccuguagucccagcuacucgggaggcugaggcaggagaaugugaacccgggagguggaguuugcagugagcugagauuggaccacugcacuccagccugggcgacaaagugagacuccgucucaaaaaaaaaaaaaaaaaaaaaaaaaaagaaauguuuaauuuucuacaaaaagauggaacagucaacauaaaggugaaaaugaagaaaacauagcccgguuugcaaacuggcuuugagcgucucgcucccugcaggugcagauguccggcgaagugcgggacaaguccuaucuccugccgccccagccugucaagcaguuccucaucuccccuccagccucucccccggugggguggaagcagagcgaagaugcgaugccuguuauaaauuaugauuuacucugugcuguuuccaaauugggaccagguaauaaacuucuauuuuuccuauuuucuuccccaagaaacuuuuguauugaagaucguauucagcagugugcauuguggcaguaugauuagagcagaggauaaagucaaacacaccuggguucagauuccagcuguggcaucugcuugcucugugaucuugaacaaguuacuuagccuccauuuucugagcuucugcuuuuccaucuauaaagcagggagaaucauaugcaccauucagugugguuauaaguacuaaaugagggccaggugugguggcccacgccuguaauccuagcacuuugggaggcuagggugggcggauugcuugaggucaggaguucgagaccaaccuggccaacauggggaaaccccgucucuacuaaaauauaaaaaauuagcuaggcaugguggcguacgccuauagucccagcuacuugggaggcugaggcaggagaauugcuugaacccaagaggcagaggaugcagugagccgagaucguaccacuguacuccagccuaggcaaugaagcaagacucugucuccaaaaaaguaaaaauaaaaaauuaaguauuaaaugauguauagauaauacucaguaaauguaacuaauuuuuacuacuacagauuuugcuaguacuugauaggcaguuagugaauaugaggugccuucucuccccagccccaccaaguaucagacaaacaacaacuacuuugaauauauuacaaggaauugguggugauaucaucucacuccuucaauauuuuugucauuucuuuuucauuuccuuuuuccuucucuuuacuuucucuaccucucuuccuuuuaaaaucauauaagaaaccgaugugaugcugguucagacaguuguccacccaagacagaguuaugucucuuguaggggaauaaaagaggcauuuugaggaagaagugauucagugcuguuuuuagacguuagagcugugucuuagauauccaaguuccuauaaucaagggagugccuaugcugccuggauccuuacaaguaucucccaaacugaaaccauuaugaugucagagucacuuggcugggugcgguggcucacaccuguaaucccagcacuuugggaggccaaaacaggcagaucaccuggggucaggagaucgagaccagccuggccaacaugauaaaaccccgucucuacuaaaaauacaaaaacaaauuagccgggcgugauagcgggcgccuguagucccagcuacucgggaggcugaggcaggagaauggcgugaacccgggaggcggagcuugcagugagccgaggucgcaccacugcacuccagccugggcgacagagcaagacuccaucucaaaaaaaagaaaaaaaaaaaccaucucgacugaaaauacaaaaauuagcugggcgugguggcacacaccuguagucccaacuacucgggaggcuaaggcaggagaaucgcuugaaccugggaggcagaaguuggagugagccgagaucgugccacugcacuccagccugccgacagagcgagacuccaucucaaauaaauaaauuaauuaauuaaacagauuaacucauauuauucauaaaacaauaauuagcauuugcauuuuaacucccaagacuucaguacugaaacaacauuuuauacaagccuuaaaguaucaaaucuuuaacaccaaaacaagauaaaauacucuaacauaguauuuaaagauuuaaagaacaagaaucacccauuaaaauaggaguagaacaaaaaguugcaagggacaaaagaguucuuuuugcuggaagugaugcuuuugucaugguuauuuuguuugccucugcaggagagaaauaugaacuucacgcgggaacagagucgacacccagcguggugguucaugucugugaaagugaaacugaagaggaagaagagacaaaaaaccccaaacagaaaauugcccagacgaggcgccccgacccuccgaccgcagcguugaaugagccccagaccuuugauugcgcgcugugaggcccuugguuguggugcgaggcggcugcccuggugggcucuggccauggcgcucugugccugcggccgaugcguugcugcgaacagcauaggugagacucugccgagugagguauaggucuucucaccacgccuguacugcagacacggucguguagaguagcagcugauuugaccugucccagauuuuaagugauauuccaaaagggacuuuacauuaaaggagaagcccccaagauguggccacccuuaaccauuuuuaaauaguaacaaauuaggaaaacagcuccccuccccuccagccauguaaguccuccugauucuguaucacaugagacaccaaaaacuggaaauguagucacacccaguacaguaccauuuuuaugaauuuaaaaauagucuuauaauuuuaauuguuuguggguauuuuucuacugguauaaauagcuucuaauuaauaaaucgaucaaagguuguuacucaguauacaugaaauuuuuugcaggaaaagaaaccagaaauacagaauaauucauagaaaucaugguucucaaguauuuguucaauuagcuuuggggaagaaaugccaaauccacuuugaggaugagucuuacgacacagauccacccacauguugcucuuaucuggaauuugggacaa

SEQ ID NO: 191424 - RNA, 84836 nt, Homo sapiens
cugagccuuugggagaccagucugccuuuauuccugauucccuccauggguaugugcuaaaacuucccaauucuacuaaagguggugguguacauuuugggaagcgcacuacauaggaucaagggcuuagguaacagcugguuuaacagauugccacaaacuuaguggcucuuaaaaaaacagaaaucuauucgaaaguucuggaagcuuaaagucuaaaauggguacacagggcugcauucauuacagaggcucucagagcagggaggaucaguucauuuccuugcucuuuucagcuucuaggugugggaaggcucguggcuccuuccuccauccucagagcacauaacuccaguuucugcuuccaucaucacauugccuucuccuguagucaaaucuuuugucucucucuuaaaaggauacuaccugugauuacauuuaaggcccaccuggaucaucuaggauguucugccucaucccagcauccuuaucugcaaagucccuuuugccauauaagaugauaaaaacauguuacaugcugguuccuucccaggggcuccugacugacugacagauagaugauaaacacuguuacugcaaauccaaguaaugucccuuaaaugugguuuuauucuuucuuacugugaguuaagggacaucauuauauauauuggugaucugacuggaagaugaaaacggagaaggcuuuucccccccuagucuuagaauucguggcaguaauggaaagaaucugcacaccaggaucagggcaguuaauguuuccaguccuugcaguaucaguaauugguuagguaaaauacccaauuuuaaguauuacacaaugaaauaaauaaauauacuagagcugcgccaacgcauagaagacagaugauacacagggaugacauugacaaaacuggcaucacagacucgcacagaguauacggaaacgagggagcuuuauugguuacauauuguacugcagagccaacagagagcauucgcgccagaggauacaugcagacaggcagcuccaaugauacacaugcacccaaggagcccugagccacugcuuugcccugguuuccagcgacagguucuggccuccuuggucccaugcuuggagcugcugcaccuagacucuaaggggcaggggugagagagaccagagcaccugccugagcaaguagguguggaccaacaggcugcccccaacaaaggggccuauaaugcaauaacaguuuauuugagggcuacuuucuuagcccucucaaucuuuaaaauacaaaaaaauagacuuuauucucuuaaaaauacauuccauucaguauauguucugagcugggaagcagcaggaaaauagggccccuuuccuaugauccuaugguugugaggcuuugaggagaacccugcuccccacucgggguauucaaaaaauaaucccuaaaagcagcucuuuccaaagcaaucuugucagagaaauaacaaaaccucauaacaagguagccagggacccagccucuggguccccauuccuuuauugggaagugguagcacuuggcacugacccacuaaauauaaagaacuaaaacugccccaggacgacaaguccaagaacacuauagugcccccugcaucccgaacacuccacugacggggguuauuuaugugcaagcuugccuacagcugagggugggguggcauccuuggccccacugcagaucccuuuaacccacacugugacucuuucucauugccacccaaaagcaaaaaacagccacagcuucuuuauccaccugcagcuuucucugguuuaguaucagaguggcaaaaaaagcagcagcacguggaagagaucagcugcugguacuaagccagcuucacuuccuccaaccaagcagcucuauugccaggucccccaacucacuaggaacccuccaacaaccauacaccugccaguaaaauuuaagagccaagcugcggaagaaaacugucauaaaaguggguuuguugaccgggggcagugggacuauuuggcuugauuaaacaacuauucaacuaccaggucuccccucuacuuggaggcuuccuccaggaccccugaugaugaggccuggguccaaacagucacaccucaguugcuuuucagaaacaugccucccaacuuugggauuugagagccagccuugccagccauuugaagcccagagaaacagccuccagccuuuacuugcuauuacaauguuauuuucugcaaugcugaggacacuuaaaaauaaaaucuaucuagaaagugugcagauuaaagaaacaaaauauccugaaauaacuguuacaagcaaauccuauugcacucagauuucaagauggcagccccagcaaaagggcaucacagcugucccucuucaacaggacauuuugaguagcagcagauguuggugcugcugaaauguggaaagauccagacuuuggcaccaggagcuauagcaccagaauccagggcuccaacacucaaagacaagaauuauuggcgagaucuuuuuaggcauggcuuggcgcccuucuguuuccaucagcagagaagagccacagacuuaguuuccuaauaccuuuaguugaccaccacagagguugauuuucuuugaacucucaagguugccaaccagugaaggagaauggcagggaggcugcaagugaaggauggcagccuugagugagcuaguuucuggccaguaagccaggagaagcagcaguaagagaucuuggaaauagcaucuugagcaucagagguggggauguggacaggaaaggcaggccacaugacaaugccuuuagauuggcaaaacucugggaagcagaaguaugagcaauagauuccugucccugaaaguaagguaggugcuccccaagccuccucacugccaaaucugauacagacaaggucaggaugaacacugguucccaugcugagugaaggcagagaagacaaauuccucuggaggaagucuugagucuuccucuugccaggaaauucauaggagaugcacaggaacaggagauacacagacuuggguacuuuccauaauaccuagacuccuagaacgccaggagauacuguguggcacugggcaaggcugaugccacaaagagccucagagaccaucccaucuaaucccuucacacuuugcagauugggaaacaggcccacggagcuucucugagcucauccccaugagauuaaaacauacagaaacuaaaaaacaaggcccagaaaaacaauugagggcaggagggaagaacccacacggaugauaccuuccacaagcaaaaaucaucccauacuauuauagauggugaaaacaggagaaccuuagaauaccagauuuggugcccuuagagaucauccauuucaaagaacucauuuuacagacagggaaacugaggcuccaagaagacaaugacucacccaaggucacacagcaaggaaguaaagccauggggaaaaaaauccagcuuaccagacugguaguuuaauguucucucauucugagggcaauagugucuacuucauaaagguagccuuugaaagaggaucccuucuuugaauugacagaaugcuaaagaaaaagcacugccaagaauauacaauucuuuucaacuuccccaugugacugguauaaggaaccuaaccaauuuauuuacguggcuuucugaaaaguuugcugcauuuugaacuauauaaagcugaggcccucaaugcguauguacguaucaccuuuccuccagcgaagucaucaugauagucgacuugcagaaauccggggcccacuucuguaggaaugcaucagcuugguaaagugcgaugccuccuccaugggggauggagaaggaggaacaggagggaguagucucacaguccaugccucucauggagcuauugcuuguggagugacuaaaggggucugcuuucccucuugcugggcacuuccuagaaggcagaggaugcugggucaggcccagcuuagccuagggauuuucccaagguggaaacaaugaagucagcuugaagucuccagccacuggagagaaagcaggcgaugccagcagcauuacuggugcucaggaaaggagaugcaugaggcuugcaccuccaggugccuuuggaaggugagcagagagagcugggguuggggagggaugaugucauuccaauggguauccgcaugaguaucugcaugcucugcuuccaggagacugguaagccaggagccaggucaaacuucaaccuaaaggguagucucauaauccuuuagaggcagcacagaccccuuucugcuuuaagucugaagaaaagaacuccaaggggaaagaaaugaaagcccccuagauagagcugauggcugguaaaucuuaugggguacuugagcccauugggcaaaugaggagugaaguggauauagugaggagacugagaaaccagaacauuaaccacacagacagaggcugcccuaggauccagaaacaacccaccaaggagccgagaagaauuuuugacuccugcugugugcuggggacuuuaucuucccuuguuugggggccagaaugguccaacuacuugguggacagggacaaggagagagagaggacucgugcauuggggaagguugggccugggugacuguccagcuuguagucucugauucccucuggccaaauggcaaaaauuaccugagccacagcccggcucuaccacaguuuuccagccaaggcuugugucuugccugguuaacuggccuuggauccuucguggggcaggacgguggaagagcugagaagcaggagcagagggcagacaacagacacccagcgggcucaguucuccucagcacagggccugguuggccguaaucguuccucggcccguacucgcccagacucuggcagccccugcuucccaggcaguucagacggauccagggaguugugcaguugccuguagacacugaguguacagucuuccccuucuuccuccugugccaauaaauaacaaaagugagcuguggaggucaguaaagugaggaccgagacacccucaccugcuaccauaguggguccuuuccaacccagcagaggcagauauagcccagacaggccauaaguuaacugcaaagauaugcuuuugccugaguaugggccaauauguaaauuccuuggaaaucggcagacugggaacuccaagcugcugggaacaaucaggguaggcuaggaggaggcucacaacucaacaggagccuuacagaggauagagccuggaaugggggcaugggacuagcaccccugaggaggggccagcagucuccgaguucugcacaugcaugcaggccgcaugauucuggggaugagguccacauccuugauggggagcugaagagagguccggacagcucucuuccuccuucccacauacaaacuaccaaaaagcucacauucccgucucucauccuuuaucucuccucuuaaauguccaaagcuucaggggcccaaauagcugucuuucucccuacgccuagaauucuaccuuuuuuuuugagacgaagucucgcacugucucccgggcuggagugcaguggcgcagucucagcucacugcaaccuccgucuccuggguucaagcgauucuccugccucagccucccaaguagcugggauuacaagcacgcaccaccacaccuggcuuuuuuuuuuuuucuuuuuuugagacgucauuucacucuuguugcccaggcuggaguacaauggugcgaucucggcucacugcaaccuccgccuccuggguucaagugauucuccugccucagccuccugaguagcugcgauuacaggcaugugccaccacacccagcuaauuuuguauuuuuaguagagacgggguuucacuauauuguccaggcuggucuugaacuccugaccuugugauccgccugccuuggccucccaaagugcugggauuacaggugugagccaccacgccuggccagaauucuaccuuuuuaauauucuccuugguucucccaagcaaaugcagaucaaagaauaacauaggcaugaguaagaaagguuagaguagaaagagcauuggauuuagagacaggaaucuuggauucaagucuucgcucuuccaguaauucugcugggugaccuuagguaagauauuuuguguuucugacccuuagcuucuacaucugaaaaauggggauaauaucugcccccaggcagauauucaagggacugaauaagauaguggguagugaaguacuuuuguccaguguuaaguacccuguaaagagucacagggcuuuucaaguuaacagagucaucugcuuuuuuaaagaagggagcacuguguccagguccaagaaguuuuucaucaucacagguuucucaucaaaaagacacucccaggggcuucuccagaugcuguucugacacccugagccucacacucacauaaggcaggugguucuggauuuaucaaagcuguaaugagcuauacugaaccagcccugcccucagacugauaauaugagacagacagcugucuggggggcaaaagaaagugucacuuggaauuggguauacgcuuaucuaaaauaggcccaguguaagccccggcucuccucaucccugagaggccagcagccugugaagaucugcuaacugaggcggccgagaacuugcugaccuggcucccccucacugugcccuacagaaagggcaccgggccuccuccuguugcccagagcuccccaucagcugcagcugcuucuugugcuuuucaugcuguucugagggccuacggggagcuccuuuagcugcucuggcaaaccaagggaagagaagacagauuuccuuuuuaugucaccuucauauacgagagcaaaaugaagacaacaaauuggaaaagggauuuuggaaagugaugcugccaaaaaccuucuuuaggagaaaggucaaaccccccugauuuuucaacaguucucuaaggaacccaguucuacucaguucucaagauccugggucacacaggccagagcagaggggaaaaaggaaaaggcaaagaaggaaaagggagggagaaaagagagaggggagagaggcuggaacucaccaugcuugcugagugguuccaggcugcgacagugauggugucuccuacccgauuccgacggguaagcaccucugacacagugaggcuacuuuggguccuucuggaggagggcucaggggcauccccugaacuugguccuacccuucgagugcccugcucaaaaaggcaggaccugggcuguucgaguucugagaagucuguggaagaccucuggguguaggcauugcuauugguagauuccacguuuuuaccuauucgaguuggggggucuucuaaagauuucaagucucgccuacucuuccaggcauuccgcacaguaacaugucuggcaucugagaagcccacuucugaaggggcacuauggcuuuuccaccugauugucuccgcuggaggugcauggcuauuccucuccacaggauccgauggcuugauuauaaugcugcuccgagagaccacuguuucuggccuguccuucaggggcccaucugccauucucuccgcuucugcaagcugcagggugaugucauguuugugaauggagagcucaaaaggggagcugacaugguugcuaacugaugugagcucugccagccccaccuggauauugcuaguggaugugugccucucccucagggccucacccggagcagcucuggggcugcugcugucagauggauauauaguaaugcuacuugucacuuuguuuggcccugguuuggagacggguuucuguuucuccaacguagucucuguuccagauccucccaugauuuuuuucacauccuuaucaacaauaacagguuugaugauggcucuagaccgcaacgccucucuggggcuaaagggccuuuggcuuuuuaccccagcaccauugguaucugggagcuccaugguauugguggaggcucugacagauuucacagauucauucuccauuccagcaucuuuaucauucucaaauagggagguucuaggugccccucggguuuuagccuuuucucuagaguuaggcugugguuugggcucuggcucuggagugaugguuguauuuaccaacuuggcaguaacaagagaugcuauguccaagucaucaucugagucuggcuucucucugccacuggauuugaugacucgacaccucaaggcuucaugcggacugcugucuuccaucacaacugcugcagguugauuaaccccuucuuuaugugagguugaaaaucccugaaggauguucucuuggcuucuacagcuauaaggauacuucgauagaacaggagccuuggaauucgggcaacuguuaucagccucaaggccauuggcagccuuuuugccuuuagagagcccuucugaggaggaucuucgagaugaggccagggcuccaauggccuuagaacagccagaguuugcagccugaguuacuugacuuccguugccaagcacguguccccucuugccaaagacagucucagaggaggugucagaagccuugucagcucuacccaaugggucacugggaacagauccauggguggugucacuaaacguucguguugucuucuccacuuuucccuucaguccgcucucggugccuggcuuggaaguccccuuccacgcuuuacugugcuccugagcagccgggggguagcgacucagcacugagggcugcucccuagacuucuucccuucgcucugggaggagccggguacaaaccggucuucaguuuucuuugucuccugagucccacugucuguacucacccccaugugagaagcuuuugcugcccuccuguuggugaaacugggagaagaaaccugccuguugcucagagaauaguuuucauuguugagagcaaacucccuguuccggagucguucccgcuuaugcugaggagacaguucccgcgcugugugcuuggacacagaagcuucacuuccguggccucuaaacuuaguccucucaugucugccuuugcuggacaggaaagcaucuuccccuucuaccucuccauuuucuaacucuuucuguuucuugauuuguagcuuuaucuccuccaguuggcuggcuaauaauuuguuuuuauuuuguucacuuagguaauuauccugaaggucguuauuuuuggacuucauuuucuuaagcucuucuuccaacgauucaaaguguuugauuugugucuuaaguuucucaaucucuugguuaaggucuuugacuuuguugucuuccugauugcgguucuuuucauuuucugauuuguuucuuguuucauucucuaccugcuuuagguaguccagaccacccuuccuucuugauucuuuggacggcaguguggaagagaugccauccucaauccguaggucauuucuuuccagauuagaagcauuccuuguauaaucucgguucauuuuuuuguucugcucuaguuuuugagugaguucuuuuaucaauuucucauuuucuuucuccuuuucauucaaguauuuucucucacuuacaaagcucagaguuaaugauuucagcuuuucuaacucugacgcuaaacucugcucaguuuuauccaggcgguccucagaagauucuaguucuuucacuuugacucugagcauuuccagcucagaggagauuuucuuggucagauuucucuccucauucaggcucagacacagcuggguacagucauucuuacuccugcugaaggccucuucuagcuucucuaauucagccauucguuucugaagccgcucaaucucagauuucagcucccgggugagguuuucuuccucuucaaguuucuccuucaucagacgacacagauccucugcucucuuaauuuccucgucuuugccuucaauucucagcacccgcuggcgcagcacuucaaucuccgccaacaugcuggaguugcuaccuucugccugaaucaccuuguccuggagauccaggaguucauccucugcuuucuggagguuuuuuguggcuuccuccaacucaucaaggcggcggcuuagacucuguagcuuaaaccgcaaguggcggcuggaggccgucuccuuguagcuuguaaauucggccaugucuacugccagccaaugugggcuccuagaggcauccaauuccacucaaggggaugagaaaugguuaccuuucucuuggcaaccacaaucuucuuugacagcuggagaccaucaucaaucuacaaaaggaaaguagaaagcaugucagucagcaaauguaaaaccugcacguuagcucccaguuauagaaaagugcuccuaucuguuccuggugccuggaucauagcaggggcucaaaccuguugaaugaaugacuugaauaaaccugcaagaaaacacugguucuuuauggccgauauugaguugauaccucauuucgcccuaauaaagaaugucaccaguggcagcauggcaaaaagacauauaagaagccucaauuuucauggcaggguauaauaacaucauuaccaucugcaaccugcauaaucucaggagagucauuaacaauggaaacuaagucucaguuuuacuuagugguaaaaugggcauaaugaugucuaccguauuucuccccaguguuguucugagauaauauguggaagaucuugguaacaaagcaauaaacaauccuaagauuuuuuuuuuuaaagauuaucucuuaugagcuauugugacuuaaaagugauacaaauuaacccucugccuugcuauaaauggugagcuucacaauauacuaaaacaaucucucuacacccauuuucaacaucucuucucccaaaaguauauuuguaaguggaauucaggugugaguuggcccgacccagccaacaggcagcuucuacaaaacauauccuuuugcacuguaaaagaaaugccccagauguuaagguugguaugaagacugguuuguuucuuugaaagccauuucacuggggauauauaccaaacauauaauaauaccccaaggaaauagagaaaggggaagguuuaguuuuuuuauguaauuuucucauuuuuaaaacaggagaauggauugauaaauguauuuuaaacagcuuucaugaacaauaaguccuacgaaauuaaaaggcaaacaacagacuuccauuuccaccacuacagcaaaccagauaaccuggaaaaccucuaauacuauaaaacagcuaaaaauacugaauaaaauguaacaaucacuuaaaauguauaguugaucacauagaaaguaagugacauuccagcuaaaaccagaggaaaagaaaacuaaaugaaaaauaauaguaaguuuaaacuaccacugagcuguccuucuuagggucuugccgaucuccagaaccaaggaguuuggguucuaacaaucaugcagguauaagaggcaagaguuugggcucaauagaggugguaaguugaaaaugagacuccaguccccaaucuaaagcaaggauuauugaagaacuacagcuccaggauaacuagugaaaaaagucaccucccugauauagggagauaagaggacccgggcucuauuagggguuaaaggaggauuaucccuagagaauuuauaaucuuagaccugcucucacuugaauucagaguucaaauuuauaccaucugaguggucuagaaccuaucuguccugagaaacuaacauaaaauggccaucagccuaguaauaucccugggaaaccuagcugagcaaacaaaaguacucuggagggagccacucucuacagaggucacacaggauucccacagauuaaaguccagcugaaccugagcuuauaacuaaaaauuacaaaacacauaaagauccaucuuuuacuugacugggcagagcaagucaaguaaaaaagaaccaaaguuacuaagauuauuggcuagagaccauacaauaaguacauuccaauguuuaaagucauaaaagaaggaaugaaaaaaaaaaaaaacaggagaaaggaacaaggugcuaucaacaaagaucagaagaucugaaaguuaacuaaauacaacagcuagaaacagagaagagaaauggcauauuagaggcaaaggaagauauuaauaguggucaagagagauacguaauuacaaagagcagcacagaguuaaaaagauggaaaagguaaaagagagguuaacagauggggaaauaauuaaaaagguccaaaacaaggaaguuuuaacaggcagcccaaaaggauagaauacagaauagggaacaggcaauauuugaagagcuagcagguaagaauuuucaagaguugauuaaagauauggaccucacauucaggaagcaaugucccaacaggagaaaacuaaaucugcaccuaggauuuaggaucggaagaauccuaaauccucguaaggauacggaagaauguaucacaaacagaaaaucuuuaaaaagaaaaaagaaaaaaagaccauugucucaguccauuugugcugcuguaauaaaauaccugagguaguaauuuauaagaacagaaacuggccaggugcgguggcucacgccuguaaucccaacauuuuaggaggcugaggcaggaggaucacuugaggucaggaguucaagaccagccugaacaacaugaugagaccccaucucuacuaaaaauacaaaaauuagccaggugugguggugcacaccuauaaucccagcuacuugggaggcuggggcacgauaauugccugaacccacgggacggaggcugcagugagcugagaucgcgccacugcacuccagccuggucgacagagcaagacaccaucuccaaaaagaacagaaauuauuuccucacaguucuggagccugggaauauaagaucaaggcaccagcagguuuagugucugcugaaggcccagucucugcuuccaagaugacaccuagaaugcuguuuccucacagggaagaaggaauggaacaaaaaggguugaacuugcucccucaggcccuuuuuuaaaggugcugaucccuaauacuaucuccuuaaagguccuaccucuuaaugcuguugcacuggggguuacguuucaacacgaauuuuggaggaagcaaaaacaucccaaacacaaaaacaaucuauaauaacaacugaaccacuucucagcagaaacuuuuaaguagguggcaaguagaauggacuacaggggauaagguugggagcaggaagaccaaauaggaggcuauugcaguaauccaggcaaaacauaguuauggccuagaccaggaugguggcaguacaugcguuccaagagcacgugaccaagacaguugagaaauggucagaauucuggccguaugaaggcacgaccaaaagaucugcucuuagacuacaugugaagcaugaggcaaagaaaggaauuaagaagccgagugcaaugacucauaucuauaaucccagcacuuugagaagcugagguggaguucaacaccagccugggcacaacacaguaagaucccgucucuauaaaaaaagguaaaauaaaauaaaauuagaagguacaguggcauacaccuguagucccagcuacuugguaggcugaggcaagaagacagcuugagcccaggaguuuaagguuccagugagcuaugacugugccacuguacuccagccagggugacagagcaagacccuaucucuaaauaaauaagcagauagacagauagauagauaggaauuaagguagacucuaagguggcugggcugaauuuguagagggacagcauuaccaucaauucaaauggagaugaccgcagauggagcagucugagaaggaagaugaggagucucauuugggacauguguaugagauguauauuagauguauaagggcccacuugaaauuccugguaaugauuuaaagugaaaccaauccacaaaguucuuuuucuccagucuuguucagcuggcugaacagacaaaagaauagagaaaccagaauuggacugaaccagaucgaagcacugcagaacaaagcaaaagaaggacaggagagcagaggaugugugugagggacuuuaaauucacucaguacagaaggaggugaagaauagugaaaauauaauagaaacuaaugaagugaaggucccaaggggacuugaaggcuuguuggaguaaggguaccagguaccagaggaaacuaagccugaaauauagaagaaagaaaucagagagggacuucaaggaauugaaaucauggagggacuguaguuauugauaaugucaaaaacgaagguauaaucauaggaauccugugggggaguagggagaaguagagaacaagaucauuagaagagagaaauaauugagagguaaagguguugcaagggucaccagcauguaagcgccauaaauuaacaggaauaaugcuggaaagagugacguuaagacagaaucugaaguuguugagaaguuaggggcagugacucagggcgucgacagacggcagcaacgauagaguauuaggugaugucguccaauaagaucacauuuaaaaaucaaggacaagagugaagaaacagucugagacauaagagaaaaacagccaccacuggagagggaagaaaugacuccaacaaugauccuaugagaaagcucagggcaaaagaaaaacaacugaaauugggccuggaggagacgccaaaugccaauucucuccaagccugauucuucuaauggcugcacuauaagccuagaaccaccagauggagcccaagcucagcuccucaaaaacaccaacgcuugaagguguugaaaaaaccaagccuuccgcuuccauucagauucugcccaccccgaauacugcucccuguccaucacucugcuucucuggguacaucuuucucuguccucucaucuuugccucuuuuggucccccuucuccuuuccccagccuaccugcuuccucauucucaaaaacggagagggaaaaaaccuccuauaguuuauguuuuuaaaaagaaagcuuuucccuuuuaaaaacucuugcauuuggccuucugcccagugguacaauuaaaaucuugucaauguauacacaggguugguuugggaggacuuaauuaaguuuagaccacacaccaauuuuaaaugaguguaugauacaaagggucuguguugccaucguagucauuggaagacaaaugauauaugauucaucuauaaagugcuuuaaaacagcauauccucauaaauaugcuuaaaccauuaaauuguguauuuuaaagagauaaacuucaugauaaauaaagcauaucucaauaaagcuguuaaagaaaacccagcuuauccucaaacuguagcauucucucagcacaucuuauuuguacuagcuuauacuauaguuuucacaaucucuuuuucaaaagaaggaaacguuaaaccuuaguauagccccaucuauaaauuaucauaauucugaauucagagagucugggaauuauaccaccguuuuauuuauuuggcuuuuagugccaauuuuauauguuuuaucaagacucuggaugauaugaaucaacuaguacaggcaaugaaaaagcuaaacccaguaaauauguagcaaauacuuacuggaaacauacagagaaagcagguauuacacaccacugcuuaaaacucucuaaagguccuggcuacuauuaggauaaaguccaaauuccccaugauggcacccaaagcccuucaugauguggccccgccagccucuucaucuacauccucgcccucccucuucccucuggucccucacuaguuugauuccuucucauuucuucagaucccacuuuagacaauacauccuucuggaaaauucuggagugccuucuucaaaccccaggccagaucugggccucucuuuuuugcuuucacagucugcuacauauuucccaucacagaaccuaucacacucuauugcagcuuuauuuacucaauucuucucuccaacuugugucaccacuauauucucaguacccagcagggagccuagcacacagggaaugcugaaaauucgaugaauuugacugaugagugagccuccuaauuaucaaauagcuugucggcccuuuggcaaugaccauuaacagaaaauaauaagaauguccaugaccuaaucauggauuacaaaggagaaaacagauggcaagagugaacagacagcacagaaucucaggcccugugguaaugcucugaaugaucucaucccuagcccugugccacuugcacaaugucucaaccacaauucucucccccugaccugcugggaagcccuuucuugcaggucuaugccacacaaacaggacauagacaucaaaaaaccacaacacucacaggauguucagcucuaguuaucggaccaaauguuggagaaguaguagaaaacauuucuggaucuuccuccacuccucagaaugagauuucagagccagaagguagcuaaagaucauuuagucaacugguuuucaaacuagacucagcaaauccccuuggggucauuuaggggaaagacaacaggggagauauuuugagcaggcugaacuccaggcuccuuucacuuacucaaccaaagcaacugauuuuuagcuucuuacaauauugggcuucuccuauaugacuuuauuaaagaauucuacauagcuuuuauuuaaaauaaaaucacuuacuucauucaaaccccuuauuuuagaaacaaggaaacggacucagaaguaaauacugugcuuuuuccagcaguuuagcaaaagucaaggacuucagucuccugacucuauguucaggauucuucccauuaugcaaaaucaccuccuuauaaacucuuaagcauuuuuacaaaaugaggaguucuaagcacuacucuauaaacaaacuaacaaugacaaaagaguauaaaggaacaaauaaguacaaccacaaauagggcaguacuauacuacaggcaauacuaaguaccuuauauacaugauuucugcagguaucaggaaucucagaucauuuacuuuacauguuccuacguuacuccacggagguuuucccucaauguccacacaaaaacaauaugguaaucccuggacauguaaaaugcuuagcagaauaccuugcacauaagucacaacaaacaguaagcuacuacuauuauucuauucagcuuucacaauaaccuuauggggcaaggacucucaaauuuucccaaaguacgcagcuagcaaggacagucagagugaaucuagguccaauuccaaaguuuauauucuuuuaagaauaccauacuguuuggccaagucacugauuuucucuaugcuuuaguuccucugaaaaaauaaaagaauaucaacuaccuuacagcaacacuaugcaauaaaguuagcaaaagcacuuugaaaaguccuaugcauaccuaaaguaaguuucaucagggaaaauccuccuaaaaauagugauucacuaagaucaucccuucuccccagaguaaacaaggaacuagacugaaaaugggguuaggaggucacuuaucucugaccuuuuggcccuaaguagccaggauaagaaaugcuuugcuaccuccuggaucauccaaaagcaaaguagacaccucucuuucuacugccucccuuacucuguguuaaguauguuuauccaggcaaaauucauuuauuuagcagacauuuauagaacaccuaugaugcacccagcauuuugccaagauaaguagaaaaucuuacccuugccuuuaaggaaucauacagauauaaccaaucauaaaacuaugauaaagaagccuucccugaccaucuuacauaagauagcacccacccuuuugcauccugucuucuauccugcuuuuuuuuuuccuuagcauauuguaucaucauacauauaaccggaagcucagaagaagugauuaaaugugccuaaggguggggucugggaaggaaacuguuuauauuaaaccuugggaaaccauaagaagguuuuuacaaagggaaggacagucucacuuuucaugccaccccuacauuaguaccuggcucaguucuaauucacgcuagcaacauacagugccaacugucucucauucagggcucuuucuaucaaaguuccugaacccaguuccaaguggccccauccagcauuuuggaggguggcucuucuuccuguccuggcagaucaggaaggucugaaauagaacauaaucaggccugcccugccccuucucccaacacagcugccaugauucacuuccuguucccaauagucauuuaaagaggggucggcaaacuuuuuuuuaaaaaguuugauaguauacacauaaguaugcaaacuuaguuugagaguaaauauuuuaggcuuuauaggaucuaagguuucuauuccagcuacugaacucugacaauguagugaugaagcaaccacauauauacuguacagaagugaaugaacauaacuauguuucaauuaaacuugauuuaaaaaaacaggcagugggcagggcaugguagcucaugccuguaaucccagcacuuugguaagaugagcggggaggauugcuugaggccaggaguucaaggccagucuuggcaauacugcaagacccugucucuacuuaaauaaaccauuaaaaauuuaaaaagcaaaagacagugggccugucugccagaauuugccaaucucugaucuaaaggauaauaggagcuuuuauuuuauuuuauauuucauuucauuucauuuuucauuucauuucauuugauuucauuucuuuuuuuauugagacagggucuaccaggcugucaugcaguggagcaaucacagcucacugcagcuucuaccuucuagccucaagcaauccucccaccuuaagucucccaagcagcugggacucagacacaugccaccaugccuggcuaauuuuucucauuuuuuuuuuuuguagagaaggggucucuaugcugaccaggcuggucccaaacuccuggacucaagccauccucccacuucgcccuucgagccuucuaaaguacugggauuacagacgcgagccaccgccccuggccaagagcuauuuucaagcagcuuccuccugaccacuuguaguuaccuguuuuaaaaucuuaggcugucuaagccucaccaucaacucuugcacauuucuaucuaauuacagggcuuacauuauuuuucccagaaucacaaauucauguauuuuggauacgcaaacucaagagugagggacccagcuagcauacagagauucuucauguuggaaaggauuuagagaucaucuaguccaaccucccacucaaugcggacguuaucuagcaaguaguuacucagcuuccguucaaacacuucuaaugacaagaaugacagucacuuccucccaagacaacucacuccaucuuuggacagcucuaagguaagauacccuacuuauuuuucuucuuggcacauuuaaccaccugauuacuuguaaauuuauuuacauugauucuucuuaccagaaaguaggaugcaugaggucagaaguguaguuuuuuguguuuguaauuuuuuuauugcuguauuccccgccccuugaacagugccuaguacauaaagaguauaauauaguuguuuauugggaaggagggagggaggaagagagggagagagggagggagggagggagggagggagggagggagggagggagagagggagagagggagggaggggggaaggagggagggagggggggaaggagggagggagugaacaagcuaacaaaacaaugcuguauucggggaauuuaauucagcauggcugacaccagagacacaaggggaagagcaauuaacugguaaggucucugugguagguuugaggccccugaaaugucacaguaaguucagaggcugaggguguacuguuugaggaacauucccuuaucuccuuuccuuccaagcccccacaacccacagccauuccgaugguaaacaucuuuuuuucuuuuucuuuuuuuuuuuuugagacggaaucucguuccaucguccagguuggagugaagaggcacgaucucagcucacugcaaccuucguuugcuggguucaagggauucucgagaacugccucagccucccgaguagcugggauuacaggugugcgccaccacgcccagcuaauuuuucuauuuuuaguagagacagguuucacuauguugccaacacuggucuugaacuccugaccucaagugauccacaagccucggccucccaaagugcugggauuacaggugugagccaccacgccuggcccaaugguaaacaucuuuuaaugcaucuguucucugaggccuuuucaaaccauccuuccccgcaagagaaaugcaccauccuaaauucuguagaugcuucuaucacuauauccaugauacuuaaaauaucugucauccucugcugggcucugagagcagggacuguguuaucuucauuuuucaguccugggcacugaauacagugacaggggcaagguaggaaccuuauaaauguuuuguaaauaaauuaauguaauaguuuuauuguauucuguacuggccaaauuuacauaaaggggacuauuuucagaucuaggcacuacauucuaggaaagaugcuuagccuuuaugccagaggcugaaaugcaggugccaaagagaucaggccaaugauuuaaaugaguuaaagggccuagaaggacuauggcuaagaggggcuaugcccuacuuuuauauauaaucucuuaaauguagccaaugaauucagauuucaaaaaagaggaaauaaaaagaauaccacuguauagucccuccaaaacauacaugccugcaaguggauaugggaagcaaauuugcaaccuguauuggacaaagggauuaaguaagagaguaacacaaucagaacugcaguuuuugaaaggccauucuagcaggauaaacuagggugcuauuguaauagucaaggcaagagaugggauaagggccugaaccaggacaguagcaaugggguaaaagggugggauggaugaaagaugaccuggucugcccaguucuaauaaugaaguccaagauugcaugaacgaaucugauagccacaguaccaauuuguagguucauacuggcuuuguuuccaaauaaacuguuaaaucucauuuuuaauaauugaaauauggggcuuaauucuuuugcaggcaacgugauacaaugauuaaaguuuacgaacucugaagccaggcagccuaaguucaaacccugacuuuauuagcuacuagcugugugaccuuggauaagucauuugaauucucuaugcuucaauaccuauaagguuaugguauguguaaauaaguuaaugcaagaauugcuuagacuaguaccuggucuauaguaagugucauguaaguuucagcuuaaauuauuauuuauuauuuuuggauuucaacuucuuaguuucaaucccuugacuaaauauucucuacacugucuagccugcaaacauucgcuauuuaagucucauaggcaugucuuuucuauaucuucauccaaauugauguucaaaaacaaaauauaaccaaaaucauuaaaaacaccuccuauagauuaacacugaucuauuacaauuccugagugcaacuauucaagaagcuccaaagccagguaaaauuuuuuuuuuugucuugggaucacaugagaaaacauuaaauaccuaauguuagcacuuaagacacauuaccuuuguagcacauuccaauccuccagcgaccuaggaaucuuuccaaaaaugaaaugcucugauauauauaucaaacugcuauaugguaauuaucucuggauaaugugcuuuuuuucuguuuuugcuuaugucuauucucuaauauuuuuauacugaacuuguaccgaucguuuaaauaaaaucauggcaaggcuuaaagaaaaaaaagaauuguuaucagcuagcaugauuuauucuuagugaacacaagcuggcuucuagggaucacuguucucauucuuugaucaaucaauuuuagaauuuuaccagagaucacugucaaguuuccaaugacauccucaaaccccugugacccagacguuaacuccaaauaaaucaaacaccucucaaaugggcacaguggcucaugccuauaauccuagcgcacuuugggaggcugaggcaggcagacagcuugagcccaggaguucaagaccagccucggcaacauggugaaacccuuucucuacaaaaaauacaaaauuuagcugggagugguggcaugcaccuguagucccagcuucucaggaggcuaaggugggaggaucaacugagccugggaggucgaagcuacaaugagcugagaucacaccacuauacuccagccugugugacagagugagacccugucucaaaaaacaaaaccaaaaauuuaaauuaaaaaaaaaucaaacaggucuauggggagaauuagaauuugagagccuucaaaguaugucuagaagccauugcuuucugguuagccaccacuaccacccagguccaaccuaccaucaucccugcccuggacuacugauuacugcaaaagcuuccuaacuugucucccugcucccaucaguguccauccuuccccacccuccacagucuguucucccacaacaaccagaguaggccuuuuaaaacaucagucagaucaagucacuccucugcucuaagcucuuuagugcaccucacuuagaauacaaugcacuccaaaggugucacauggcuguaaggcccuacaugaucuaggucccaucacucaucugcugcuccuucccuacuacuccaauccagccacacggccuccuuauggguccuuauacaugaccaguuacacucaucccucagagauuuuauaccugcuguucccucugccuaggaugcuuuucccccagauaucucccuagcuggacuccucacuucuuuuagaucuuagcuuaaaauaucaccucaucagaggccuuccuugauugcuguacauaaaggagcaaucccucagcuccccaccacuaucaccuuacgcugcuuuuuugucuucuuagcauguacuaucuaguggauguuauuugucuacucaccuguuuauuuauuuauaucuaauuauucauuuuuaucuguuuccacccauuagaauauaauccuugagagaaaggacuuuuucuauuuuguuuaaugcaguauacuuaguuccgauaacuaaagcguguaguaaguggccauuuuuugucaucagaacauuagccccaguauauagcaaaauauuuuauguguaauagguauguguaggcugggugcaguggcucacacuuauaaucccagcacucugggaggccaaggugggcaaaucaccugaggucaggaguucaagaccagccuggccaacauggugaaacccugucucuacaaaaaauacaaaaauuagcccaggcgugguggcacacaccuguaaucccagcuacucgggaggcugagacaggagaaucgcuugagcccaggaggaggagguuugcagaggcagugagccaagaucgcaccagugcacuccagccucggcaacagagcaagacuacgccuugcaaaaaauaaaaaaauacagggcaagaguuugccuugaauuuuuccacuccuucgagaagaguucuguauuaucccuaacuacaccuauuuccucagagggguugacaugagagcaagaggcuuuguuaagauuccuuuccuaugcccagucacugcuaugacgagaacccauuucccacucauucugagcuacccuauugcucuacuuuccuagggaagcuuucucuaacuaucauccagcuaucaggagcaaccaagaccaccaggucucuuggccacugaccguucaaguucucacuucuaucucuucuauuucauuagugcucuccucugccuuagccaacaccaaccaauaaaauauuggcacauaaaauccauaaauggcuaggaaaagaaccuaauuguugaucaaaagguuuuguauuuugcuuugcuuuuccaagguuaaaucagucacagccucaaccaaaaaguaacuuucuuaaaagggaaacauuauaguguaaugaaaauaacccacuagggugguggcucaugccuguaaucccagcacuuugggagacuaaggcaggaggacugcuuuagcccagcaguuugagaccagccuggacaauacagagacccagucucuacaaaaaaauuagcugggcaugguggugcacaccuguagucccaguuacuagggaggcugaggugggaggaucaccugagcccaggaagucaaggcugcagugagccaugaucacgccaccgcccuccagccugggcaaugggagcgaaacccagucucagaaaaaaaggaaagaaaauaaugcagguuugaaaccuaguucuacuacuugugugaacuuggaagaguuauuuaaccucuuuaagcuuguuuccuuguggugaugacaacaguacuuaccucacaggguugguagggcgauaacauguccaacaggacugcgcccgacauagaguaaauauucaauaaaugguagcuacuucuuaaggguggccuaauucuuacgguugcuaacuucaugcaaggauuuuucacccucaucagguugguugguuaaguacucagcauaguauuugguucauaauaggccaucacaaauacugacuuuccuccccacuuccaguaguggcaaaauuauaguggcuucagaaaccacccaauucuauugguacacccagguuucacuguacaacauacuuaccauguagguaauucaagcuuuccgucaauacuuccggcggcucucccuaugcuugcuguuuuggaaacagucacucacucucuuucaaaggcaguugucucuugaccuggauagaauauaaacagaauggaagagauagguaaugcaugaaucauaccaagacugaggugacccagagggcugucccaaagacuuucacauacaauucacugucagcaaggggccaagguaagaucugcaucuagauccugacacuaaaggaaccuggcuaagcuggcuaugucucucucaggaaagucaagaaagaauuuggcuguaggagacuuccccuuuccuauaagaugauaugguccuaggguagaacccacugucuuugcuuaaauuaaaacacccgaacauuccucaacagucuaaaaauguacaugacaucuuacagcuaggaagcaucucagaaaucagcuacagguugagcaucccugaucugaaaaucccaaauucaaaaugcuccaaaaucugaaauguuuugagugcccacaugacuccacaaguggaaaauuccauaccugaucucaucugauaggucgcagucaaaauacaggcacacaauacucagguuuauucaauguccccuggggaaaaauaaaauuaccuucaggcuauauguauaagguguauaggaaacauaaacgaauuucauguuuagacuugggucuuaucccaagacaugucacuguauacaugcaaauauuuuuuuuaaaaaucugaaaucuaaaacacuucuggucccagggauuucggauaaggggauacucaaccuucaguuaaauguccuuguuuuacagaaggaaacuaaaacuuagaaagggugagucacacaauuauuuagcagaaaagcaaggauucuacuaaaaauaagauguucuagaagauaggaaaaaaacaucugcggaguauuuaccaacccugagcacuaugcuuuauguuuuauauaagacaauaagaagauaauguuaccucuacuuuacagauaaagaauuuaaguuucaagaagugacuuguccaaggucuuacagcuuguuauuaaaugacagaguuuaaacucaagucugucugacuuugaaagucccuucaccaugcuggcucucauuuuguugcccucuagacucgguccucaaaagagcccugaaccacccaauaucaauuaaaacuaaaaauagagcuuuucuuucugcaaacuuacccuccaguuuugaaacaagcaggcuucuacaggagaguugaaaagccuaccaucccauugaaucuuaccccuaaaauuagagaagagcuacuacagauggaagaucugggucaaacuucuuguguuaucuuacucuugaggaaaauggaaagguagcuucuaagcuagugguaaaccuaaagcuuuuguacaugaucuuacaaacuauccucccuucuuucaucacaacugccucccuuacacaucccugcaagccaccuugugacugccuuccaagacuauuggucccuuuaauccaacuuccacaccuccaccaaaacaugcacacaugcacacauaccugcaccugcgcgcaugcaugaacgcgcacacauacacacacacacacacacacacacacacacccaucccugccucuaucuucccagagagcaaggcggcuagaauuacaauggacaaauaaugagaguuuuuuaaaaacagcuuaaaagaugaggggaacaguaguaacucaagccucaagagaauaaaauuugaaaagaauuuuuuuuuguagugauggggucacacuaugucacccaggcuggucugaaacucgugaccucaagcaaucuucacaccuuggccucccaaagagaagaguuacugauaguaucggccaggcacggugacucacgccuguaaucccagcacuuugggcggccaaggcgggcagaucaccugaggucaggaguucaagacaacccuggccaauauggugaaaccccaucucuacuaaaaauacaaaaauuagcugggcauggugacaugugccuauaaucccagcuacucaggaggcugaggcaagagaaccucuucaaaccaagaggcggaguuuguggugagcccagaucgcgccacugcacuccagccugggcgacacagugagacgcugucucaaaaaaaaaaaaaaaaaaaaaguuacugauaauaaaaacagcuagaaaauaaguauaaaaaaggaucuaggccaggcacaguggcucaugccuauaaucccagcacuuugggaggccaaggcaggaggauugcuugaacccaggaguucaagaacagccuggacaacaacaaagcaaggcccccaucucuacaaaaaaaaaaaaauuuuaauuagcugggcauggugaugcacaccuauaguccuagcuacuugggagacugagacgggaggaucaccuggagcccagaaguuugaggcugcugugagccacaguuguccuacugcacuccagcuuagaugacagagugacgcucuauauuuaaaaauaauuuuaaaaacgaucuauaccaaggcggcacccaagagauagcuuagguggaugugggggaagcuuuagcucuccacccucugcuuuuaaaaaauaaucaauggaaguuaaaguaagugugauugguauucaaauaguuuuaggacaguuccacagacuuuccguccuaccccaucaccaccugucucuuucccccuccccacccaccuuacacacacaacacccacacacaaacaccgcccccccacacacacacucaucuucuucugcauagccuaaaaccucuccuacauaaaaauucugaacucuaagaaauggucacauaaaucuggucuaucuccccuaaggucucugcagcccuaacagugauagcagcgccccugcuaaaaucuacugucccagcaccuaccaccuacugccaaauuugcugacauguuacuaaggcccaggggcuuuucucuucaaaacaagacagaaugcacugccaaagggaaagaggaacuccagcuaauccugauuuguuuucaacugucuacguucucucauauuucuaagggguagaaguaagcaguaacugauuucuuucuucugaaugccauuuacuucuugcuuccucagcguacuugcccucuguccccaaaacaagaggaugacuguaaacauccucaaauuccuuagugaugcugcuucagagagcuuuccaccaugacagauccauccucaucacuucccucaagcaucucuucuggcacuuauuguuucuguuacuguugguggugauaguggugguaguauguguguacgugucugucugccuagaagcagagacugaaggauccuuacagaucacagaguccaaccaccuccuuucccagaggagcaagugggucccagagaggaaaggagacuugcccaagcuuacaaaacaagcucaagugaacauuuuugucccccaaacacuuugauaauagauaaaaaugucaguaagaaauucugcuuucaguaugacccucccacagacaacaacuauacucuggauaaaacacaaaaacuaucugaagugaacaagggcuggcagauuuugaaaauaaguugaaaguuggaagaaagggcugacauggaaugaacuccucauuuuuggaucucuagccugaggcuggucuagcugaaguuccaaucaaaaaacaaacccuaggcuuucuguccugaagaaauagcccagagcagccacagaucauggaaguaagaaaaaaaagagcuagaaaaggagagucucagguucuguguguaaauucuacccagucucuggcugaacccugagccaugcaagcauagggcagaauccaaagaccucaguuaaagagaaaagaacugaacugaaauuugaacugcgacccacugcaggugugacagaguuugcaguuuugagucugaguuauugucuacuaaauuaaaaacaucaacagaaaccaaagucuccacaauacaacauucacagugugaagaauacaauuccaaauuacauaaagaacuagaaaaagcaucuggacacgguggcucaugccuguaauccuggcacuuugggaggccaagacaggaggaucaucugagcccaaaguguuuuugagaccagccugggcaacacagugagacacugucucuacaaaaaaugaaaauaaauuuaaaaaaauuagccagguguggugauacaugccuguggucccagcuaccugagaggcugaggcaggaggaucacuucagcccaguagucaaggcugcagugagccauguccacaccacugcacuccagccugggcgacugagugaaacccugucucaaaacaaaacaaaacaaaaacaaacaaacaaacaaaaaacaccuagaaaaauuaaacccauuugcaauuugcaaaggaaaagacaaucagcagagggcaacuccaagacaacccagaugcugaaauucucagacaaagauauuaacagagcuauuauaacuaagaucaaugagguaaaagaaaauaugcucaaggccggacacgguggcucaugccuguaaucucagcacuuuggguggccgaggcaggcggaucacgagaucaggagaucgggaccauucugaccaacauggugaaaccccgucucuacuaaaaauacaaaaauuagccggguguuguggcgcgcgccuguagucccagcuacuugagaggcugaggcaggagaaucgccugaauccgggaggcagagcuugcagugagccgagauucagcuacugcacuccagccuggcgacagaacgagacuccgucucaaaaaaagaaaaaaaaaaaagaaaauaugcucaaaaugaaggggaaaacaguaaaucucagaagagaaacugaaaaaaaaaauuuaaguggaaauuuuugaacagaaauacaguaucugaauuuuuuuaauucacugaaugggcuuaaggacaaaauggagaugacagaggaaagagucagugaaauguggaagcagaacaauagaaaugauucaaacugaaacaacucugggucauucucagucucuagaaaaaccacccucagacccuuuacuaaaguauacacagggauaauuuucuguuaucagaaaaauugguaucagagagaaacagaauaacuugggaucacagaguuuucuagugguccuaaauuauauaggaagcaaggggaaaauaauuuuauuuuuccuccuauaauugcugaaguagcauucaggauuguucaggaaaaaagccaggaaggauuuuaauaauuuuucugcccugugcagucucuucaccaaaaagccaacaugguaaacaggccgauggcaggaugggguggggaccaaucaggggguauggggcuaaggaagugccagcagcuugcuauguaugaaccaaccuaggugguuuuaaaagcagcuucccugaaugccaucacugacugagucgcuucucacauucaagucacuucauguuggaguucagaacacuccagauaaaaguggaagaaaaaacauaagcugcagaagacaugucaauuucuuuaaggccugccuuuugcucacuucccuccucccaaccccacuugccaacaagaaggaaugaagagaauccagagccagugaucuuuucugacuaaagcgggaaacugagaguaagacaacgcacccucuaaguguagagaaacuuggauggggagugagaaacccggguggcggccucuaguucuaccacagacauuguuggaccucagaugugucuuuuacacuuucugggucucagcuucaucagucaaacaaaaaggccagacuaaaugauauuuaacaaugauauacuauuguccuuuccaauaacacuaugaaugacauccuuaaccaugcuaucuccauuugcccuuguagaaacuauaaacagguccgaaaagaucuaaguagaggcauaccauuugauuaauuggaguaccucauguuauauaaauuauucaaacuuuuuuaauaauuuucuauaagucuugccauuaauacuuaaaucgcaucaauaauagauauuucaguaccuaucuaugauagaggacugcuguaaaauaaugucuuucaacugaaagugcuucuaauucucccagaauaacuuuuuaaaucuacguaaccuuuaggaugagaaggcaaauacucuuaucucauaugacagaugagcaaacaaagggacuucugagaccuuuuuaggaagcuaguaacagacaaacaaaacuagaauccagcaaucccaucucuaugugucagguuauuuuucaccuugccaaagaaaccuuaccaaagaagaguauaaacaagaucagaauuagaaagaacuuaagaacuuuugugcacuuugggagugcuuauuaauaaauaauugauaaaacuagguugagauuaauguaucuauuugaaagcuggcacucaaagaaccggcucugcuacuuccucuuuuuuuuuggagacaaagucucgcucuguugcccaggcuggagugcaguggcacgaucucggcucacugcaaccuccgccucccggguucaagcgauucuccugucucagccucccgaguagcugggauuaccggugcaugccaccacgcccagcuaauuuuuguauuuuuaguagagaugggguuucaccauguuggccaggcugguucucaaacuccugaccucaaguaauccacccaccucagccucccaaagugcugggauuacaggcgugaaccaccacgcccggcccugcuguuuccuuuucuaaccaguggucuacaauugagacuaggcuuccuugcccauguuugugaaguuuagcaacagaaucacaucuaaaauuguuauucaccuacggagagaaaguuggccaaggccaagcacagugccuaaagccuguaauuccaacauuuugggaagcugaggcaggaggaucacucgagcccaggaguuugagaccagccugggcaacauagcaagaccccaucucuccaaaaauaaaaccaggccaggugcagugacucacgccuacaaucccagcacuuugggaggcugagaugggaggaucacuugagcucaggagaucgagaccagccugggcaacauagugagaccuugucucuuaaaacaauuuaaaaauuagccaggugugguggcguaugccuguagucccagcuacucggguggcugaagugggaggaucacuugaucuaggagacugaggcugcagugaguggagccacuauacuccagccuggacagagugagacacuguuucauuggccaggcauggugguauaugccuguaguccuagcuacucaguaagcugagacgggagaauugcuugagcccacguguucaagguuacaguaaacuaugguuucaucacugcugggugacagagcaagacccugccuccaaauaaauaaaugaaugaaagaaaguuggccaaaucagaagguguaaaaaaguaaaagaccacuggacuguuaaaaaaaaaaaaggcaaagagaagaaaaaagagaaaagaaaaggaaaagaaaagaaaagaaagaaaaguuugccugugugaaagugauaaggaaaauguagaguugaggaucaguuuuguuguuauuuuuguuuaaugaggguacuauccuagcacugucugucacauguacgagcugcaagucuuaggaggugcaagucacccaaagguuucgaaucuuuuuaccuucacacucaacucagagaaugugacuucccuuguacugacuguuaagugcccagagcaucaaucuagaaguuuuuuguuuuacaugcaucucaucucccuuaggagaaguguaucucaucucuuaaaauggaagauuaaaaugcccuucuauauacuuggugguaucagaagaagaauacuaagcuguaccuauuagagagccugagugaaaaagguuuucugcugcuauuuuaauuugaaggcauauuuuacagggucacuauuauuucuacccccuguaacaaguuuauuuccauuuuauugcuucuagggaauuucccuuugucucuauuccacacucucucuccauccugccugcugcccuggcaacaugcuauaagggaaaaccacacaugggauugaaagucagauuaucuggguucuauucuaauucagucacauauuacuuuaagugauuaaacuucacaaccucaguuuccacaacuguauauagagauuacaucuaaacuucaugggacuguuguaaggauuauauaaaaauauacauuaaaugccuaagcacauaaugccugaacgaaaauauacccuacacauauuaauucaauuuucuuuucaucacuguacacauucuuuuuuuuuuuccucucucucucucucucucucucccccccccccccccacaaucaggaagcccugggggggggggcggggggggggaacaccuugagaaaguaacuugcccaguuacagcagaaauaauuuuaaauaaguacuaagagagguggauggguggggccagagguauaauaaggcagcauccaaaagggcaaggaagaugcccaagucagaauaaucaggcucugugccaguucugccucccaccccuaagcccuaaguuccuucuuguagcuauaacuaugucuaucuccuucuuuuacuaagucacacuugccaacaugucucacgucaaagucuacauuauuaaaaacaaacaggaggcugggcacaguggcucacggcuguaaucccagcgcuuugggaggccgaggcgggcagaucacgaagucaggaguucgagaccaaccuggcaaacauggugaaacccugucucuacuaaaaauacaaaaauuagccaggcgugguggcguacgccuguagucccagcuaaucaggaggcugaggcaggagacuugcuugaacccgggagguggaggcugcaacgagcugagauugcgccacugcacuccacccugggcgacagagcgagacuccaucucaaaaaauaauaauaaauaauaaauaaaaacaaacagucaugguggcuugcgccuguaaucccagcacugugggaggccaaaguggguggaucacuugaggucaggaguucgagaccagccugaucaacauggugcaaccccaucucuaaacacaaaaauuagcuaggcaugguggcacacaucuguagucccagcuacucaggaggcugaggcaacgagaauugcuugaacccgggaggcggagguuucagugaacugagaucacaccacugcacuucagccugggcaagagagcaagacuccaucucaaaaaaaaauuaaaauuaaaauuaaaacucacucacauucacacaccagguaguacaaugggcaguagaauccugaguucuacucuugucucuccaacuuacuagaauaguuuccucauuuguaacacagaaaugacaaugugucuugacuacaagauuauaaggaccaaacagaagaauguaugugaaaguacuuuguacacaauaaaacaugguuauugucauagguacagugggucuaccuuuggccaguuuagguguuagguuuuacuuuaaaaaggccucaguucuacaauacucuauuucugugauccaaggcugccuauuuccaguucaaguccucuucuuccuggcagcugaaaauuuuauauugucauccuaauuucacuugauucccugauuuuugcaagguuccucaaauuucucuaaccaaaugggcuccaugucuccaaaaugguaacuaaagaccacuagaacugaucaccucuaccuguccuuuugguucuaauauucuaagauucuugggccuauguucccaaugcacuuugucuguaucucuacuugagcaauuuucuuagucuacuuugcauuacagguuuaucugacaccaucuccuaaagaaaaagccacagguagguuguccuauguuguuuuauauuccccguagcaauuaacguggagcuucacaaaaguauuaguugaauugacuugaugcuaauuucucauuuuuuuauacuuacuaucccuacuacaccauaauuauagaccaccuuauucuuuuguacugccauuggccugguacagugugaaauaaacagucaacauuuuuuuuaacgaccugaugugacuagcucuuuuuuuuuuuuuuuuuuuuuuuuugagacaggguaucacucuguugcccaggcuacggugaaguggcacaaucacagcucacuauaaccucgaacuccugggcucgagcaauccuccugccucagccuccugauuagcuaggacauaacugaaagugaaagcaaguaugacaacucagaucuuaguuuuagcuuuaaaaauaacaagcuaugggugugaccuuaggcaaacugcuucauuucuccaggccucauuaagauaucucuuacaacuuuuaaacaaagucuggagaggauguugagaggaaucaaguaagaauaagcccuucugaaaaacccuagguuuaucucuaguauagcacuuaucauucuguauuauaauugucuacuuguuacucuccuguaccaaaccccgagcuccugaaaggccagaauuauguauuucaucucugaauccaagcaugugcauagaacguggcacacaguaacaguucaguaaauguucaauggccaaacuacugaaaauuauaagugccuauacuuacgaagacucuuauguauaaauggacuuauauaaacuuauaagaaagaauaauucaucucccucauguacaacccuuucaaauaacauuaaauaaaaguauuuuucuuauuaucaccagcucaaguccagguuuuguuuuuuguugguaguuuuuuuuuuuuuuaaagacagagucgugcucugucaccgaagcuggagugcgguggagcaaucguggcuuccugcagucucaacccccuggacucaagcaaauccuccccgcucagcucccagaguagcugggacuacagggaugugucaccacaacaagcuaaguuuuguaaguuuuguagagaugggguuucaccauguugcccaggcuggucucaaacuccagagcucgagcaauucacccaccucagccucccaaaaugcuggaauuauagacaugagacacggcaccagccuaggaaguccaauuauugaaugcccagaaucaucugaaauucaggaucccuagaagauauccugacaagggccucagaagugcaugccuccuacgcucuaaauaauauaccuccuaauaaauaaauaaacauauauauauggagacaggucucucugucacccaggcaggagugcaauggugcaaucauggcuuaaugcagccuuaagcuccugggcucaagagacccucccaccucagccucccaaguaucugugcaccaaaaugcccagcuaauuuuuuuuauuuuuauuuuuuuguagagacagggucuugcuauguugcccaggcuggucuugaacuccuggccucaaacgauccucuucucucgaccucccaaagugcuaggauuacaggcaugagccacuacgccugacaauaauaccuaaugcuuauacauuauuucauaguucaaagcacuuucacauccauacucucaauccuuaauaaugaccccauaaggauauuaucaaauucauuuuauauguugaagaaauugaggcucauauuuuaaauacuuugcuaaccuaaggcaagcugauaucaacuaaaggagggcuuucauauuuagccucucuugcuucagugcccaaaagaggcagaaacaagaacaccaccaucuccacuccccuggccucuacaaacgagguggaucagaccacuaucugcuauugcuuuacugagcugacuaccucuuaaguuuuucucgucuccauaaaaaucaguuacccagaguauuuuauuaugucuuaagcaaaaaauaagaccagcccagggagaaaaauccccaagauuacaaacaaccacauuuauaagcugcuggcuuauaucuuuauaaacaaagcuaaaaaaauaaggggaaaaccugcuccaauggggagcuguaaacccuacugaccaaacagccccuuggcacuuagguagguaguuauauacagcuaauuuagucuguaauaguuuuuguacuucuucaauaauuuguacugccuauuguuuucuccauaccauucuaaaugccucaagagcagagaucacaucuucuaguuaauuuacaucuguuccuguacaaugaccauauaguacccaaaccaaaauugguuuuucuggccuagaaauuuauauaaagucuuauccaaauuuaaaaauuaaaauacauaggcuaggcacagugguucaugccuguaaucccagcacuugggagaccaagacagaaggaucacuugaggccaggaguucaagacuagccugggcaacauaguaagaccuugucucuauaaaaaauaaaacaaaauuagucaggcguaguggcacacaccuguggucccagcuacuugggaggcugaagugggaggauagcuuaagccccagaggucaaggcugcagugagccgagaucaagucacugcacuccagaugacagagcaagacccugccucaaacauuaaaaaguagucugggcaugguggcucacgccuguaaucucagcacuuugggaggccaaggcagguggaucaccugaggucaggaguuugagaccagccuggccaacauggugaaacccccccucuacuaaaaauacaaaaauuaacugggugugguggcgcacgccuguaaucucaguuacucaggaggcugaggcaggagaauugcuugaacccaggaggcaaagguugcagugagcugagaucauaccacugcacuccagccugggugacagagcaagagucugucuuaaaaauaaauaaauuaauuaauuaauuaauuaauuuuaaaaagacuuuaaguaauugacauucuucaacugaguaacauuuauaaaaucaacaguuucuaauaaagaaacaccaaaagacacuuaacaccuacaauggugccaggcauacauuugagugggcacucaauaaaguugugcugaaugaaugauaacugagagcuuaaaauccauuaaaaaccacuuaaggcagaauaaaauauccaggacaagagccaaaagaaaugacuagagacugucaaguuaauuggaaaaauaagauucuaagguaguuccacucaaagucauacuuaggguaccacaagugaacacucuggauucaagcaccacauuauauguacagccagagugaaugcauuagggcagugacuuagcacgaggguucucucugcucagaccagcagcaugcaaccagcagcagcuugccccuucccccaguuaguccccauuaccaacgcccugaagccuagucacagaacuacagcaguuaagccaggcaguacuaaaaguuagaaggaaaugagcaugccaccugacacuuuucuggcacaggcuaagccgauuaguuuagguuacaaacacaacuacaagauuccaggacacugaagaaacuacucuuuuucugcaaacuaaaaauaacuuauuaaaacgggaguguucuucaaguauuucugcccugccagcaacccaaaguuccauuuccucaaauccuucuuagucuuauuggauccaagucuccacaccucccccaucuucccaacucuucauccuaaugcuaugaacacaguaaaagaccuaaacuccuuuccuaacucaugcuuuuaacguuucuuuucuaauaagcaaucgugcagaacuucuauggcuccugccuuguguagaaccacaacuggaagacaugcugagcuucagcaaagaauaaugaaaaacaaagaaaaacugaaggacaagaugcagcaugcucgggaagucagcuaaaugcuuuucauucaggcaggaauagaaggagccucaccuaccuagaagaauacagcauaaggacaaauggugucuaguauagagcuagacuauacuuuaucacuuuagaacaaagccaucaagcguguucuagagacagacucauguccaaauagcuuuaguauccuauaagaaucauuaggcuggccgggcgcgguggcucaccccuguaaucccagcacuuugggaggccgaggcggggggaucccgaggucaggaguucgagaucagccugaccaacacagugaaaccccgucucuacuaaaaauacaaaaauuaaccaggcgugguggugcaugccuguagucccagcuacucaggaggcugaggcagaagaaucacuugaacccgggaggcggagguugcagugggccaagaucacaccacugcacuccagccugggcaacagagugagacuuugucuccaaaaaaaaaaaaaaaaaagcaucauuaggcuaucucaagguugaagugacauuuuucaggguuaaacaaacucccaucauuuaagccaaauaaaucaagauugaauugcagacuuucuggucauacagagcugagagaaggacucaaauccuacuacuaggaaguggaaauuccaaggaagcuagaaaacccuguccucaguagcucucccugcucucaggcccugagguaagccagcauuuccuuuccaaggucaaaaauuaaccauagacuuugaacaucucugugcuuugcaacagcaccaggaaaaugccacaaugcuaagccacccuauauagaccuaagacauuugcuauucuugauuauucccaagaguagucacuugggauacucauuaauguacuuucuaaagauccaacuuucaaaguagucuuuucucauucuuauuuuuaaccuuucaccaucucucuuuaaaaaaacaaaaacauucagaugucuuagagcacugaagaaaaagaaaacaaaaauuggcuuaucuauauaaucuacacucucagaaaaauuccuccugaaaaaaaaaauuuuugcccuaagaccacccaagguacacaccaugguaaaguuucaaugcagaaucaugcugugagcaagagcaaauggaaagcugcagcccuucaucaaacagcauuagaaccuuccaagauucgugaaaucaaagaauaucagagcuggaaagauacuuagggugcaauaaucuagucuagccuuucauuuuaaagauggggaaaauaaagcccaaagagaggaaacggagucuugaagcaaagcuggaccuaggaccuaaguggccagacucccaacucugguaucuucugccacaccauaccucuucacaagacugacuuuaagggagucaaguggcuaaggacaggguaggcaaaagaaaguaaacauaugguaccaagcaaagaaaccaacucucugugaauucuccucuguugcuuuguggugugacucagggagaguuauuccuccuccauaugccuuaauuucaagaguuuuucucuuaaauauuucauaauuuuacuaagaagcaagauacaauuaucacucaugccuuaauggugccucccaaccacuacacaggugaagucaaaaacaaucgacuacuagaauggaaagacuacaagaacccuuaaacagaaagauuaacaucauuuuggggcaaggagguacauuuuuuuaaaagauuacucaacuagauggcuccacugaaggaauccacaucaccugacuucauauucuaguaucuagacuucaaggaaaauaaguucacuuuucugacucuugguuucuuuaacaguaaaaugaaaccuacagacuuucguucauucuaaugcccuuucaaacucuaaaugaccuaaccuugacaggagccaugacaguaaaaaaaaggcaagguacgaaaguguugagcuugcccagguuuggagguuugccccaucauuuaagccaaauaaaucaagcuugaauugcagauuuucccaucauacagagcugagagagggacucaaaucauacuacuaggaaguggaaauuccaaggaaguuagaaaacccuguccucaauagcccucccuggaagcuggcagauaugcuuggguaucugcuggccuaguccuacgcaugaguccuagcagauaugcuuacaacccgacaguaucaguggcaucguuaaaauuaaaauggagaaaacagugcauacuuucuucaaaaguaugcccacuaaaaugauggcugcgaccccuguaaggaucuagcuggaccaucugcagaugguuuaaauuugccauugcugauuuuuuuucuauccccuaccuugauaucaaguauuuagugucuuacuaugaaguaaaucauauacuuucucaauauccuauucucuuuguuuuucucuuucauuuuaagugcauguuagacauuuaaagaucuaugaaaaauaaacucuuaguaacagguaaauaacuagaauuuucaauaaacacggaaaaaaguguugagugugagcaagcuuuuuacuaaagcacaucagucuauacagccaauucagcauucuccauucagaggcugccucuucccagggauguggcuaauagugaaaacacaaaauaauguaaggaaagaggacaaagguuucauuuucugcugucucaucgacacaucuuaacauggaggacacaguauaucagagauuaaagccagaaguuaaaucaaugcaaaaggaaaugcaagcuccaaugucaauuaugaaaaguaacgaaucuuaaauaagcaaguacuugccugccugccugccugccugccuacuaagacuggguugaagauuauuucuaucgacaagguuacaaacaguaauuuucaacacuucauauggauauacaauuaccuggguacuuguuaaaauuacagauuccucgguaccauuuucaaaucuucugauuaaguggaucuguuacagagcccacagacugugcauucugauacagauaguccacagacuauacuuuuuaaaauacugugaaguguguaugggagggcgaucauuaggucuccuggacacauaaauauacgucuucuggaaugguauaacccacaguaaaauauguguuccaaggauggcaugcaggccaauuuuuaacuguaccagacccacuccccucccuucuaccuccuaaagcaacuucugaagucagugcucucucaacucauauaaagggcccuucuaaauagugacuaaaacacacuauguuggcuccuauuuuagauccuauuuuaaaacaagcaaggccgggugcagaggucaugcuuguaaucccaguacauugggaggauaaggcaggaggaucagcugagcccaggaguuuggggccagccugagcaacauagugagacccaacauacuugcuucuccuguuuuacuucucuucaugguucucaguauuuccugagauucauuauauuuuauauuuacuuacacucucucucacugaauguaagcucuauuagaaaaggggcuuccccaccacuaccacuauauuccuagaacccagaacaguaccuggcauaugacagaugcuccacagaaguuuaaauacgaagaaggcaccauuuuagaaaacaaaauaaguucuuagucuuacacccuguucaguuuauugaccauacugucagcuguaccuuucauccuggauggccauucuugcuuuugauguuuacagaauucaggaaagugaauauagguaccagcccagagaggcucucugcuaccugacuuucacuacucuaugguaaugugcaauuucucccgcaacugaacuacaacagaaguuuaaaugucuagccuacagauagauguuuccacaugccuuaaacuccacaggaaugaguugucuuuuacuaugugagaagucaaauguaauguuggcaaauaccagugugagagcuacaaguuucaacaaaagcagcacacuguauauuggcagucaaaaucacuucgcucuauucugcauuaggucagccaaacgcuuccugucaagacucaguaacucucaccauacauuuuugucuauucauuggucuaugggcaguaaugucuuauaaagcacacauuacuaagugcuuuauauacaucacccuauuccucaaaauaauucuauaagaguuauuauucucauuuuagagauuacaaaauugaagcuccaaggcacuuagcaauuugcaacuaauaacuaauuagcagggcugggauuugaauucaggucuaccugacuuuaaauucuugguuuuuuucacuguauuaguuuaauucuuaaggcuucucccaccaccuuccacccucugcacuaagccuggcacacagaaaacauuugauauuuacugaauccaugagaguuaaaaaggauaauuuaauucaaacucaaggaucugucuaggaucaaauucuucagcuccaauuuuaguuuuguuuuuuguuuuguuuuguuuuguuuugagacggagucucgcucuguggcccaggcuggagugcaguggcacaaucucaguucacugcaagcuccgacucccggguucacgccauucuccugccucagccucccaaguagcugggacuacaagcgcccgccuccaagcccagcuaauuuuuugcauuuuuaguagagacgggguuucuccauguuagccaggauggucuugaucuccugaccucguaauccgcccaccucggccucccaaaaugcuggaauuacaggcgugagccaccgcaccaggcccaauuuuaguuuuaaaaagaaaaaaaguggccgggcgugguggcucaugcuuguaaucccaguacuuugggaggccgaggcagguggaccaagaggucaggaguucgagaccagccugaccaacauggugaaacccugucucaacuaaaaauacgaaaauuagcugggugugguggcacgugccuguaaucccagcuacucgggaggcugaggcaggagaaucgcuugaaccugggaggcggagguugcagugggccgagaucacgccgcugcacuccagccuggugacagagcgagacucugucccaaaaagaaaaaaagaaaaaagaaaaaacuuaaguucauucaacucccuuuuaauuuuuaaaaaaguggaaaauacaaguuucucaguuaaaaaaaaaacaaacuggguuuauuccaaaauggaauccaucauaacauaauucauuacuaugggaauuuggauauaaagcaagugaaaucauaaaaagcagcauagcuuaguguacuaagacauggaugugaaguaaaaucugaauuuauuaauaaguuucagcuaaaagagauaaauguacuugccuccccaucuaacaaucaugcucuaaaguucaaauguguuaaugcuuauaaaaacacuucauaaauguaaaguguuauacaauauuaauuauuaguguuaauugagccuugaagacagaauaaaagccucuaaggccagcauuauuaaaaccccauuauauuuggagcauuauaagguaaacaucuuaaacucaaauuaguuuauccuuaagaaagaaaggauguggcuuacccauuacuaaccuuuuuauaugucuaagugcuaugucuccaauuggcacuauuaagucuccaauagcagagaacugggauacagaccucaauauauuguuucacuuuuagaaggauuauaacccuggccucauugugggggagggacacuggguucuauaacuagauaauaauucccuccuuucaugcuaaggcacuuaucuauucagaacauuagaugucagaucuguaauacugauaaaaaauauuccagauuauuucuuccagcuauaaaagcugugcuucuuaggcggagccaauaaacauuaacagcauaagccuauauauugauuagucuuuccuaagcuaaagagaaaauaaacagaaaauaugcaacaaucuuuaaaggcuauagcaucacuccuaaugaaugucacaaagugcauuuaucgaugacauugcugagacugauaugaaaugauaaaauauuuuuaaagccaguggaucuggguagauaagagacuguuuagaagcuacugggauuguguguaugugguggggcauauuuuaaauaaugaucaagauaggacaaucucaucauuagacucaccauucucuuauuuucagcccucaaaaauuaaugaccauugccuuaucaaaacccagauuauaaagauggcaaugaggccaggcgcgguggcucacaccuguaaucccagcacuuugggaggccaaggcaggcagaucaccugaggucaggaguucgagaccagccugaccaacauggagaaacacugucucuacuaaaaauacaaaauuacccaggcguggaggcgcaugccuguaaucccagcuacuugggaggcugaggcaggagaauugcuugaaccggggaggcggagguugcggugaaccaagaucaugccacugcacuccaccuugagcaauaagaacaaaaacuccgucucaaaauaaauaaauaaauaagacaaugaacuucagaaucuugcaacacauuuuaacaugcacauagccuucuuauaauucaacauuuccuccaauccaucucgcaacaaaauccuccaacuauuccacuccuacuagagaaacaaauuccaucccaucaaauuuuccuaaggaaauaagaucacuuaaaagauuuuccuccccaguucauucauuuucugcaucuguaucuauauuuauauacguaccaugugccagaaucacaauggcauuguauaucugccagggcugaguuucaaagaauacaugugcacuuagcagacaauauuauaaauauuauaaauaaauaagcagauuuagaauacaggugacuaacacauaaguaagauguauaaaggguuauccacaauaacuacagauuagucuaaauuccuuaaugcaucacucaaagcccuggcaagcuggagguuaucuuuuuuccuucuauggacagacugauccacucauuuccugaagacaaauuacuucauguuauaacuuugcccagacauuuucccugccuggaauacccuuuccaucucaucaaaucuauucaagaaauucaaugcuaaucucucuucaguggaaccuuuccacauucacuauuuuuuaacucuaccuuuguugauaaccuacugacauucgguauauaagcauauauuacuaugauagauguacuguucuuuuauacaggacaugcauaaacauuuguguauguguuuaugucauaauacuccaaguaaaacacaaaacuccuugaaggugcagaacugucauuucuuuguauuuuuaccuguacaauauuaugaauauaaugguuauucaauagagaucuguuuaagaaaaaaauaaaagagggaaagagaggcgggguuauccuuaggauccaccaaguuaacaguuaucuuuuuuuuuuuuuuuuuuuuuagagauggggucucacuauauagcccaguauggucuugaauuccuaggcucaagcaauccucccaccucagccuggcaaagugcugggauuucaggcgugaaccaccaugcucaguccccaaauuaauaguuucuugaaauuaagcccuuaucaauggucugaauccuuccauuguuuuauggaguacuauuuguauucaucaaugguuuccuaucacuuaaaauaaaacucuacagaaucugguuauugccaccccuccuacuucaucuccuaucauauucuaccauucucucugagaccucucacucaauguuccauauacauacauuggccuccuggguccucacgucagccagcucauuuccaccuuaaggucuuucuaccuggggguugggcacaguggcucacaccuguaaucccagcacuuugggaggcagaggugggcagaucaccugaggucaggaguuugaggccagccugggccaacauggugaaacuccgucucuacuaaaaauacaaaaauuagccaggcgugguggcgggcaccuguaaucccagcuacuugggaggcugagacaggagaaucgcuugaacccgggagauggagguuguagugagcugagaucaaccccacugcaauccagcccgggcaacagagugagacuccaucucaaaaaaaaaaaaaaaaaaaaaaaaaaaagaucuuucuacuuggagcuuccucugccuucccucagaucuucccauggcagcuacugccuccuaauucaagucacaguucaaauaucauuccucagaaaugccuuagcugacaauccuagcuaaagcugcacuccucucacauuacuuccuaguauaugaaacuucucuuuuucuccaucucaaucugaaauuauucuguugauauguuuacuacuugucucucccaacuaguauguaaacuccaugaagagaagaauuuugaguucuguucaccacuguaccccagugccuagccuggaauacuagcugguaugcagaaggcagucaauaaauauuaauccaaaaaaaacgaguuuguuuccucucaccuaauacuguaguucuccucaggagcaagaacauuguuuccugcuccuauuuauucauuuauuuauuuuauuuuauuuuauuuuuugagauggagucucacccucucacccaggcuggaguacaguggcgugaucucggcucaccgcaaccuccaccuccuggguucaagugauucucuugccucagccucccaaguagcugggauuacaggcgcaugccaucacacccagcuaauuuuuguauuuuuaguagagacgagguuucgccauguuggccaggcuagucucgaacuccugaccucaggugauucaccuaccucggccucccaaagugcugggauuacaagcaugagccacugcgcccggcccacaccuggcuuauuuuuaauuuuauuuucauggagacagagucccacuauguugcccaagcugguguuuccuaccuuuaaucucccacagcaucuaacagacuaaaugcacugaaaucaccaaauaacugcucaacaaaugaggacagaaauaugguauuuccuuuucugacacccccuccaguuacaucuuuaagucaacaaauacucauuaaguaccuaccaugagucaggcagugagcuaggcaucauucuaauuucuuacuuuuucaauuugucauacucaucaaugauauucugaaaggucaaacaccuggucauaagcuaaagaauccuugacacugccauccccagucaaucucauuuuauugaacaaagaaaugcaacuaauuacagcuaccugcagggcaccauauaaacguacuaguuacuguuuaugucaggagaccacacagaaaacuuuacuguccaauucuuaauaugcgucucuuaucuacuauuguucuucaagagaacacuucuuguuuaaaaaaaaaaaaaaaacuauaaaagacauuccugagaaaucuggagacaucugaauaugggcugauaaagaaaaacaauuuuuuaggugugauaaugguauggugguuacauagcagauuauccuuauuauuuagggugacacaucugcagcuugucaaauuguucagaaaaaaauuuguugugauauauauagagacacagauacuaacagcaacuuaaguauaauaaggcaaacaguugacaauuacugaauuccaaugaauagucuaauaaguauucuaucaacuuuucuauguuuuaaauuuuucauaagaaguugcugagaagaaaauguuuauuuuaagaagauuauuaggugcaauuuucuagcuauaacuacuugauggucuuuaauacaagcuuuuacauauaauuagaccaaaacugauccagaaaauacuacaggacucagaaacugaaccacuaaaacgcaagaaauacugacauaagaaguaaggaacccaaggcaaaaaccugggcaaaagccuagacuaggucccuucuucuuaaccagccuugggcucagaaaagaaagacacucuauuuuggaagccugcuucuagaaagcacaacacaugaagacccaaucuuucagccuuauccucccaaggagauaagucuaugaugggaaacuaaacuacaaaaucacagugacgauauauacgaacagaucuuucuaagcucacaagcauuuuuaaaaauauuauuuaauuauuauugcuauuauuacuuaggcagauauuaagaacuauaaucacaaccgccaguguaauaauugauucaagcuaagauuaucaguggaugcuaaaaccauuugguuggaaaauaggauauuuauacucucucaaagucaccguacagauuucucacaaagggaaguagggaucccuacaacggaaagauaaaacuuaccaucaacaaugagacagacugggcgcaguggcucaugccuguaaucccagcacucuggaaggccgaggcgaguggaugacuugaagucaggaguuugagaacagccuggccaaaauggugaaacccuguuucuacuaaaaauacaaaaauuagccaggcaugguggcacacacuugucaucccagcuucuugggaggcugaggcgggaggaucacuugaaccuaggagggggaggcugcagugagccgagaucgugccacugcacuucagccuaagcaacagaacgagacuccaucucaaaaauaaauaaauaaauaaauaaauaaauaaauaaauaaagagauagacugacauuauaugacucccaguacaacacaaggggaaguacacagcagcaucuauguaauauuucuucccaaaaaugucuacccugaaucuaaguacaagaaaacaaucagacaaauccgauuuaugggacauuauaacuggccuggacucuuccaaaggagaauguuauuaaagauauacacacaaacaaguuagaaaggacugcucuagaucaggggucugcaaacugaaguuuuauaggaacacagcaacgcccauuuguuuaugaauaauuuauggcuguuuuucccucacaagagacaagauggcccacaaaccugaaaauaguaucuagcucuuuacagaaaaagucugcugacuccuacucuagauuaaaacagacacaaggccaggcaccguggcucacaccuguagucccaacacucugguagcccaagucaggaggaucacuugagcccaggagucugagaccagccugggcaacacagcaagaccccauuucuauaaaaaauuuuaaaaauuagccgggugugguggugcacgucugcagacccagcuacucaggaggcuaaaacaggaggaucacuucagcccaggagauggaggcuacagugaaguaugaacacaccacugcacuccagcuuuggugaaaaagugagacccagucucuuaaaaaauaaacaaggccagguguggugacuuaccccugaaaucccagcacuuugggagaucgaggcaggaggacugcuugagcccaggaguuugagaccagccugggcaacauggugagacccugucucuacaaaaaaauuuuuaaaauuagccuggcaugguggcgcacgccucuggucccagcuacuugggagaggcugagguaagagaauugcuugagcccaggaaguuaaggcugcacugagccaugaucaggccacuauacuccagccugggggacggugugagacccugucugaaacaaacaaaaauagcaguggaaauuaguugccaugcuuuuuuuuuucccaacuuuuaaguucagggguacauaugcagaaugcgcagguugguuacacagguaaauugugugccacagcgguuugcugcacagaucaucccaucacccagguacuaagcccagcaugcaguagcuauucuuccucaugcucucccuccucccaccccugccaugcuuuauuaaccaaugaaagcucaauacaaaaacucaauccccuggaguauguuucaagaagaaucugugugacaaggaacuaucaccaacaaaacaaauaccaauccacaauucuuuguuuggggcuaaauguguuuugaaauucaaaauuuuucaaacuuuggaaacuuaaggacuggggcagcacccaauaggcaaacacauuaauauuucuacaguuaaauaugugaauaaucauaauaaaaagugaaauaaagauuauaaauagccugcuucaauucaggucagguuuugccaggaagcaaauuacuuuauucauuuuaaaugcauuuuggcuuuuagaauuacauacaaagaacuauggauuccuuaggaauauucuacacuuguauucaaaccauuuaaucagccuacacuaguaccuacuuaugggguggaguuggguagacuucagagauuuuccaagagaauuguauuugugauuccaacauaguugcauauucuauugaagauucagaaaaaccacauuaauaugaacaagugguuaggaacaggcaugguacuggaauacaucauuuuaaucaggauucaaagcaaccagagagaacacggguugggauaguguaaaagcacucacauuggaccggaguugcuguacauauaucauagguagccaauucaagagcuuagagauacauguaacuguuuaaggcugcaaauaggucuuuaaaggaagagaauauuauuaaaauuuuaaauuaugcaucaacuuauaccuaaaauauguaacaaauauauguugguuuuacuugaugcuauaaauuauuagggaucagaauuuggagacaaauuacuauaacccuuaguugagaagcugguaaauucuugauauaacuccuuaaccagacuaacuuaguaacccaugacaaaguaguauacuggaaauaguggugaacugaaaguccaggagaccucaauucucaucucaauucugcuaguacuuaauuauacaaccugacccagaaacauaguagacacccagcaaauagguugcuaaaucaaugagcuuuuuugugccucuaauucaucauuugugucacagaacacuagauuaaagaaauuuaaagguuugguuuagcuauaaauucuuaaauaaaaaugcagguuuauucaaaugauuagaguuagucagaauuaauaacgacuaauuuuaaagaaacagacagggccaggcgcaguggcucacaccuguaaucccagcacuuugggaggcugaggcgggcagauuccgucuuaaacacacacacacacacacacacacacacacacacacacacacacacagaggguccuucauuaaagaggaaaaaacaaaaacaauuuuccaacaaacguaaaacagcauuacauagguccuguaguaagaacaaaugagagggaguauaaucugaucuauaacaugugccccccaggaccuuaucaacucaaacuuuaguauugugugaccuuaaagauuaguccaaaucauucacuuuacagaugagaaaacugacucugaaaaaauuacauaauaugcccaaggucauacucucuggccgcgacaaugacaggacuaaaacccaaaguuccgacgggcacgguggcucacgccuguaaucccagcacuuugggaggccgaggcggguggaucacgagaucaggagaucgagaccauccuggcuaacacagugaaacccugucucuacuaaaaauacuaaaaauacaaaaaaguagccgggcgugguggugggugccuguagucccagcuacucagggaggcugagacgggagaauggcaugaacccgggaggcggagcuugcagugagccgagaucgugccacugcacuccagccugggcgacagagcaagacuccaucucaaaaaaauaaaauaaaaguuccccaguucccaguuaaaugcuuacuuccuuucuuguaaucaaaggcuucuagaacugcauaacaacaauggugcuaucugucauauggcaaucacuucagucaacauaugcucugucagaaccucuaguuccacuauaucaucuuuauacauggcaugggcaaugaacucuaggcaauuaaauaaaaaaacccacauagaaaguauuuccaaauccuauauccaguaagagacgaguauccagaauauacagagagauacagagaucuuacgacucaauaauaaaaaauauccaacuaaaaaugggcaaaggauuugcacaggcauuucuucaaagaagauauacgaauggccaauaagcauaugaaaagaugcucaacaucauuaacuguuaggaaacugcaaaucaaaaccaaagugaggcgaggcaugguggcucacaccuguaaucccggcacuuugggaggcugaggcagguggauuaccugaggucaggaguucaaaaccagccuggccaacaugucgaaaccccaccuccacuaaaaauacaaaaauuagccggguguggugguaggcaccuguaaucucugcuacucaggaggcugaggcaggagaacugcuugaacucggaaggcagagguugcaaugagccaagauugcgccacugcacuccagccugggcgacaagagugaaacuccaucucaaaaaaaaaaaugagaugacacuucauccccacugguauggcuguaauaaaaaaaagacagacaauaacaaguguaagagaaugcagagaaacuggaacccucauagauugcuauugagaauguaacaugauacacugugaaaaaugucugacaguuugucaaaaaguuaaacauacagguacuauaugacccagcaauucuacucuaggaauuacauccccaaaaaugaaaacuuauguccauaccaaaacuuguagaaguauucaugacagccaaaaauugaaaaauguccaucaacuaauaaacagauaaacaaaauguauuacuguuacuauuaauuuaucuugagauggagucuugcucuguugcccagguuggagugcaauggcacgaucucagcucacugcaaccucuaccucccagguucaagcaauucuccugucuuagccucccaaguagcugggauuacaggugcaugacaucacgacuggcuaauuuuuuuuuguauuuuaguagagaugggguuuuaccguguugcccaggcuggucucgaacuccugagcucaggcaauccacccgccucagcuucccaaagagcuaggauuacaggcgugagccaccgcacccgaccacaaaauguaguauuauuauacaauggguuauuagccuuaaaaaaauaaaacaaaguacugauagauacuacaaaauguggaugaaccuggaaaacacuauagcaaaugaaagaagucagauacaaaagucuacauaugguaugauuccauuuauacaaaauguccagaauaggcaaauccauggagauagaaaguagauuaugauugccaggggcuagaauagcagagaacggagagugacugcuaaugaguauggguuucuuuugggggugauaaaaauguucugaaauuaaauaaugaugaugguugcacaacccugugaauguauuuuuuuuaaagcaccgaauuauacacauaaaaugauuuuuaugguauauggauuauguguuuguguguguguguguguguguguguguguguguguauauauauauauauauaaaugaggccaggcacaguggcucacgccuguaaucccagcacuuugggagacugaguucagacugccuaagcucaggaguucgacaccacccugggcaacggugaaaccucgucucugcuaaaaauacaaaaauuagccagggaugguggcacgugccuauagucccagcuacucgggaggcugaggcaggagaaucgcuugaacccgggagguggagguugcagugagucaagauggcaccacuguacuucagccugggugacagagcaagacuccaucucaaaaaaaaaaaaaaaaaaaaaaauauauauauauauauauauauauauacacacaucauauguauauuuuguauauauaauguguguguauauauauagauuauauauagauauagauuuuuuuuuuccacacacacacagacaccaaagcguacuucccacucauuucccauucaugcccucucugguuggaaaaaguaaaaugccaacacaaggugaaagcaucaaggucucaauucaguaucuauugagcaaggcauguacuauaaagugggaauacagagauagucugaucuuaugauauucaguuuauuauaaauaaaguacgcaaauaauuacaacacaauguguuaagugcaacaacagauguacaaagggcagaaggagguauaggugacccuugaacaacauggguuugaacugcacagguccauuuacagauggauuuucuucuaccuucacuaccccaagacagcaagaccaagccuuccucucccuccucagccuacucaaugugaagaugacaaggaagaccuuuaugaugauccucuuccacuuaauggauaguaaauauauuuucuccugcuuaugauuuuuguaacaauuucuuuagcuuaauuuauuauaagaguacaaguauauaauacauacaacacagaaaauaugugggucuaauauagugguucacaccuggaauuccaacacuuugagaggcugaagcaagaggauugcuugaggccaggaguucgagaccagcccuggcaacauagcaagaccucgucucuacagugaaauuuuaaaaauuagcugggcuugguggcacguaccuauagacccaacuacuuaggaggcugaggugggaggaucacuugagccugggaggcugagacugcuguaagcugugcucaugccacuguauaccagucuggagggcagagcaaaauucugucucaagaaaaaaaaaaaaaauguguuaacuguuuauguuauuggucaacaggaggccauuaaguuuuggagaagucaaagguuacacucaggccuuggagagaguaagggcuggguguauuuucaaguugagggaccacccuacuacuacccccacaucaugguguuuccuccaggaguccaagagccuugccauuccucuuggugcuuccuucaggaguugaagggccuggcuauucuucucacuccuguaguagcaccuauccagacucucugcuguuuucugacuuagggcaacuacaaccauggcugacaaaugguagcuacucacauggguggaagaaaggguacuacacauauuacacauauguaauacacauauuacacuuacaccaagcuccuggccaucucuuguggcuucaagcagaaccccaagcaguucaugaucaccuggaucuugcagaugcacaaccagugggccacgcccuguccuugaacuccugggagcugguggugcuaaugggcaacuugacucacaaugccaucuucaacuaccacugcaaugccuugugggaaaguggcauggcacugcuugccuggcugcucagagccuggugccagcgcuaaaaguccuuccugcccuuugaggccaccgagcugccuuucuagcccuggaccaccaaggaggagggcauccagcuggugugcaagacaggcaugcucgacuggaucuacugugagccccucucggccuccuuggaccccuugucccccucacaugagccaguggcacccaaggacaugcccuucacucagggccuacagcagugucugcugcuggcaacaccugcugcuggcagcacccucagagcuacaucucucccuggucacucugcuagaggccaugauggagcucagaccaucuccaacguuggccugcucuggcaucagagccagucacgccacaccaggcucaugcuggagcccaauccaaugcucaagcaccucacaggcuggcuccuuagccacagugugcccagggagaagguggauaaagagcucaccaagguccuccuggagcuguacggcaaagaggccaaguacaaccacagcuaccuggucugugggcugggagacgaacagucccuaccaccccucuacucugaccaggccagcagguuggagccacccaugcgugacaacuagcccucagccuggcucuuggagaacgggacacggccuggccccacauuccuggaaggugggggaaaggaggaaggcuagauuucaggaaaccugcuuucugcuuugaguucaggggagccaggcaagggagccugggaccuuguaggggagacaaaaagccuugggcagugcccucccaguguaucccuugagccuccugugggcaagccacacccucaugccauguucaagggacccaagaagacagguguguccuugcccucaaccacucacauggguaucacuggucagagcugaugaggggagcaagccacaucaguggccaauugcaaugagucucuggugucccuggagggagugagagcacccaaggacauaguauucaguguguuacauuuuggccugggcagcaaggugggugggcacagcggugcagccaccccucugccacaugggccaccaaagcacuacaggccaagcagggagaucucaugguccauaacauaaaaucaucuugaaguuuuuacucuaauuuuuguguuuuuuuggaaacagggucccaaugucccccaggcuagagagcaggggcaagaucauaguucacuggagccuugaccuccugggcucaagcgauccucucaccucagccucccaggcagcugggaccacaggcauacaccacaaugcccagcuaauuuuuuuuuuuuuuuugagacaguuuugcuuuuguugcccaggcuggagugcaauggcgccaucuccggcucacugcaaccuccgccucccggguucaagcaauucuccugccucagccucccauguagcugggauuacaggcaugugccaccacaccuggcuaauuuuguauuuuuuuaguagagacaggguuucuccauguuggucagaguggucuugaacucccaaccucaggugacccacccgccucagccucccaaagugcugggauuacaggcaugagccaccgcauccggcaaaagcccagcuaauuuuuaaaaauacuuuguagaaacaggaucuugcuacauugcccaggcuggucucguacuccuggacucaaguaauccuccugccuuagacucccaaagugcugggauuacaggcauaaaccaccacaccuagccuacucuaaauuuucaaaggucuuuuuaaugcauuauuuuuaguuaauauuuuauuuuguggauacaugacacuuuaauuuuggugacagucauuucucuuuuuguaaugguucuucucuuaaggcaauguuuuucuuuuuggcauugccucccacuuugaaagcacauuuuugcuguuugaucacugaggaaggagcugccagucccuucugaugagucugguuucuccaggggcauauguggccucgggauaaucugaguucugaaucggacuuuaggguaugauggggccagaauuacacauuacagcuugcgagaacagagcccugguggucuggcuucauaccugaggugcugggcacacaggcauccaauaaauggugggugcauaaaauauauauauauauacacacacacacacacacacacacacacacacacacacacacacacacacagauuuuugacagcaccagaggguuggcaccccuaacucccacauuguucaagagucaacugcaacuuacuauggaucagggaaggucucacagaagagaagauaccuaaagguagauuuuaaagaaugaauaggccaggcacgguggcucauaccuauaauccuggcacuuugggaggcugaggcagcaggaggaucgcuugagcucaggaguuugaaaccagccugggcuacaugguaagacuucgucucuauuuuuuuuuucuuuuuuguuuuuugauagagucuuacucucuuguccgggguggagugcaguggcaugaucuccacucagugcaaccuccaucuccuggguucgagcaauuccccugccucagccuccaggguagcugggauuucagguaccugccaccaagcccagcuaauuuuuguauuuuuaguagagacgggguuucaccacauuggccaggcuggucucuaacuccuuaccucgugauccaccugccuaagccucccaaagugcugggauuacaggcaugagccaccguaccuggucgaugguaaaauuuaagcugacucuuuuaaaaugaguagaaucuauguauaaaaaagaaaaaugacuagauuuucagauauacuaaggaaauaauaaauagugggcaaaauacaacuggaaaugcacauacuuaguuuggcacagccagaguaacccagauugcugaagcggcacugacuaguuacuggugaugguaugacuuuaguagaaacacugucuauaguguuuuaguugcuucaguuguuuuuugcacauauucuuaccauaaacaucccucuaggauuguuaugcuggauaaaaccuuugcgccaggcuaacuguuuaccauccuuauuucauuuuuacaacaaaucugagauaaguauuaauaucccaauuuuaacuagaaacucaacuucagaaagguucauaacaguucacaguaauacaucccagcauucuguuagguguuacaaauuuauuaucucauuuaacucuucaaacaacccuaagaacuagguauugcugguacuucuguuuuacagaugagaaaacugagguucagggagguuaugcaauuugcucagggucacaguggucuuaagaggcagaacugagaauuaaaauucaggacugccuuauccuaaagcucucuuccauuacaguauaaugcuuuaucuaccuucaaucauaacucagucuaauccaauaugcuuugauuguuauacucucugcauuuccaguaacuaauaugguaguagccucuugcaaggacagguacaauacacauuugcugaagacagugcuuuuacguauuaaauauaagggaaggcuacagccagagaaaugcuagccaagagaagccccaacacaaggugacuucucaaagacucuucuuuucagguuuuuccaaaggauauggaagagucuccaaugcuauaucuuuucaucgaagagauggaaagaguacaucugaccaagaucugguuacagcaaugcagagaucuugcaguacauacugcagcaaaaucaggugcugacagcugagagauaucaaguggcauaaggcuguaagaagggaaaaaagcccuagaaauacuuagauuccaaaaaugucucuaaacgacugcaagaaacugacacacaacaaaagagugggauucuauuaaauccauuuaagaguuaaauuggugaaacaacucacauaacaccaacagaucauacugguagcucaggucuccucucauuuuaccuuuuuucacauaaaaagguaagcugucuucccaguuccuggcagaugugauauccuucaaauaugguuucucagcuucccagauggcuaggcuagacuaggacauaagaaauaugcaguaacaugcuccccaccucccaucuaacagcaggaagagaauaaaaaaccaaaagaagaaaggaguagccagcaaugaucucuucucucauuccaaauaccacagguuaguccugcuuauauaagagagguaacuauuagaacacaucccaagccuuuuuauuuuucucuuucagguugggguuaaggaauguuuuaaauuguauuucuuuucauuuugguggggguuuuggggggauuuuuugguuguuuuuucuuugcucugucuugcucuguugcccaggcugcaaugcagugguggcaugaucacagcucacugcagccucaaccucccagacucaagugaucuucccaccucagccucccaaguaacugcgaccacaggcacaugucaccacgcccagcuaauuuuuuguauuuuguguguuuguaaagacaggguuucaccauguugcccaggcuggucucaaauuucugggcucaagggauccuccugccucagccucccaaagugcugggcuuacaggugagccacuaugcccagccuauuucuuuuaauuuuguucuggugugcuuaaauaaguuucuucauggauuucuuuguaaaacaagacuuacuauaacagacucuagacccuaccucucucauaggaacgcuauuugaaggaaauguuaaaguacuugaaaaacuuaaaagcauaacacaauaauaauagguaauauuuauuguguuuguuuugugucauuuaaagcccuuugcgugaacuaacguauuaucucacaacaacccuaugaggcagauacuauuaaucucuuuuuuuuuuuuuuuuuugagacggagucuuacucuuguugcccaggcuggagugcaauggcgcaaucucagcucacugcaaccuccgccuccugaguucaaguguuucuccugucucagccuccugaguaggugggauuacacgugcaugccaccacgccuggcuaauuuuuguauuuuuaguagagacaggguuucaucguuauuggucaggcuggucucgaacuccugaccucagaugauccacccgccucagccucccaaagugcugggggauuaccggcgugagccacugcagcuggccaaccucauuuuuaagaugaguaaacugaggcccagaaaaacagaguuccuuucccuaguuuacacaaauauuauaugguagagcuggaauucaaacucaauucauuugagucaauaaauuugaguauauauuacucaaauauacuuauguaaugaaaauuauguuagaauauuacuacacauggauuaaggaagcaaacacaauaaccuaguaaaacauucaacaaauaauuugaauucuuuguccucaccaucguaacaccaccaucuuuuuuuucaagacagagucucccucugucaccaggcuggagugcaguggugcgaucucggcucacugcaaccuccaccuccuggguucaagcgauucugcugccucagcuucucgaguagcugggacuacaggcacaugcuaauuuuuguauuuuuaguagagacgggguuucaccauguuggccaggauggucucgaucucuugaccucaugaucugccugccucagacacccaaaaugcugggauuacaggcgugagccaccacgcccagcccaugcaccauuaucuuuaugcauucugagauuaacauguaacagauaaauuuaugcggaacauaggcucuggagucacacaaaccuagucacaugacgucacuuaauagccguauggacaaguuacuuaacugcgucucaguguccucauguguaaaauagggauaauaccuaucacacagaauuuaagaacuaaaugggacccccaugcggugccucacaccugcaaugccagcacuuugggaggccaaggugggaggaucacuugaacccaggaguuugagaucagccugggcaacauggcaaaaccccaucucuaucaaaacaauacaaaaauuagguguaguggugugcgccuacagucccagcuacuugggcgguagagguggcaggaucaccugagcccgggaagaucaaggcugcagugagcagugaucacaccacuguacuccagccuuggugacagaaugagacucugucuccaaaaaaauaauaauaauaggcugggcgcgauggcucacgccuguaaucccagcacuuugggaggccgaggcaggcggaucacgaggucaggagcucaagaccauccuggcuaacauggugaaaccccaucucuacuaaaaauacaaaaaauuagccaggugugguggcgggcagcuguagucccaacuacucgggaggcugaggcaggagaauggcgugagcccgggaggcggagguugcagugagccgagaucgcgccaccgcacuccagccugggugacagagugagacuccgucucaaaaauaauaauaauaauaauaauaauaauaacuacaugggcuuuaagaaaugcuuaaugcuggccuggcacgguggcucaugccuguaaucccagcacuuugggaggccgagacggguggaucacuuuaggucagggguuccagagcagccuaaccaacauagugaaaccccaucucuacuaaaaauacaaaaauuagcaaggcaugguggugggagccuguaaucccagcuacucgggaggcugagguaggagaaucacuugaacucaggaggcagaaguugcagugagccgagaucgcaccacugcacuucagccuggggugacagagcaagacucuaucucaaaaaaaaaaaaaagaaaaagaaaugcuuaaugcuuuaagaaaguuggccaaagccaggugcucacaccuguaaaccaagcaagcacuuuggaagacugagguggaaggaucacuugaggccaggaguuugaaaccagccugggcaacauaguaagacccagucucuacccaaaaaaaaaaaaaaaaaaaaaaaaauuaaauggauuauauacucaucccagaauaguuguuggcacauaguaagugcuaagcaaacaccauuagcuacuacuguuaauauuuuuauuucauuuuucuuugccauuuuccauguaaacaaguaucuaaaaaauguuugucucaaagcuaucaaguaaucuugaaaugggcauauguuuuacauuucacauuucagugucuccauacuuugguaauauuuuccaguaaauuuauaauccauguaacuaauauugcugccuaugcaagcaucucuucuaccauuuugaacuuaagaaauacaagaauacaauagcuacauuguguuucuuauguguagugauaauacugcaaacccuuaucucuuaauauaaacugccacauuucuaauuacaugagagucacucuguauggcuuuucaucaaaugccccaaauuaaaauagguagugucuucuuaaaauuacuuacuuuuucauuugacaaaucucagacccaaaagguaaagggacuugugacuugcucaaguucauauagguagauaaugauaaagaccgacccggaaccuucagacugaguucaaagcucuuuuucaucucucugggcugaauaauuccauuucuugucaggggaggugauaaacaucugaaaauagugaaugacucaaaucucccaagguuaaaaaaaaauuucaagaagacaaucuucaaaggucauuuaauguagcacaacaaaacaacaacgaccaaaguggcauaacucaguacuguuuccuucucaaaaaaucaggucaucucgaaaauuugcuuuacuaaauuuguauuagccuaacacaaaucucaugcuacuucuucccagcuaucucugcaacuuucugaaacugggcaacuucagcucaaaauucaaugacaaacuccagggaacugucacagugcaauguuauaggaaauauuccugaaaauaaguggugcuugugaauucuauucuacugagauucucaguguaauuauuuuucugugacagaaucugauuuguuucaugaaaccaugcuaaaauaaaaaagaacacaaaaauguucucauuuaggacacuaauugauauaaaauuucccaaaaauuuuggagcaguucaaaucuaacaagcauuuaccaaaggauuuaauccauaucauucuuucaaaaagucuggccuauaaucccaaugcuuugggaagccacggugagaagaccacuugaucccaggaguucaagaccagccuaggaaacacagaccaaucucuaccaaaaauguuuaaaauuagccaggugugguggcacaugcguaugguccuagcuacucaagaggcagagguuggaggaucacuugagccugggaggucgaggcugcagugagccaugauggcaacacuguauuccagcccaggugacagagugacaccuugccuaaaaaaaaaaaaaaaaaaaaaaaaaaauuaaauuaaaaaauaaaaauuaagaaaguccacucugaaaacaacauaagacuuuuuacuuguuauagauuuaaccagagucaagaccagaagugaccaauccauuuuacacacgagccacagcaggacugaggagagaggaagagaaaacaggaagacuagcaagucaaaucaauuauuuacuuaaaaguccacagaguacagagcacuauaagauguacagugccaacaugcuccacccuuucucugcuagucaguacaggccacaagaugaacaccagaguccaacaaccagccaaaugccaggcaaaauggccuuaucaggcuagauggggucaaacacauauauuuuuaacuuauagucaaagaggcucaaggaagaugaucaacaacuuaaauauugcagcgauauuaaggaaaacaaggcuaggaaaaugucugaauauacagacauugggucuuuugaaugugcauuuacaguaguguuggggacagaaacaagacaggaaaagucuuaaaaagugagugaguguaaaagcaaaagcugcauacaaaaugccauuuuaaaaauguuuagaaguaaaagggccgggcguggugguucacgccuauaaucccagcacuuugggagcggaucacgaggucacgagaucgagaucagccugaccaacauggugaaaccccgucucuacugaaaauacaaaaauuagcugggugugguggcacgcgccuguaaucccagcuacucgggaggcugaggcaggagaauugcuugaacccgggaagcggagguugcagugagccaagauugcgccacugcacuccagccuggugacggagccagacuccgucucaaaaaaaaaaaaaaaaaaaaaaaaguuuagaaguaaaagaagaaaaagauggcaauaauucaaaaagcugaaaaggcagaaaauuuuuauuuguuuuaggauagacaagaccucuguauuuguagucugaaaagaaagacucaauagcgaaggugaagauggaagagagaaagauaacugaugagagugagguacuggauacuagagaaugcaaugaagaagaaaacugauccauguggauccuggaagucaucagacaaaagcaaauaaagcaaugggacaaaagacaaaaagcaauaaaaauggggagagaacagaugguaaggacuuuuugaaaaaucagaagcugugcaaaaauggcaaaacaauggucuagagggacagugaaugacuagaacuacaaugauugcuccccucguccaaggaguugcagaguauucaaccaaugaaaacagaaauaauagcauucauuacagaaaaagccguguuuucacuuauggguuaggagauggaagaaauauuggaagaaaaaaaauuaagaacuuaggacuuugcucacauuugugcacagguucuaccagacccagcagaaacagguaguaaagggacaucaagaaugagguagaaaagaaugggacugagcuuuuaaaauacugaggcaauaaggcagacggaacuuugagauaacuuuuuaccaacagugaagaugaagaagaguaaucuaaagaacuuuauggcugcagaggaugaggggaaugaagacaaacauaucaaaaaacugcuggauaccacagacaacaagucuucagcacuaacuagcccuaauuuucaaguggaaucaucuccaaaacccacuuucccagaagcuggaccugaaauauccuuuaauuucauuugccaagacuagcaaguugcugaacugugucaacaguuuguuuguguuuguuuuucgaauuggacauuuguuuuuaauaacgauuuguuguguucuacaaaggcauaggagggacauuccccaaaagauaaaugaaugccacaugacuagaacugggucuucuauuuuuaugauuuagaacuggguuuuuuguuuguuuauuuuuuuaggcagagucucgcucugucgcccaggcuggagugcaauggugcaaucucggcucacugcaauccccugccucccagguucaagcgauucucccaccucaaccucccaaguagcugggauuaaaggcacccgccaucaugccugguuaauuuuuguauuuuuguagaaaugugguuccaccauguuggccaggcuggucuugaacuccugaucucaggugauccgccugccucggccucccaaagugcugggauuacagacaugagccaccgcacccagccauaacugggucuucuaagcccccuuugcaugcucagacaggauggaaaaggauagauaacaccaguuaauauuuaguuagcacuucacugauucaaauuacuaucuaaucaauuagcucaacugacccacucuuuauuccuguucuuauggugcguaauccaaggauagaggagcagaaagaacauggacuuuaaagucacugaccuagaauucuaacucucccgguucccccagggauauuucuuaaaccucuaugagcuuccauuuccucaccuguaaaguaggaauaacaguaccuauuucaugaggcaguuguaaagauuaaaguguaagucaaguaccuacuacacaguagaugcuuaagaaaugguagauaauggccaggugcaguggcucacgccuguaaucccugcacuugggaggccagggcggguggaucacaaggucaggaguucaagaccagccuggccaauauggugaaaccccaucucuaauaaagauauaaaaauuagcugggcaugguagcacauaccuguagucccagcugcucgggaggcugaggcaggagaaucgcuugaacccaggaggcggagguugcagugagccaagaucacgccacugcacuccaaccugggcaaaaaagcaagacucagucuccaaaaaaaaaaaaaaagaaaagaaaugguagauaauauacuccacauguugcaaugaaaagaaauggaagaccauuuuaacuaaugucauuauaaacuaaaccauccaagcugaaccacaauuuauugguuacuguuguuaauacacacagggcaaauuauguuaaaaaaaucauaaaauaacaaauguuuuccaaaaaguccucucuaucuaacaguuaaccuaacuaaggaugacaguguuuauuaagguacgauuuucauaacuaggaacuuauacaauguuucaugguuugaaacguacuguauuuuuuuccaaaugauuacuuccaaaauaaacuaaacuuuuaacuuccagcuuaauccuggggcaauuuuagagaaucucaacaucucacaaauaaauggaauugaaaaagcauauggauauaaugcaguccacagagaauuugagggcaaaagagaggcuaugucuuguacccuuuccaacuucaguuaacuaauaccacaaauguuccucaauucuaccaauuucuuucuuuauuuuuuugagacacaguuucacucuugcccaggcuggaguggagugacacaaucugggcucacugcaaccucugcccccuggguucaagcgauucuccugcuucagccuaccgaguagcugggauuacaggcgcccaccaccaugcccggcuacuuuuuguauuuuuaguagagacaggguuuugccacguuggccaggcuggucucgaacuccuagccucaggugauccaccagccucgaccucccaaagugcuaggauuacaagugugggccaccguucccggccaauucuaccaguuucauaagcuuaagagcuaucuucacuuucuuuucuucuuucucuacguuauuaagucccaucucuuccuucuccaaaaucucuccaauauauuccuuuuucuucccauuccacuugcuaaauucaugccugcagcauaauuuuauuucuuuaaaaaaauuccuuaacuggcuuccuuucagauaaucuauacaacacuucuugauuaaugucauaauuccaaguucaucaagucacugcucaacuuguaaaccuucaaugauucccaaauguuagcaagaucagguccaaauuccucaguaugacuguuaagacuguucauaaucucaaugagcauuacuucacuaucuuaucuccuuccuaguccauaaucuaaacucuauuacuagaccagacaaguauucccaguucccaucaauaauacgucuaaucucuaucuuugcccuugauuugcucuugccuagaaaaccauucccucauccuuaacuuucucaaauacaaaagaaaaaaauuuaaaaaguaaaagaaaaacaaaaccuucucuuuccuuucugccucuucaaccucuauccauccaccacugaaaaacucuagucuaacugccugcaugaagcccucacagaccacuucagccuaaacuaaucccaguaaacuguaaccugucauuucaacauacacuauuagcauaacaacagaccuccuagggcagucauuuuagucaaugguauuuucacccaagaauaguaaauuuuucauaaggcuaaauuauucaacaugaaaaaccccuuuaaucugagaugaugcccuuucucuuaccuguuuuuguuuuguuuuguuuuguuuuguuuuuaagacagagucgcagccagucauggcacuuugggaguucgagaccagccugagugacauagugagaccucgacucuacuagaaaucaaaaauauuacccacaaacgguggugcacaccuguagucaucucagcuacucaggaggcugagguaggagaaucauugagccugggagguugaggcugcagcccccgccugggcaacagagugagacucuaucacacacacacacaacccaaaugcuccucaacuggucaauaaacaaacuauaauacaucuauacaauagaauacuacucagcaauguaaaggaaugagcugcugauacaugcaauaauguggaugaaccucaaaaauacgaugcuaagugaaauaagccagacuaaaaggcuacagacuacagacuaccacuuacagaacauucuggaaaaggcaaaacgauaggaauagaaaacaacgcagugguugccugaggguaagaauugggguagacuacaaaagagcagaagggacuuugcagaggugauggaacugugcaaaaucuugauugugguggugguuguuggacaguauacauuugucaaaacucacagaacuuugggaggccacagugggaggaucauuugaggccaagaguucaacaccagccugggcaacauagccagacccccaucucuacaaaaaaaaaauuuuuuuuuaauuaccaggcauggugguuugugccuguagucccagcuacuuggggaggcugagguggaaggacugcuugagccugggagaucaaggcugcagugagucaugaucacauacugcauuccagccuagggaacagaguaagacccugucuucuuuuucuuuucuuuuuuuuuugagacggagucuugcucugucgcccaggcuggagugcaguggcaugaucucggcucacugcaagcucugccuccuggguucacgccauucuccugccucagccuccugaguagcugggauuacaggcgccugccaccacaccuggcuaauuuuuuuuuuuuuuuuuuguauuuuuaguagagacgggguuucacuguguuagccaggguggucucgaucuccuggccucgugauccgcccgccucagccucccaaagugcugggauucuuuccuuuauuuuccuuuucucucccucuaaguuaccuuauuauuuccguauuaauucucccugcuccauuaacuguccucccaucuauuuuuccaucacaugucuuuaagauucugguagucacuuuaaaacugcccuaggaucuagucucaaaacaaaauucuaacauaaugauaaguccucaaguuccuacagaaaauauuuucgcauauguuggaaaaugucuaauuuuaucaaauuacacuaagaauauaucauauuauacuccauuacagcuguggcaagaagcauaaaaacugguauuccugauuuaaaucuaccagggaccauuacuuuguuuacacacccuaacuacauuuucuaaauaucucuauaagaaucuucuauauuuaacuaguuucuguauacuucuguaaagucuuccauuuaaugaaucuuuaaguccaucaagaucuaaaaauggcuuucuuucaauccuaggaaacauaagacaauguugaccucauuuacuuacagggcaguacacaguucauaaaaucauuauguguuaaaacaauguaauguucaagaguaaacucaaggucaaauccuagcuuggcacugaccuugggucaaaccgaucucacaucuuagggacuuaguuuuuuccucugcaaaaugaggauaauaauaguuauccucauuaauaucuacccuaauggguugcugaaaagagauuaaauaaacacauaaaagguacuuaaguacuguagcugucauauagaagucagcaacugguuucaucauuaguccucaaugacuaagaauucuucaaaauaucugaauuauaaacuuaaaugggccaggcgugguggcgggugccuguaaucccagcuacucggaaggcugagaugagggaaucacuugaacccgagagccaagaucgugccauugcacucacuccagccugggcaacaagagugaaacuccaucuaaaaaaaaauuaacacuuaaaugagcugcucauucacuggugaaucacuaaaauggccuaaaucagauaaauacccgcagauaauugggaaaacagcacauuuuugauaaagcuguuccaggacuuaaccaaaaauuaacuuuaucucaacaguuaacguuaccaguuaacuugaaacuagauaaaaacagagauuuauguuuagaaacagaaaaaugcugucagaccaagguaaaugauaccauuuuucuauuugaguucuucagcaucuguagaaagccuaugcaaauaaagccggccaggcacgguagcucacaccuguaaucccagcacuuugggaggccaaggcaggugaaucacuugaggucguaguucgagaccagccuggccaacauggugaaacccugucucuacuaaaaauacaaaaauuagccaggcaugguggcaugagccuguaaucccagcuacuggggaggcugaggcaggagaaucgcuugaacccaggaggcagaaguugcagugagccgagaucaugccacugcacuccagccugggcaacagagcgagacugucucaaaaaauaaaaacaaaaaauaaagcauuggaaagugggccagaaaaauacauuucacccuuuaauuauacuucaguucgaaucuguuccuacacagauuugccugucagcagacuaaacauguuccuuucuuagacaaaauuuaacaauauuaauuuauuaacguuauaaauaaaaucacagugacauuaauacaaccuaauguuuucauuaagagaauuccaauuuaauuguaauaugggucauauucauaccaugauuuguuuuauagagguuucagcacugaaaacaagugcuguuauucaauggcgccaucuugggagguaagaccuuccaaggauugggaugacugggcgcaucuuccaaucauguggccaagacucaaaacuuuuuugacgugccauuuauaggauucucaaagacaaaccucacacacacacaaaaugcuagucuccaccuuuuagaauaacauuucauuuguggccaaaaacaaugcugaccacucacuuccuucaccagacuuuccuaucuccaaaaguuaaauauaagcaccugcacaaugaugacuuaccagaauuaagaacacguaauaugcucuaaagacaaauucaaaagaaauauaccaaauauuucagaauuuggaaaugucacuaaaauaaauacauaacuuuccaaggcagggagcaguggcucacgccuguaaucccaacauuuuggaaggccaagguaugaggaucacugagcccaggaguugcagaccagccuggcaacaugccaaaaucccauuucuaacaaaagauacaagaauuaguagaugugguagugcgugccuauaguccuagcuacuagggaggcuaaagugagaggacugcuagggcccgggaguucaaggcugcagugagcugugaucaugccacuggaguccagccuggguaacagagugagacccugucucaauaaaaaaaaaauaacuucccauuuggagaguucugauguuuguuuuuaaaaagccguccuaggccaggcacaguggugccuaccuauaaucccagcaccuuggaaggcugaggcaggaggaucguuugaggccaggaauucaagaucagccuggguaacauaucaagaccugucucgccaggcacgguggcucaugccuauaauaccagcacuuugggaagccaaggcaggcagaucaccugaggucaggaguucaagaccagccuggacaacacagugaaaccucaucucuacuaaaaauacaaaaauuagcccagcgugguggugggugccuguaaucccagauacucaggaggcugaggcagaagaauagcuugaacccaggaggcggagguugcagugagccaagaucgcgccacugcacuccagcaugagccauagagggagacuccaucucaaaacaaaacaaaacaaaacaaaacaaaaauaauacauaaaucuugccccuaccaaaaaaaaaaaaauuuaauuagccaggcaugguggcaugcacuaguagcccuagcuacucaggaggcugaggcaggaggaucgcuugagcccaggaguucaaaguuguagugagcuauuauugagccaccgcacuccagccugggcaacagaaugagaaccugucucuuuaaaaaaaaaggcagucauaauaccuuacaguugccccagagaugacuaugaaacuacauaguaacaaaauuggaaaugugaaauaucauaccagaucuguguaaaagcagucaaaugauacugaaaaguaaugaaaaacaacugaaauugucuaauuuaaacauuuaaacucauacuuccauuauauuugcuuccagagugccccugaaggcacaguauuuaauaugguuauuuauauccacucaucuuuuuauacucgguucaccuugguuugaauaaacugcgauuuuccaaaauaaagacuuuccauauuguuuguuguucugugaaauuuuucuuguaaaagauggguuaggcuaggcgcaguggcucacgccuguaaucccagcacuuuggaaggccaaggcaggcagaucacgcggucaggaguucgagaccagccuggccaacauggcaaaacccugccuacuaaaaauacaaaaauuagccaggcaugguggcaggcgccuguaaucccagccacuugagaggcugaggcaggagaaucacuugaaccugggagauggagguugcagugagccgagaucgugccauugcacccugaccugaguggcaagagcaagacucugucucaaaaaaaaaaaaaaaaaaaaaaaaaaaaaaggguuggguccaggcaugguggcucaugcguuuaaucccagcacuuugggaggcggaggugggcagauuaccugaggccaggaguucaagacuagccuggccaacauggugaaacaccgucucuacuaaaaauacaaaaauucaccagcugugguggcaggugccuguaaucccagcuauucagggggcugaggcaggagaagcccuugaacccgggagacagagguugcagugagcugacagagcaagacuccaucucaaaaaaaaaaaaaaaaagagauggguuggggguaagagaagaaguaaucucaguuuagcuuaucacauucuguucuaaucauuuugacuacaguuuaccagagacuucaaaauuugauuacuggccaggcacgguggcucaggucuguaaccccagcacuuugggaggcugaggagggcggaucacgaggucaggagauugagaccauccuggcuaacauggugaaaccccaucucuacuaaaaauacaaaaaaauuagccaggcgugguggcgggcaccuguagucccagcuacucgggaggcugaggcaggagaauggcgugaacccgggaggcagagcuugcagugagccgagaucacaccacugcacuccagccugggcuacagagcgagacucugucucaaaaaaaaaaauuugauuacugcuccccucccaaagauaaaaaucuagcauagaauuaauucaugccaaagaugucacuaacuggcauucuuuuaaaaaaccucaguaucugacccucaacagcuugugacacuggauaucuagcuucuguguguaccaguuccucaucuguaaaaugggguuaaaauaauaaacuauauacuuacuucauggguguggugaagaauacaugagauuaugagcuugaaacaugauagguacucaauaaauauuuguugagugaaugaguaaauaaacuaauguaugaaaaaugcuuaggauagugccugucacauagccaauggcuaauaauaucaguaucacgccagacgcgguggcucaugccuguaaucccaacacuuugggaagccaaggcaggcggauuacuugaggucaggaguucgagaccagccuggccaacauggugaaaccccugucucuacuaaaaauacaaaaaugagcugggcaugguggcaugcgccuguaguuccagcuacucgggaggcugagacagaagaaucgcuugaacccaagagguggagguugcagugagccaagaucacgccacugcacuccagcaugggcaacaaggguaaaauuccgucucaaaaaacaaaaacaaaaacaaaccaauuacuacauuacccuguaauauucugauguaguuucaucagaaaagccaaaauaaucacugauuuaaaauacacaguagguaccuccuaaaaacuaauuuaaauuuaccacuuaauuugaaauauguacugaguuaaaucaacuaaguugcuacuaauuuaaauuugcauuuaaauuggcuuauagaacauucuucugccuuuaacacaagaggaagaguaacuacugagagagcuuacccaucagacaaagcagcuuuaagcagauuuaauuggcucaagauuugcuuuguugacaucaaaauaaaauguuagucaacagaaaauucaaauaaaguacuaccuagugucuuguuucuguuaguaauuccaaucugagaacauuaaacaagcacugauaaagcauuuuuucuaagaaggaacucugcauaguuaauucuacaccagugacaaguuccaaaggagaaucugcuuuguggcauuaggacuggacuccuguacuuucacacccuaauagucucuauaucgccggaagcaguuggugcacucccggccuuuagauuagagaaaauacuaagcaggauucuaauaaaaagaauccaaguuaauaagcuuaagaaauuaaaauugcuaccuauacauaaauaucauuggucaucaaaaacucuacuaaagaccuacuaugugccagugaaaauaacugaggagggcauuagcuaaaacagcuucugaucgagaagcuuccagucaaauuagcuaauuaagauauuaauagaagcuggucaaguuaaccaaaaauaugagggguacuggcauaacaagcuacaagauuucugagaaaauaagaagcuuuugauacaacuagguaaaauaagauaugugauagugugauuuuccaugaacacaaggugguacuggcaauaaaugcuauaaaauuuuagagaagaaagauuaacuguugcaaaaccaugauagacuucaaagagggagaacugagcucagucuugagggguggaaaagauuuaaauaguuaaacagcauaagaggaaaggacaaaagauaaugggaccaaaggugcugaauugggaauauggccauuaaauauuuauuaaauaccuacucuaugucagucacuguguuaggcacuagagauacacuggagaacaaaacagaugaguucucugcuuucauggaaucuagcagggaagacauaauaaucaugcacgcagauauauaaucauaaauugcaauaggugcuaugaaaggaggcaacagaagccaguaauagggaauaaugggaaaggacuagcaagacacgaugaugagaaaaaguaucccugauauuuauacauaagcucaggcaugaaggcagccaugcaaagagcagggaaaagaaguguucgaggaagacagagccaugcauacaaaggcccugagguaggaaacagcucacugaguuuaaaaauaaauaaggccaguggcucaugccuguaaucucagcuacucuggaggccaaaggacagcuugaggccaggaguuugagaccagccugagcaauauuguaagaccccaucucuaaaaauuaaauaaaauaagaauaaaaauaagaaguuagcguaacagaggcauaaugggcaaugagauuggcauaaaaugccaauugccuacccgaaaaguagccaggagacgggcuauacagggcauuauaggucaaaauaaagaacugaaauggccaggcacaguggcucacgccuguaaucccagcaccuugggaggcugaggugaguggaucaagaggucaggaguucauggccagccuggccaacauaacauggugaaacuccgucucuacuaaaaacacgaaaauuagccaggcguggugguaggcaccuuuaaucccagcuacuugggaggcugaggcggagaacggcuugaacccaggagguggagguugcagugagcugagaucgcgccacugcacuccagccugggcgacagaacgagacugucucaaaaaaaaaaaaaaaaaaaaaaaaaagcugaaauuugaauuuuauuccaaaucuaaaaaccacuaaaaauuuuugcacggucacauuaguguuaaauaaaaggagccagaccacaaacaauauauacuauaugauucaauuuuuacaaaaguacaaaaaaagagcaaaauaaucuaugcugucagaagucaggauggugauuacccugggugguagaggggagacaggaacugaaagggaacuggauaggggcuucuagguacugguaacgcuguuucuugaucuagaucuaggugcugcuuacauggguauauucaguuugugggaaaaaaacaucaaauuccacuuuuacaugcauuuuucuguauauguauuauauacuucaaucauaaaguuuuuaauaacguaauauacuuuuauuuuuuuuuuuuuugagacggagucucgcucuguugcccaggcuggagugcaguggcgugaucucggcucacugcaagcucugccuccuggguucucgccauucuccugccucagccucccgaguagcugggacuacaggugccugccaccaugccuggcuaauuuuuuguauuuuuaguagccacgggguuucaccauguuagcccagcccauaauacauuuuuaaaauacuauuuuguccagauaaaaacaggaauagagugcucacuuccacaacacaaauacuaaaauuggaaugguacagggaagauuaguaugugcccugcacaaggaugacaugcuaauucauaaagcaguccauauuuuuaaauuuuuuuguaaaaauaaagaaacaaacgguauaaaggggcacaugcaaauacggcaggucuugaaugaaagauuacccggguagaagcuuucagaggaguaauucaaacagccagugauacaaaguaccauguuaauaaagaauaaggcugggugcgguggcucacaccuguaaucccagcacuuuuggaggccgaggcaggcggaucacgaggucagcagcucgagaccagccuggccaacaugguaaaacccugucucuacuaaaaauacaaaaauuagcuggguguaguggcaggcaccuguacucccagcuacuugggaggcugagggagaagaaucguuugaacccgggagguggaaguugcaaugagccgagaucacaccacuucacuccagccugggugacagggugagacucucucaaaaaaaaaaaaaaaaaaaaagcauguuggggccaggugccacucaugcuuguaaucccaacacucugggaggccaaggugggagaaucgcuugagcccaggaguucaagaccagccugggcaacaaagcaaaacccuaucucuacaaaaaaaaaaaaaauguuucuuaauuagcugggcaugguggugcacacuuguagucccagcuaaucggaggcugaggaaggagaacugccuaagcccaggaguucaaggcugcugugagcuaugacugccacuauacuccagaucgagagaaagagugagaucccgucucuuaaaaaaaaaaaaaaaaaaaaugcugagucugggaaggaaguugugcaauacuaaaggauuaacuaucaauuccuuagaacauaaggaggaaucuccagaaauuaagaaagucauagaugacaacagcaaugccuaaaaagguuagcaaugcuugucauguuguggcucauauuuuaauaugguauuuucaagcucuucccuugacccuccacucccauacaacugagaguguaaugacauagaccccaaaccugagcaucaaucauaccugagcucgaaucaauggucugccccucacuugcucuggcaguuaacugcucugagcucaguucccucauuuauaaaauaaggauaaugacuaccucauagaguuauuauuuuuucaaaggugaacagaguagucacuucugcagcacaaauacuaaaacuggaauaauacagagaagauuagcaugucccccgcucaaggagggaacacuauuauagucaccccuuugaguagaucuaaaggguuauuuuaauuauuauuuccuaaugguauacggaggaccaaugguggauuuaacaagaauuccuuugcuucgggcagagcaaaaaaaaaaaguuuccauucucagacaaauccaugggugagagaagggcuuauaaaauagucaccggcugggcgcgguggcucacgccucuaaucccagcacuuugggaggccgaagcgggcggaucacgaggucaggagaucgagaccauccuggcuaacgcggugaaaugccaucucuacuaaaaauacaaaaaauuagccgggcaugguggcgggugccuguagucccagcuacucgggaggcugaggcagaauggcgugaacccgggaggcggagcuugcagugagccaagaucacaccacugcacuucagccugggugacacagugagacaccgucucaaaaaaaaaaaacacagucaccauacagaaacagaaugaauaaagauaaaaucaaaaaauaaagagaagguagaaauggggcuucuucuagaagcucacuagcacagguuccaggcauuuucuaagagacagagacuugagcuaaagcauacugggagaaguucagugacuugagaaauuaugaaaaggaagaaacaaucuuccccgcaagccacaauugcuaccuaauguauucuucccuuuguggaauauuacuuaaaacaaguuagagaucaacacuaaggauauucugucauagguggaagggcaaggccuucaaccacuuuacaccauccccacccuuaaguauuauuugaacaaccauaauuuguuaagcgcuucuuaagcacagccaaagauguuaaguuuuauauuucaggagcuaccauuucaaaagaaaaaaaauaaaaaguucaacuccuuaaaucuuuugguaacuuuuuccccaaaauguauccucugucuuaaaaguaacuaaaaucuacuuccuccugaauuuauuuaucuuuccccuaauccaauaaaugucucuccuuauucuuccuauuuaccucaccauuaaauaccgaagguuuuccuauuuccucccaaguuggcacauuaacacucuaauauucauucugaucucacaguauugaaucugagcauagaaaccucauaacauucccagggauaaaucugcuacccaauuccuaaaagauaacacacaguuuaaaaaaauaaacacaguggugguaauuauacaacuguauacaugugucaaaauuugucaaacuguacacuuaaaauuggugaauuuuauuguauguaaauuauaccucaauaaagcuuuuuuuuuuuuuuuaaagaaugcauuccgggcagggcaugauggcucaugccuguaaucucaacacuuugggaggcugacaugggaggauccccugaacccaggaguuccaggagaccagccugggaaacacagggaaaccucaucucuauaaauaaaaaaaaaaguuagccaggcaugguggcacacaccuguggucccagcuucucagaaggcugacgugggaaaaucacuugagcccaggcaguagaggaugcagugagacaucaucacagcacugcacuccaaaaaaaaagggaauacauucauuacauucauucauucacucaucaaauauuugcuaugcaucuauuauaugcaucaaaguuuauaccacaucuuucagccuggacuauccggguccuaccuguaacagcaugcuuuacucauaaguugacacugucccuaaaagcuguauuacaugaaaaaugauucuguuucugauaauguuaccuuaaugauggccgcuuuacacuggaagggccauuagcuauccaucaacuuccauuacauaaaugaaauauaugaucacuuagguacuccccauuuuaacagaaaugcuuucaucauaagaaauaaguaagcaccuagaggcauauaguacauaccacuacuacacuacuacagccuuauauguuugucuuuuuaccaaaaaaaaaaaaaaaaagaaaagaaaaacagcacacuucaagugcauauuuacaacacugcugaaagaaaaggcaauacuauuggagaauagacuuaaaugacuuauucuagggcccacagucacccaguggcugagucaaaggccaaaaaacuaggucucaugauucccaaggcagugggcaaaguagagagacaaccacagaccugagaaacagaccuggguaugaauuccagugccacuucuuacuaguugugugugugaacuugggacagccacuuuacuuucugaccuuuggcuugcucaucuauaaaacagggaugcugacugggagcgguggcucacaccuguaaucccagcacuuugggaggccgaggcgggcagaucacuugaggucaggaguucgaaaccaacccggccaacauggugaaaccccaucuccacuaaaaauacaaaaauuaaccgggcaagguggcacacaccuguaaucccagcuacucgggaggcugaggcaggagaauagcuuaaacaugagaggcggagguugcagugagccgagaucgcaccacugcacuacagccugggugacacagagcacuccgucucaaaaaaaaaaaaaaaaaaaaaaaagggaugcuaacuaccaccucacaaaauucuugggaagacugccuaagaucuauaccaccuagcauaauuacuggguacagaauaggcaacucaacaacauuaguuccuuuucuuggucuuaaauuauuuaagauuaagaaaacaccucauaaucaacgaaggcuaauuaacaauccgcauuauuaaucacuggucaacaaugaaccuguguuugcugccuucuucauacuccaacccauucccuucccagcucacuauuuccagcuuuucaaacuuuaguuacuauguuuagaaaagugauuuaauuuuagaaaccuggaaaauucuucuaggaguaaauucuucuaggaguaaauugagcaaaaccuuaaucugcccccaggggaauucugagcaaaacaauuauuucugacaaaagaagaauuuucuauggggguaauucaauuuaaccacaugaauacuaccaaaguugcaaacaaggugacagaaggcaaucuggaacacaccuuccagauuccccaaaaagaaauguccuccuaaaauccaaaccccucccucccuaauuugagguagucaaaucuuauuaggugaucugaauucucccggcucugacaccaguccagcuccuuaggccagaacugcagccgucuguaaaagaaauacccugagcaaaccccaccccucaaaacauccccaaaaggcagggagguccagagaguauuuucuccuccaacgacagauaaggcaccaagggcucagcagcgcaauccuucucccaaggucauucaagucagugaaggugcgacgguggagcugcaggcagucuggccuucuggaaaucacacuacagggguuuugggggugccuacucucuuccccucucccacccgcaagggugagcacuggccucggcauucccgaaacaagccacaacaagcucugcaguguuaggaaagggguugacgcgaugaagaaacagaugcuccaaagcaagauggucuuucucggcucacagaggcuccuccaagguuaugcacagaaaccgcagccaccuccaagagcucuaaaccgggcuccgaagccccagcgcggccgcugcgggucgccagguucccugcaggcaggcuccgcagccagaggccaccagccccagaaaccgcacuucauuccugcgcuccgggaagccauggcuccuucccugcccgggcggcugggcgggggccgggggugcgccgggaggcgggccccgcgcugcggaaaguucaccgcggcgggcggggggaggccccggccccgcucgccggcgucccccugcagauuccaccauuaauuaguccuaaggacugucuacuggcaacuuaaacaaagcgaaugccucgaauuccuucccggcccagcggucuggcugcgagaccagcagagcgcccgggacgcgggccggcgcggccgacagcugcggcggccgcgggaccccuccccgcccggcccgcggcccgcgccccgcgcccgcagcuggccccgcacgccggcccgacgcgcucccaaaccgcccuccuccuccugcugcugcagcucccgggcccuuccugucugaucacuuccuuccuccggugcccgccgggccccgcgcagcccccuccacggccgccucgucgccccccgccccugucggcccgcgcccccucccccaaccccaaacucuacccccgaaacucuucgccgcccccucgaaaaugucuccuccgcgucucugccccaaacauuucuccucagagucucgcucccaccaagaagucuccucagaaccuucccucccccucccgaggaaaaaucuccucagagucucuuccuccaacuccacaaacaugugcugggucucgccccaaaaggucuccuccugagcccuuccuccaaaauccauuccaacucucccccaacuccacaccccaucucuccucggcugcgcccgcgguuucuucugccccguggccgcgggugccccgaccucacccgggaccggccucccaaccccgccgcccuccccuccccgcgccgcgcucccgccgccgccgccucacggacccucaccucugcggccccgaaccgcgcucccgccagcgaaggguuccgccgcucagcugccagcgaccggcgccuccucuggcuccgcgggacugacaa

SEQ ID NO: 191425 - RNA, 18057 nt, Homo sapiens
cgcagaggcaccgccccaaguuuguugugaccggcgggggacgccggugguggcggcagcggcggcugcgggggcaccgggccgcggcgccaccauggcggugcgacaggcgcugggccgcggccugcagcugggucgagcgcugcugcugcgcuucacgggcaagcccggccgggccuacggcuuggggcggccgggcccggcggcgggcuguguccgcggggagcguccaggcugggccgcaggaccgggcgcggagccucgcagggucgggcucgggcucccuaaccgucuccgcuucuuccgccagucgguggccgggcuggcggcgcgguugcagcggcaguucguggugcgggccuggggcugcgcgggcccuugcggccgggcagucuuucuggccuucgggcuagggcugggccucaucgaggaaaaacaggcggagagccggcgggcggucucggccugucaggagauccaggugagcggggccggguccuaagccgagcggaggacggagcuaagcgcgggggcggguccucagcugggugggggcggggcuagguguggaggcggggcucugagcagaucgagggccgaggcgaggguccuuaaagcucaucuauuucaccauuacugaucggcugcuauaaauaaagccagcaccucccauuuguuuuaauguuucccuuccucaaaugaagacauguugccgauuacagcuccugucgcagcacagcaaaaggcuuuguguaaauuuucuaaaauguacggacaacuaaaucauaacauuccuaucccuuugagguaguugccgucccuaauuuauggagaaggaaaguccucaggugaagggacuugcucgaagucacacagcuaauaaaaugcagugcccuuaaccacugagccaggcugccuccgccguuuaaccaaaggauuaguagugacagagcugaaaccgcaguaaaaacuaugaacggcgagaaaaacaguccuaacauuuuaguuaccuguguagaguuaucccugcugacuggauacacaaggguucuuaggguuuuuuaaugcuuaaaauagcacaagacuucucuuuuugcccaaccaaagucuguauuaggguucuccaaauggaaucaauaggaugugucuauauagaggcagguuuauuuugaggaccuggcucccuauggggauuggcaaagucuuaaaagccgcagaguaggcgggcaggcuggagagccagggaggagccagcggugcaguucagguuugaagccuggccgcuggcagaauuccaucuucuuccagggaggucacucuucuuccuggggguguagaaccacucacuaaauuagcauagccccugcauuuuacagguuagggcugaggugguggaagagggagugacuugcccaaggacacagcuguuagggccaagcaguggcuccuggguuuccugguuuccaucccaguucuuauugcucaucaccacugucucauguuugagcucuggccaguuuggggugacaggugacaucuggccuaguccccagccccugaccuugucuuuugccacagcuuaacuggcagaagcuaaggaugggaaauuugacuaauccugcuuaaaacuaaagaggcuuuuuuaacugaggagauugauccuccuaaacuuaccauucacacacaccuucuucgcacacuucacccuccuaugccugaaaauguuauuaguuaucaauuaauuucacauuaaaaaaauuuuuuuuggucaggcacuguggcucaugccuguaaucccagcacuuugggaggcugaggcgggcggaucacgaggucaggaguuugagaccagccuggccaacaugguggaacccugucucuacuaaaaauacaaaaauuacccgggcgcaguggugggcgccuguaaucccagcuacuugggagacugaggcaggagaauuccuugaacccgggaggcggagguugcagugagcugagaucacgccacugcacuccagccugggugacagagcaagacucugacuggggggagaaaaaguuguuuucacuggcuacuuuugcuggaauuaauuucacauuuaaaaaauucugggccgggcgggguggcucaugccuguaaucucagcacuuugggaggccaaggcgggcggaucaugaggucaggagaucgagaccauccuggcuaacauggugaaaccccgccucuacuaaaaauacaaaaaaauuagccaggcaugguggcaggcgccuguagucccagcuacucgggaggcugaggcaggagaauggcgugaacccgggaggcagggcuugcagugagccaagaucgcgccacugcacuccagccuagaggacagagugagacuccgucucaaaaaaaauaaaaaauaaaaaaauaaaaaauucugaagccaggcauggugacucaugccuauaauccuggugcuuugggaggccaaggugagagaaucucuugagcccaggaguugaagaccagcugggacaacauagugagaccuuguucccacaaaauauuaaaaaguuagcuaggcaugguggcacaugccgauagucccagcuacuuaggaggcugagguggguggauugcuugagcccaggaguuugaggcugcagugagcuguaguugcaacacugcaccccauccugggcaacuagcaggagugugcuaguagcaagcucuaaaaauuuauauuauaaaaauauauauauaauguguauauauauguauauguguauauauguuguguauacuauaauauguauguuccauauaauaguauauaguauauuuuauauauauacacacacacguugcuucugcuccaugaaguuuauaagggaaguuggauuuuccuuuuuuuuuuuugauacggagucucacaccgucgcccaggcugugcaauggcacgaucucagcucacugcaaccuccaccucccagauucacgcaauucuucugccucagccuccugaguagcugggauuacaugugcacaccaccacacccggcuaauuuuuuguauuuuuuaguagagacgggguuucacuauguuggccaggcuggucuugaacuccugacuucaugauccgccucccucggccucccaaagugcugggauuacaggcaugagccaccacgcccggccuggacuuucauuuuuuuaaaagguucaaaguuauagugcaagguuaaguugcuuacagauagcaggugcuuuaggaacccucuagaaggaaaguugccaugggcugggucaucagggcuggucacagaggaaggaggagcuugaguugggcuugauggcugagcagggaugagccagacagagcaauacuauagaaacaggggcuggaaggaugcugugagcagcuuucagagggaggcguccaaaggaugagugcaggcagcgugcagaccagccuggcagcagccagaacacagauaaccuccugggcagucugauggacagccgagugacacaugaaagcaacauauuuugauguggcucagagcagggaaggcacggcacugagagugggguagucuagagauggugccugguaggcuauggccaaggggcauaugcagagcugugccuggcacccaggggugacuaaccuuggaaaggaagagcucagcagaucagaccauuugagagggaaagcggagccugggugacuggaagagugacgucaccgcugccugaagcaggggaagacccaccagauuuuugucacauggccucuuucccagugcagcacugcccccagcaccugcaccuccaucuauuucugucugaacucuuguacucuugcuaccuuucuggacagaguagccucaucggggcccuaagaggcagagagagaaagacaguacugaaucccucugcucuggggaugcgccugaugucacccacuugccugagagacccucugagaucacuguggaucacacacuccugcuaguugcccaggagccgucagccaaggucuuugcagagcgagcugucuccauaaucagacaccuccagaacucugcuggagagugaaggcagcaaggagaggugcacuggcugcgggacgugggguuucugaccucucagaucauugaguauugugaucccagugaagcaacagaguuugagaaaaaucauucugaauaaugagaaagaagauggccuggacccaggcugagcaguagaaccugguuggguuguguuuuucugguuuauugaucuggucgacguggaccacgccuugcugcaccucucucugccuccccuguuucccuuuucuugggccuuccuaggcucccuggcucacggugcauucuuuucucaucacaggcaauuuuuacccagaaaagcaagccggggccugacccguuggacacgagacgcuugcagggcuuucggcuggaggaguaucugauagggcaguccauugguaagggcugcagugcugcuguguaugaagccaccaugccuacauugccccagaaccuggaggugacaaagagcaccggguugcuuccagggagaggcccagguaccagugcaccaggagaagggcaggagcgagcuccgggggccccugccuuccccuuggccaucaagaugauguggaacaucucgguaagcaccaggccuuucaucuuuaaaggagauguucucaaaaugcccaucuuagugggccuggugaggauuuuuuccaggaaguagguaggaaaagacagauuauccacaggaaaggugccuguauagucagguuaccucccccuguuacacagaagucuaaaccagaauguuugaaauuguauucugcccacagaucacccagagaucagguucaaagguagauuuuggccaggccugguggaccaugccuguaaucccagcacuuugggaggccaaucacuugagcucaggaguuugagaccagccugggcaacaugaugaaaccccaucucuaugaaaaauacaaaaauuagccgggugugacagcuugcaccuguauguagucuuagcuacuuggguggcugguggcugaagugggaggaucacuugagugcaagaggcagaggcugcagugauccaagauuguggcacugcacuccagccuggguaacagaguaagacccugucucaaaacaaaacaaacaaacaaaaaaaacccaaagguagauucugauucagcaggucagggauggggccuaagauugugccuucccaauaagcucccacgugauaccaaugccacugcucugucaaccacacuuugaguaacaagugccuaaaccacugauuucuaccuugauugguuaguucaccauccccuccuuccugcaaccugccucacuggagagggggaacuggaucucuuuccuuuaagcucacucugcaagcccaccuccagcucagaggcuugcaugucaacucccuacucucaacucuuggaaggacucaagacuuugggaaauugaagaguauuuuucccccacgaaaacaauuucuguccacuuaauuuauuuaccuugccauugcuagguagguuuuaaaaauguauuaagacccgaugcucugucuccugcccaucccugggcccauccauucaaggccgcagugggaaguggccacagccguucauggugggcccuagaggaugcaguuucuuguucugauuuggggaaugaagguuauuagacuguugcacuccaagcuggguuaauagcuaacaaguagccaaauccuuugccugugaaacauccagucuuagcaucaaaacaugcccugguuggggcaugacagcuguugcauucacagcagcuacaagauuguugauucuuaccagaucuucuugauacagguuucauauguccugagagcccuucccaauacaaugaggacaauaaggugcuuuccccacucuuugguuuuugucuguuugucgugggggauggaggaaggcuguucugugauucaguacaacuucacccaggguggagcaugucaggcucuggccuggcugcugaagggagccugcagaaugaguuagugauccaguggucaauuuugaacugguggggaccagaggcaccgauggcaggaagcagcaccccauauccugaucaccuuggcaucuccuccagcccuggcaucuaggcugcaagaguuugaggagugugaagaauccucugaguuggcauggaugguaccucugucugccucccaggaguaacuagucucagccugccaguuaagacaggucaucuuaucucgaaggucagagccaauucuaggcaguagcugcccugcuccagguuacaggcagggcuuacaaggaacuuaccauucugcuccggccuguguaacccuggguuccuuguggguguuccaggcagguuccuccagcgaagccaucuugaacacaaugagccaggagcuggucccagcgagccgaguggccuuggcuggggaguauggagcagucacuuacagguaagugcccucugccugccagacugacugggacuucuuugagagcaacuucauccaucacuuauguccucagcaccugguacagugucugauaugacaguagauaauaaaggcuuaauguuggugauggauuuucaguuaguggauaauuucacuugggaaagauugcagguaaucugaccccaaaugaugaugcacuugcguaauucacauuggagcaggggagaggaggccccccaaaaaugcccaguucacaguguugcaugauugacugggguucucagauuccuccuaagaaaugcacggguagagcgccaccuaucggaauaaacugaacucuguccccaccagagggaacacucauuucacuaauaguuaugugcacugauggugccaagagauuuuaaaaaaaacaaaaaguggucuguuggcccagaggucucaguguggcagcagagagcccaggguguaagugcuagaaucgaguaugcuugggcugagggagcccaggggaggcgugugcugcagaggaggggcugcucagaaagccuucucaaagggacaguuugugccaccuugugaaggaugaauuggcauuacuugggcagaggaguagggaaguggcauucccagcagagggaagagcaagugaacagcagcuacgcuuucagcucagaaaagcccauguccaccaccagccucaccacagguggugaggacugacgcgcaggcuaugacagaggagauacuugugcccaccucaauauuuacagccuggcucaugccuguaaucccagcacuuugggaggcugagguaggcagaucacuugagcccaggaguucaagagcagccugggcaacauggugaaaccccgccuuuacaaaaaauaaauuuuagccgggcaugggggcaaaugccugugaucccagcuacucaggaggcugaggcgggaggaucauuugaguccagggagguugaggcugcagugagccaagaucaugccacugcacuccagccugggcgacccuggagugagacccugucucucauuuguagacccaccaagaagaggugggucugcugcauuuuuggugauuuacuggagggcugguuuauagaucuucauucugucagaagcagggaggcaaaaguaugaaauuaagggagugguuguggaaaaccccuuccaugguuuggagguuuccaaugugacugggagucccugcaggccgguggagguagcugcucaaguggcugcugcuucuccugaggccuuuuuggagaaaguggacaccugaaugucagcugcuuuggggcuaacaugauccuugaugccuccuuuuguggcaugaguggcagccggccgacguggugcuguccugcugccggagcaccaugaugucugcugcugagaccucccaucugacauagucccugucccucuucagggacuuuguuccuuuagcaguucucacugucuggccucaaauaacacgucuuuuucuguugguuccuuuuugcuccagcuguacuguaaacacucuuuguuuacugcauacccucaguaaauaccuguugaaugaccggauagauguggcagcagguacauuaccucaacuucugguacaccuugggagaagcuuucccaagaacacccuggguucauuuccuccuagccucugcucuccuggggcccagagauugaaggcgcuuaaccugcucaucucaccacgucucccgccuuaucucucacccuucucaucagcacccuacacuccaccacgcuggcuucauagcuccuuccccgaaugugccaggcuucucugugaccaucucuugagcguacagcuggcuauaccugggcugcccuccucccacauuucaggucucaguucagacacccgcaaccccaccauguaucuccccaguacagccauacuccucugccccugagcucccaugacaccugcuggggcccugacagccuggggcugugaucaugacuugcccaggggcccgaggguggaaacgaugcucuggcuccuuugauugcauagaacaggggccacucagguugacucaagagcaggagcagcgcgugggcacacguggacugcagccacacagccuggggaccaugcagugcugggagaggccggugcccugcucucuccccagcaccgucuaggcucugccccauucgcuucccuccaccauuguuaugcagcaaagggggcucuagccugaugugcuagaagcagucacacuggauuuuugagaaaagccaagcuuucuauugugagucgacucauauggagacaggaguugaauucaacccugucucccugugcuagcuuuaaggcgguaauuuuauuagaggagguuuaagggguggauucuaagauuagcaggugauugauggaaggaaaggagaagucuggacaguccuuggacaugcacaguuaucuguucaugccaacucauggguccccugugcagauuugggaggagugaguaugaaacgugcaguggcaauucaggcuuugacaucagcaaacuuguucugugcaagcugcaauuggccuuauugguuccaaccaauuucagccaguucuuuuaucucauaagcagagggaguuucagccuuucagaaagugguuucugcaaacucaaauuuucuuuuauuuuucugagacagggucuuacucuguugcccaggcuggagagcaguggcgugaucuuggcucacugcagccucaaccucccugggcucaagugauccucccaccucagccucccaaguagcugggucugcaggcacaugccaccaugcccagcuaauuuuuguaguuuuuguagagacagaguuucuccauguugcccgggcuggccucgaacuccugggcucaagcaauugccugccucagccucccaaauugcugggauuacaggagugagccacgggaauuuccaucaguuacugauucuugaacuuguaggaacgugguuccacuguccacaugcuguucuuuccucgcaucuccuguuccugcuucccuuuggccugcucaccucuggcuccucauggccccagugaaguaucguggcuuccucuccacugcagacuggcagauuucuucacucacacucccaaaaagagaaucuacuucccucccuucccuucguccaaccaucugggucucgagugucacuguagguucacugccguuggggcaggugacuccuugggccagucagcuuuggcugaagggcagggcuggcacacagcuggcagagccaccccauccaaaauccagccacugugccucagcagggcugugguuugggggucggggggcgcuccccacaggauaaggagcagccagggcaggcagaugacacuaccacuacuagcugcaucuggaucuauucacuuauucaacaaagguuuauuacacccauauucuaugccaacuacuguacuagacuuggaauaauggagaaaauucaggcacaguccuugcucuuagggagcucacaugauuacucauugaugaauaucucucuccccugauagacugcaaauccaugaggacagggacucugucuuguucugugccauaguuccacagcauuccagcaugaugucugguacucagcaugcaaacagugcguauugguugaaugaauaauaguacagcuaauagcagcugagagcuuccucugugcuagacacgauucuaggugccuuccacacuuugacaaccuuaugcagcguguuaacacugcauuccccuugcacccuggagauugagcccagagaagauaaggacagaggggacacauuccaagauagaucccccaguggaugccugaagccacagauaguaacaaacccuauauauacuguguuuuuuccuauacacacauaccuaugguaaaguuuaauuuauaaauuaggcacaguaaaaaauuaaagauaacuaauaaaauagaauaauuaugacaauauacuguaauaaaaguuaugugaauguggucucucucucucuccucucucuaaauaucuucuuguacucaccuauucucaaacuguagauaacugaaauugcagaaagcaaaacuguggauaagguuggggcuacugcaacucagccaaggacuuacaguggcagaccuggaaugcaaacccaggcagucugauaccaggguuucuccaccuguguucugccacaugggauggauaggauggauggguguacggauggacggacggacagacggauggacaaauggauugaaggauggguaggggagucaucagauguguucuccaacaccauguacaguaccuggcacauagcaaaucuaugauaaacauuugauaguaagugaauaaugaaugucagugccaguguugguguggccuuagguuauucuuuccagguguuguaucugaugcuggccucauauguuugucucacuuggcugacuagaaaauccaagagaggucccaagcaacuagccccucaccccaacaucauccggguucuccgcgccuucaccucuuccgugccgcugcugccaggggcccuggucgacuacccugaugugcugcccucacgccuccacccugaaggccugggccauggccggacgcuguuccucguuaugaagaaguaagugacagcagcgcggcagggccuggagcugauacaucucccaaggggagcugguuccugcccuccaugugcaccuugaucaggggguuuuggagaacagggucaucacccuuccggagaagaaagccaugcaaagggaacauaucugcccuggagagcauuuucccuguaggacgauuuuucauggaaacaaacucucaucuucauccagaacauacuugucaccuaguccuuuugguccauuugacuguuaaccuuuucuguggcuggacuuaucuguuuuuaacauaaaaaccguucuccuuccucacccucuguauccccuaacuuugcuauaguggguauuuuauuuuaaggaaauaauuaucugcaccauuacuuugaauauagggagccccaacucuuacuuccuaauuugaggauggugagugggagggaacagaaaggaugcuggggaaaagugggaaucaaagugcuccuggaaggggaagaggaacggccuaacccuaacagugauuaagguuauuaggaggccgggaaugguggcugacgccuguaaucccagcacuuuggaaggcggagguggguagaucacuugaggucaggaguuugagaccagccuggccaacaugaugaaacccuguaucuacuaaacauacaaaaauuagccuggugugguggcgggcaccuauaaucccagcuacucgggaggcugagguaggagaauugcuugaaccuggaagguggagguugcagugagccaagaucgugcuacugcacuccagcuuggcgacagagugagacuccaucucaaaaaaaaaaaaaaaaacguauugggagucgucgaugugugguagccagaggcccucuccccucuccgccagcuaucccuguacccugcgccaguaccuuugugugaacacacccagcccccgccucgccgccaugaugcugcugcagcugcuggaaggcguggaccaucugguucaacagggcaucgcgcacagagaccugaaauccgacaacauccuuguggagcuggacccagguaggaaccugcugcaccaucagagcucuccaggggcacuagagggugggucaggagcauuuaggacugacucuucagguccucucugguuuuguguucuaagucaugucuuuauuuagcuccgcacacaagagguuagcaaucucucccuuagaacgggguuuuuuuuucucucuuugcagagagacagcacuucccaaguuccuuucucuagcccacuuaaagaacaaggaccucagugcugcaaguuuuccuagguaaauaaagaggcccggcacaguggcugacaccuguaaucccaacacuuugggaggcuugcuugaggauugcuugaggccagcaguuugagaccagccugggaaacagagugagaucccuucucuacaaaaaaaaaauauguuuuaaauuagccggaaaaaaaguuagccaggcaugguggcaugcaccuguagccccagcuacuugggaggcugaggucggaggaucacuugagccuaggaguuaagagucugcaaugagcuaugaaugugccacuguacuccagccugggcagcagagugagauccuaucucaaaaaaauaauaaaaaauaauaaaguaaaagagaaguagacuuuagcucauuauaaaaaauaacuuucggccggggguaguggcucacgccuguaaucccagcacuuugagaggcugaggcgggcagaucaugaggucaagagaucgagaccauccuggccaacauggugaaaccccaucucuacuaaaaauacaaaaauuagcugggcaugguggcgggcgccuguaaucucagcuacuugggaagcugaggcaggagaauugcuugaacccgggaggcggagguuguagugagccgagauugugccacugcauuccagccuggcgacagagugagaguccaucucaaaauaaauuaauuaauuaauuaaauuuuucaaacaaugaaagcuguccaaauguaagcccaguugccucuggaaaugaguugccuaccacuggaagcauucaaguagaagcugaauggccacuugccuaggaaaauuguaaggagauucauacaucugauaaauuuuugaacuagaagauuuaaaauaauugacuagaggaacuggcuuuuauuauuucuuuauuuauuuacuuauuuauuuauuuauuuauuugagacagaaucuugcuuuguugcccaggcuggagugcaguggcgccaucucagcucacugcaaccucugcuucccagguucaagcaauucucgugccuccgccuccugaguagcuaggauuacaggcaggugccaccacgccuagcuaauuuuugauuuuuuuuuuuuuuuuuuuuugagacugagucucgcucugucacccaggcuggagugcaauggcaugaucucggcucacugcaagcucuaccucccagguucacaccauucuccugcuucagccucccgaguagcugggacuacaggcgcccaccaccacgcccggcuaauuuuuuuguauuuuuaguacagacgggguuucaccauguuagccaggauggucucuaucuccugacuucgugauccaccugcuucggccucccaaagcgcugggauuauuauuuuuaguggagaugggguuucacuguuggccaggcuggucucaaacuccuggccucaagugauccacccaccucagccuccaaaauguugggauuacagguaugagccaccacgcccagcugggaguuggcuuuuuuuuuuuuuuuuuuuuuugagacggagucucacucugucgcccaggcuggagugcaguggcaugaucuuggcucacugcaaccccugccuaucggguucaagcaauucucccgccucagccuccugaguagcugggauuacaggcacacgccacuacaccuggcugauuuuuguauuuuuaguagagacgggguuucaccauguuggucaggcugaucuggaacuccugacuucgugauccgccugccucggccucccaaaguucugggauuacaggcgugagccacugcgcccagccaggaacuggcuuuuuaaaggaauuuuguguggacccuuuuacaaauaaccaauucuuuuuuuauuuuuucugagacagagucucgcuguguugcucaggcugaagugauucuccugucucagccuccuucaccucccagguucaaguaauucuccugucucagccucccgaguagcugggauacaggcacacaccaccaugccuggcuaguuuuuuuguauuuuuaguagagacagggguuucaccauguuggccaggcuggucuugaacuccugaccucaggugaucuacccgccucggccucccaaaauguuggcauuacaggccaccacacccggcaauaacugauucuuaaugcaccugguucuuagguuuggauuugggguuucaaauucaaaucaaagucuccugggguauaagggcccuuggagaucauuugaaccaagcucuagcuccuuuggucuuggggacagcuccaauuacuagaacaugauuuaaauugagccacacaguccuuugccuggggauuuugcagccuguacuuacuggaggcauuuccguguucgcacagcaggcccuucugaucagcucucaggccuugcugaccuccugggccaacacugagccauuagccccugucagcuaugucuugcugguggcuuuaguagggacauaggagggccucucagagggaaggaggggaggagaaauggucacuuugcuugcuccuucccagacggcugccccuggcuggugaucgcagauuuuggcugcugccuggcugaugagagcaucggccugcaguugcccuucagcagcugguacguggaucggggcggaaacggcugucugauggccccagaggugagucccgagugugucaugcgccaucggcagcccuucccccacauguccacugaaugcaggagacucgaugccuugugauaacccaacaccuccaucuuuucugacccauaauuuggcacaaguuccuucccugccacuuugcuuuccuccggcguucccucauguuccaggagaaugcaaguccugucacauaaaccagguggucuaagcagaccccuucugggucugagccacagcucacucaagcucuggguuccuugggacagaguucagauuagcccauggaucaggugaugugcaggacaugaaaagguuagaugggcgggcagcgugaugucucacccacugcuucugagcagguguccacggcccguccuggccccagggcagugauugacuacagcaaggcugaugccugggcagugggagccaucgccuaugaaaucuucgggcuugucaaucccuucuacggccagggcaaggcccaccuugaaagccgcagcuaccaagaggcucagcuaccugcacugcccgagucagugccuccagacgugagacaguuggugagggcacugcuccagcgagaggccagcaaggugaggcuguccccggcuucgaggggacgguguggguagaaaccucuguucucguuccagagugaaggucagguuugggccagagccacagugacagauccucuguguuaggaagguaaaggcuaguuacaagagaacaaaaaacagauuuuaauguagguaggaguaggagcacuagccaccacagcauagucagaauccuagcaguucaacuccuguggcuuuuuuaguugcugaaaaaguuguucagaggccagacacgguggcuuacaccuauaaucacagcacuuugggaggcugaggcggguggaucacuugggaccaggaguuccaguccagccuggccaacaugguaaaaccccgucuguacuaaaaauacaaaaauuagcugagugucguggcacacgccuguaauuccagguacucgggaggcugaagcaggagaaucguuugaacccuggaggcagagguugcagugagccaagaucgcgccacugcacucuggccuaggugacagugcaagucuuugucucaaaaaaaaaaaaaaaaaaaaaaggcuauucagagagagaaaaggaggcauuuuugagaaauguuuaauggagauguagcucauggaagcagcugagaacugaucagagagagauggaaaacaucuccugagagcagaucuggacauugugaaauuaauauaaaggaaugcaaaggcagaccuauccgaagccauaauuggaguggcagcuggcucaggggcaggcuuagugcaaagagcugagccauaccugcaccccagcacuguucugccacuccguuaacugcucucuguacguggccugcuaucuuggugcgcagugaagguuagaacaacagcugcaaccaguuaugaaaugauagaggagacuacuuaccugguucaagggaccagauagcugugcacaagaggcacuaggcuuuccacccagggggaaaggcuauuucaacaaugcaugcugccccaugcagagguguacacauggaaaagcuuggagcacgggcaggggacaggcaguauuugucaccugagugaagggcaucaguaggagauaggguagaggaagaauuggguugggaccagagaagggaagacccucacuaacaaagcaggcuuuggguugagacuguguuaacagauguucuagcuacagcuucccuuccuguugcagagaccaucugcccgaguagccgcaaaugugcuucaucuaagccucuggggugaacauauucuagcccugaagaaucugaaguuagacaagaugguuggcuggcuccuccaacaaucggccgccacuuuguuggccaacaggcucacagagaaguguuguguggaaacaaaaaugaagaugcucuuucuggcuaaccuggagugugaaacgcucugccaggcagcccuccuccucugcucauggagggcagcccugugaugucccugcauggagcuggugaauuacuaaaagaacauggcauccucugugucgugauggucugugaauggugagggugggagucaggagacaagacagcgcagagagggcugguuagccggaaaaggccucgggcuuggcaaauggaagaacuugagugagaguucagucugcaguccucugcucacagacaucugaaaagugaauggccaagcuggucuaguagaugaggcuggacugaggagggguaggccugcauccacagagaggauccaggccaaggcacuggcugucaguggcagaguuuggcugugaccuuugccccuaacacgaggaacucguuugaagggggcagcguagcaugucugauuugccaccuggaugaaggcagacaucaacaugggucagcacguucaguuacgggagugggaaauuacaugaggccugggccucugcguucccaagcugugcguucuggaccagcuacugaauuauuaaucucacuuagcgaaagugacggaugagcaguaaguaaguaaguguggggauuuaaacuugaggguuucccuccugacuagccucucuuacaggaauugugaaauauuaaaugcaaauuuacaacugcagaugacguaugugccuugaacugaauauuuggcuuuaagaaugauucuuauacucugaaggugagaauauuuugugggcagguaucaacauuggggaagagauuucaugucuaacuaacuaacuuuauacaugauuuuuaggaagcuauugccuaaaucagcgucaacaugcaguaaagguugucuucaacuga

SEQ ID NO: 191426 - RNA, 33463 nt, Homo sapiens
ucauuugucacuugcuuuaugcaaacauucgaguguaccucuuucaccacagggcuagagauggucuacucuguacauacauuucacaacaaagaaaaauucugucauuccccaacucuaugaccaaggaaaacuuuuaggauuucuuuaauuuguagcagagacacaguggccuagccaaucggcagugcuauacacacaguaugccaguuucccaccccuacccucuuucuccuuuuuuaaagcuucaaagguuagaucaauaaaauuuaaaauuuccucauuuaaggagaaauauaaugacccacauguuaauuuauauuaaaaacuaaaaauaaauaaugggguucuuaaacaaggacaucuuuaacuagguuaugauuagaccagccugugggugaaaugagagauuaucucuucucccuggaaaugucuucaaggcucagacaauucaguaguuuuuaaaaggccccaacucacacaucucaggugaaaaguauaggcaaugggcaacaaacaagacgcuaguaugcacuuggcuucugauaaauugaaacaaagauuugguggcccagccuaauaaaugacagcacgaaacuagagguuuaaaguaaguuuugacaucacauauagaucccucaacccuaaguuacuuuggagggaagccaugagaggcuggaucaguccucaagccucagcuaaggauggauccuauuucuucccagugcaaaacaccaaauguaccuauaagguggagucggcaaggagaguuccccucuuacuuugaagcaagagauggaaaaagucagaaagauuucuagauaaaauugagaaacacaaaaggcaaaguaaagucaauuuaaacaggccucacaaaaaucagccggaauucuuauuaaaaaaaacaaaacagaacauucauggaugggcaaagaaaggaaacaaugcagacgccuuuggacuucaagagaaagcccaucaggaaucucugagagugucagcugagagaguucugucucucuccauguaggauccuuucugcaucauguauaucccaaaaggaguucugcgugaaggucauccaucuucccuacaguucuuagcugagcacugacacacacacauacuccaccaauccaccaaacugcagcuguagcugcuuaucugacccacacuccccuggcucuccacuuuuaggcacagucuuuguucuuuaucgccaggcccgauucaggagcuucaccugugccagucucuuagugaucaugguggcaaaaaccaggccaaagaggacgcugcugauuaacacguagucauagucauccuucagaacgucaaacugcuuggauggguagacucgaguuugguaaauguccaaaccauaggccacaaccuggaaggcagauggaauaagaauuaggaaagaaacaaccaaugauccaccaagggugaaauagggcagcugugggcucuacucaccaaacaaguggacuccagacccgagggagcuguguagauaccucgcauucgagaaacugucugguuauaguugaugaaucgcucugcguguaucuguacaucuggagaauacgggauuaaguucuccucucugcaaaacaccagccgggacaggcagucugagcacugcuguaaagggaucucuuggcugcccuuccugaguccugggagguuuccaggcuacauaucuagccucaaaucuccuaggaggucugcuugcauuagguaguuaaaaauuuagcagcugaauguuaggaaggacuacaagaaaggaagcucucuggagaguaagacugagaucuagauuccuacuuuguucuaaaucugaaaagaaagaacauacagaugacuggcacuucacaccacaagaggaaagccgaccauuuuaaagccaacacacugaaccacuaagcuaauuccugcucuccacuccagggugccucucaguccccauuucucugaaaccugauuaucauccugugucuuuuccuagcuuuaaccuccucucucucauauacuucuccaaaacacacuccucuccauuccucaugccccuaggcaaagaaauucaggauggagguaagaaaacccgacaagauggugguuguuaauacaacaauaccaacagugaauaagauauuggcuugcccacauggucuggcccgaauuaccucagugaucucauuuccuagcguugcccuccgcaaacucaccagacaugaucucaggggauuugcauugccuguucccucugccuagaaaguucuuccucagguaucuacacagcuagcuccuucaccuccuucaggccuucacucaaaaugcaccuucucaaaggggcuuucccaggccaccucucaaauuacacccacgcacauccccauccccacuuccuagcucauuccuguuuuacucugcuuagcauuugaguaccuaacauaguauauauuuuacuuguuuaucuuauguauuuauuguccauuucccagcagacuguaagcuccaugagggcaggugacuuuuucagacuugcccccugcuacauccccagccccuagcacagcaugaaggcacacagagaccaagaaccaagcuuaaucagugagguuaaguuauguaaggucagagccuucagcacugcccaugagggucucaccugcuuuguucuguugggaucucggggcggcggggauccagcaaagccuuaggaagggaaagaauugcuccagaagguaguccaacuacacaggaggaagugaauguucacaccgauccaguguccagcaagggccaguuacaaaaaugucauuauugcagacauuuaaauaagaauuuaaaacaaaaaaaugggucaaugaggcucccuuacauagccaaaaauaauaauccaaugauacgcaugggucugaaugaagguucucacuuuugaagacacugguuucuuaacuuucugagacaccagaaaauaaaguucuagaaucaagauauggauaaugaugaaagagaaaaauguagaaggccacuuggauuuccucaugccucuccccggggccucccucccauaccucccccagcaggaagucuccuucccauugagcaaacgcagcuguucaugcagcugcgguacaguggccagggaagacuggaggaccaggcaugaucaaucauagcaccaguuucaguaauggugauuaaagcugauaaacugccaacagggcuggcuucuucauauuuaagaauucaauaggccagucgcggcggcucacaccuguaaucccagcacuuugggaggccgaggcagguguggaucacaaggucaggagauugagaccauccuggccaacauggugaaacuccgucucuaccaaaaauuuaaaaaugagcugggcacaguggcacgcaccuguagucccagcuacucagcagacugaggcaggagaaucacuugaaccagggaggcugaaguugcagugagcugagaucgcaccacugcacuccagccugggugacagagcaagacucugucucaaaaaaaaaaaaaaaaaagcaacagcaaugccaagugcccaucagaucugagagucccaaacaucuucgguaaaaucaacuaaacacaggaaccuguuaaccacuaaguccuaaguccugggcuuagguuacauaaggaugagauuuuagggcuggcgcaguggcucacacauauaaucccaacacuuugggaggccaaggcaggcggaucacuugaggucaggaguucaagaccagccuggccaacauggcgaaaccccaucucuacuaaaaauacaaaaauuagccgggcgugguggugcacgccuguuaacuacuugggaggcugaggaggaggaucacuugaacccaggaggcggagguugcagugagccaagaucgugccacugcacuccagccugggcaauagacccugccaguuucugcaagcugucagcacaggcuagcuauguuaacaaugcuaucaggaacugacuuuuugagcuaggugaaaaugccaaauagagaggugguauaucagaaaugaggacugaaggccaggcagccaggcacgauggcucacaccuguaaucccaacacuucaggaggccaaggcaggaggaucacaugagcccaggagucuagaucagccugggcaacauggcaaaucccugucucuaccaaaaaaaauuuuuuuaauuagccaggugagcucaggagguugaggcugcagugagucaugaucacaccacugcacuccagccuggaugacagagugagacccugucucgaaaaacaaaaaaaagaugagaacugagagagaaguggucaccuucauagguggcaaagaugaacuaagaaacuuuuuccaccgauauauagcccuccucaccaccuuucccuuacaggugguucaacaaggcucugccagcaaugugucccuugcucuguccuuaagugugguugcccaagggaacccagccaucccagaggcuccccagucacucacucagcaggugucggcuggugaugccccguucggugaugguggccuccauggcacugauggaggacgggaagauauaggacugcuggaggaccuggggcagcugggggcgguccagggagcugaaggcgguggcguuguauugcucagugcccucauagagcuccaguacgguaaacucguugcgccgagccuugguguuccaguacugguacugcagggauaggagguggcagcucagggcuuagcagcugcuucaacuggaaagggaaauugcacuggaaggcaccccucuaauuagcuacagauccaugaaggagaaccaucaacuagcaccucacuuuucuuccuuacuaucaaguuuacuaacuuucaaaguaguuuuaucuaggcuaucgaaaguucaccacaaaacaaaggaaauucucaagagucuuagaagccauaauaguagcuaaccuuugaaucauuacuaggugccaggcauuguucuuugcuagacugaaggugacuguuauuaucccuauuuuaacaaugaugcaacacagagcguguacauaacuaguucaagguuauacagucaggaaacggaagagguaagauuaaaccuaggcaaucugauuccugagcccagugcccuaaccggcacgcuuugcugccauccagggaauuugagauccuaagaaaaccaaagcagcaacuggguuucuggaaaggacucaggaggcagggagaccucuggagcuaccuugggucccugguagugaccgcuuaccaccacccaguucucugaaugcacgauauggacagggccuuuggcuuucuucugcacagaggagugaaugauacgcccagugacgccaucaaugaggaagaugccaauaaaggugcgcucauggugcgcgucugugcucucugucaccacggccagcagguugggguucaggcucuggagagagagagaaaaccucccuuagaaccacgacgacucaucacacacuccauuccugugcugugagaccaaccuggagcucuccagccuggcagaggaaucaggguuucuggugaaaagagcuuccuguuuggaauuucucaucacugcacuuguuuuaugugcauuggguacugggugccaugccagguaccuuguauuuuaucuaaucccuuaaacagucuugcagaguagcuauuaugguccacauuuugcagaaaagucccaaaguaguuaagcagcuuuucaagucacagauagcaaaugguaacccaagacaaaauccaggucugcccacucauugaccuagggacaaaugcugcagugauauuuuucuucugagggucaccaccccccuccccaucgcuaaauccaguggcuaagucuuggcccucaacuuacuugacccacuaguaccacgugacgcaggugaucacuaccuccuugcgacauuuucucaccuggcuuccagaacaucccugcccagcacuccuucuacuuuacuggccucuccuucucagucucuuuuggagguucuuccacaucuccccaguuucuucaugguggaacacaucagaaagcucucaagccuugagcauuuccgucacacuuacccucguggugaucucaagccaaucucauggcuugaacaccauuuauggauguuggcaaugcccaauguauauauccaaaccagauacuccuuugaacuccagacuucacuaagaaauuaucucaguaucuuuucucagauguuucaucugaaacuuaacauggcccaagcugaacuguucuaacuccugccuaaaaucugcuccucucuccuccccagccagucacgacuccauacaucaguggcucagaccuaaagccucgaguuauccuugacuccuuucucuguaacacacauauaccugcucuuggcucuaccuucaaaaguacccagaaccugaucccuccuucccaccuccaugcuaccagcccagcuccagccaccaucagcaccuggaugaccccacagccuaaauggucugcuuuccuccucaccccucuacagucuaaucuaggucaaaugagccuguggaaucucagucacugaugucacuccucugcugaaaacuucccaguggcucuucaccgugcuccaaagugaaggccacggugguggccugugaucuggcccuguugcccucugcccucagcaggccugacaugccuccucacucaucaucuucuaguuaccuggucuucuuugcuguuucucacacauaccaggagcacuuugacuuuucucucuggaaggcucuccccgcagcuacccacacaacucacuuccucacucaaguccacucacuccgugccacuuucucacuaagccccuccuuagccacccgacuuacacuguaccugcuuucccucuucccggcuuuauuuuucucuauagaacuggucacuuucuaauauacuaucuaauuuaccuauuuauuuucuuuauuauuagccucacccaacuaugaugaaagccucacgaggucaggaaguuuugucuguuuugcccauuuuauaucccagugucuaaaugagugccugcauccagcuagcacucaaaaacugcuugcugcuggccgggugcgguggcucaugccuguaauccuaacacuuugggaggccaagaugggaggauugcuugagcccaggaguuuaagaccaaucugaacaacacagcaagaccccaucucuaaagaaaauaaaauaagugccugggcacgguggcucccgccuguaaucccagcacuuagggaggccaaggcgggcagaucacgagaucaagagaucaagaccauccuggccaacauggugaaaccccaucucuaaaaauacaaaauuuagcugggcaugguggugcgcgcuuguagucccagcuacucgggaggcugaggcaggagaaucucuugaaccugggacguggagguugcagugagccaagaucgugccacugcacuccagccuggugaaagagcaagacuccaucucaaaaaaaaagaaaagaaagaaaagaaaauaagccauggugacaugcaccuguugucccagcugcuuaggaggcugagaugggaggacugcuuaagcccgggaggucaaagcugcagugagcugugaucacaccacugcacuccagccugggcaacauggcaagacccugucucaaaaaaaaaaaaaaagagucaauagcacuaauaauaauguuaaguauguggcaggcacuauucuaaucacuuuacauguuaucauuaaucuucaaaacaauccucugacguuggugcuauuauccccauuauacuggggaaaauugaagcucaggcagccuaagagaugaacagcuaggccacggcagagccaagucuuaacagucaaacuagaggcuugcacuguguugcacuggcucaugcuuagugauccagcuuuaccgucaaguuccgugaucucuauucuaugacacccccuccaauucagucucugcuguaccagaggguguaauuaaugugcauuacuacuaucauuacauucucucccauaacaguuuugcagcccacuagucaccuuaaucucccucucuuuaacacuaacuagaguguuggaucacagagauggaguuucugauggcucgacuaugguuuaaccccagaaugcucuaucaguacuaccacuaguaauaagagcugggcuaggcgcaguggcucaagucucuaaccucaacacuuugggaggcuaagguaagagaacugcuugaggccaggagauagagaccaaccuaggcaacauagugagacccugucaauauaaaaauaaaaaauuaaaaaaaaauuuuuuuuugaagacaggguuuuacuauguuuccuagguugaucucuaucuucuacaaaaauaaaaaauuuaaaaaaaauuuuuuuuguuuguuuggagacagggucucacucugucacccaggcuggagugcagcggcacaauugcagcucacuguagccucaaccuccccaggcucaggugauccuccuaccucagccucccgaguagcugagaccacaggcaugcaccaccaugcccagcuaauuguuuuuuuuguuuuuuuuuuuugggggugguaaagacaagguuucagccauguugcccaagcuggccucaaacuccuggacucaaguaauccacccaccucgaccucucaaaaugcugggauuacuggcaugagccaccaagcccagccguuuuuaaaaaauuagcaugacaugugccugugguuccaauuacuugggagacugaggugaaaggauugcauaagcccaggaggacgaagcugcagugagccaugacugcaucacugcacuccagccugggcaacagagcaagacucugucacaggaaacaaacaaacaaaaaaaaagucaaaaaaauaagagcuaacaucuguugcuuacuuaccauaugcuaggcacugggcuagacaugaacaucccaugugaucaucacaacaagcccaggaggaggguauauuauccccauuucacaaacaaaaauuaaggcucaaagggauuaaaugacuuacucaaggucauauauguaccaaguccuacagccagacuugaagcccuuguuuuccugauucgaaagcccuugcuguagaccagacagcuggcuguauguaccuuguagagcacacugcggucccccaucacacggcccugggaaugaacgugcucacugcugcguuuccccuucaccuugacgauccgcuguacuucugggggaauggucagcucccaacucagcucaguggugagauccuagggcaggggcaaaaaagccuguaaucaggaggguacacuuagaacugaaacagcuggaguuagacacauccuacaguucauuauuugaggccuuugugcaggaaggaauagagaucagaacuagaaaaaugagccaggagcaguggcucauucuuguaaucccagcacuuugggaggccaaggcgggcggaucacuugaggucaggaguucaagaccaaccuggccaacauggccaaaccccaucucuacuaaacauacaaaaaauuagccagaugugguggcaggcaccuauaauccuagccacucgggaggcugaggcagaggcugcagugagcugagaucacgccacugcacuccagccugagugacagagcaagacucaaaacaaaaaauaaaccagaaaaacagcaauagagaucuaguuuaugaagaaauuucagaacucucgguuugauuaagauagauacuagaccgggcgugguggcucacaccuguaaucccagcacuucgggaggccgaggcagguggaucaccugaggucgggaguuugagaccagccugaccaacauagagaaaccacaucucuacuaaaaaugcaaaauuagccgggugugguggcgcaugcuuuuaaucccagguacucaggaggcugaggcaagagaaucacuugaacccaggagguggagguugcagugagccgagacugcaccauugcacuccagccugggcaacaagagcgaaacuccggcucaaaaaaaaaaaaaaaaagauaauaaagccaguaggaaaggaggcgaacgcucaauaguaucccguuguuuaucugaguaggaaauaugcaaggaaaauuuaccauuuauuacuaaacuccaagaucccuguauacuggggccagcagugaaugucuaagcuaacagggagcucaaaacauuucguguaugauuguuuauggucauaggaaaccaaccaauaaacacucaugguuaaauacauuauuauacauccauccuauggaauuaugcggagcccuuggggguggagacaggagguaguuacuggcaaagggcacaagggccuucuaggagcuggugcuauucuguuuccugaaguggucaccagguacacaaguguauucccuuggugaggguucacugagccauaccucaugauuuugcacuuuugucaauauuuuucuguaauaaaaaacugaaguugacaaaacaaugagguagaaaacccauuaaaugaaaaaaagcaaauuucauaagaauaaauauaggucaauugcaugugaaugagaaaaaaaaauaaaaugggccgggcgugguggcucacaccuguaaucccagcacuuucggagcccgaggcgggaggaucacuugaggucaggaguuugagaccagccuggucaacauggugaaaccccgucucuacugaaaauacaaaaauuagccaggcaugguggcgugcacauguagucuugggaagcugaggcaggagaaucgcuugaaaccaggaggcagagguugcagugagcugagacugcgccccugcacuccagccugggugacagagcgagacucugucucuaaaaaaaaauaaauaaaguaugagccacacacguguguccacacagcuguugauagggaaucauaaauacacaaggacaguagaaagaggcacagcaaacugcugacaggcuuuccaccuggggaggggaagaccgcugggaauggggcuacaagggucuguucacauuuugcuuguucaccucucuguaucaauggacucuuuuacaaugagaauauacucaauguauuaccuaaauuuuuaaaauagugaaaauuauuaauaauaagccuucauugccacaaccuucuuugaaaacauaagaacucacuaaaacauccccagagaggaaggucaccaagugagggcaaaggcagcacacucccuuguggucccggacucgcgcacacagcuggcucacuucccacagacagcucugccuccuuugucuuccuuggucauuguucacucagaugauguccucaggacuccagauucaugacacccacacuccaguucacuccccugaaucuacaaaacugucucuuucaagguccucuuuuuauuaacucagaaggaugauuuuauuuauuuauguuuucauucacaaggguaaaggaugugucuucugggcagaccauuuccagugcuguuuaugcuaagguuagcuguuacaaaugucacaaaagggcgcugcauuuucaaaacaacagcaccuccaacucagauggcauuuaccaugugccaggcaguuuuaugugauuuauguguugaauucucacaacaaccuuaugagacagguacuuaucaccuuauuuuacagauaagaaaacagaagaccagagcccaaggucacaaaguuaguaagugacaaaccuagacuuccaaucuagcaaauugguuaaacucuaugccucucaaaaggccuuacaggacaggaugggagagcuguuugugaguacacaccacagaguacuucuccaaacaguccugcuaacaaggccaugccagccccucgugaacuucagagcuggacuucacagccagcguguauuacuguuuacaagaguuggucucaaguaugugaggauuaaagcaaacugacccccuuucuagaaauaaaauucaaagcacacauuccaucacgaguuggucaacaucaucuucauauaaaaguacaacuuauuacucaacccacauuccuaccuucuacccucccaagaauggaaaaaaagucccaucucucugcuauagaaaaauaauggggccaggcgcgguggcucacgccuguaaucccagcacuuugggaggcugaggcagguggaucacaaggucaggaguuugagaccauccuggccaacacagcaaagcccugucucuacuaaaaauacaaaaaauuagccgggcgcgguggcgcacgccuguaaucccagcuacuugggugucugaggcaggagaaucgcuugaaccaaggaggcagagguugcagugagccgagaucgcaccacugcacuccagcccgggcgacagugcaagacuccaucucaaaaaaaaaaagaaaaagaauguggaaugaaagcuccacaagggcagagauuuguucuacugugcaccacuccauccacagcaccuagaaccguaucugccauguaguagcugcccaacaaauaugaacaaaugauugacuuuguaucagacaucaggauuaugcuaaucuaaguuuacaguagaaugaguagcauaauucacuucuuagccaaauggccaggaaacaccugcaucucauccacaaaggguugugccaggacaugccuuccuaccuuucgaagccgauauccacacagccgucccugcucugcauccaccaaauagaagaagauggaaggggcaagcucauguagcugucgcaagacauuccgaguggcuggaaaagcugugaccuugaaaaacccagagagcccaaggaaagaguuaggaaauuuccccaucaaagagagccuuaagaauaaaacugcaaaucaguugauuugaacucaguuuaggguuuacauucaguucuguuaagaaccugaguuuucacaaaugcagacacagccaucauuucucuucgggauggccuuagagcccaaacacgugcugggugcagagagcacuccaucuccgggccgcuguguuugaccaccuggccccaaaccggacuccgcuagcauguucuccauccccucugaagacaguaccuuguauucaucaucuaucaacagcaacaccuuggcguagucuugauccaugacugggagaagcaaggacugcaagauggggcgcuucagcacugggggagcuaccugacuccacuucccaaaaaugggauugaagacauacagagaacucauucccgacuccuaaaaugagcaaacugucaggcuccaccaacaagaaaagacugcaaauccuagggauagaccugaagagcugggacuccagcucaacaacuguggggguucucuagucuuugcccucuuuguggaaaauaaguucuuggcuguaggugaauaguccccuaggcuaacgucacaaagaaaaaagucaaacugucucugccaguucuuuuucguuugagacagggucucucucuaucacccaagcuggaaguacaguggcaugaucaaggcucacugcaaccucugccucccagguucaagugauccucccaccucaaccucccaaguagcugggacuacaggcacaaaccaccacacguggcuaauucuguuuuuauuuuuuguagagagggguuucaccauguugcccaggcuggucucgaacuccuggacucaagcaauccgcccuccuuggccucccaaagugcugagauuauaagcgugagccaccgcgccuggcugcucugccaguucuaaacaagaacuaauaaaaaagucaaguaacaauucagcaaccuggccgggcgugguggcucacaccuguaaucccaguacuuugggaggccgaggcagguggaucaucuaaggucaggaguuugagaccagccuggccaacauggugagacccugucucuacuaaacauacaaaaaucagccgggcaugauggcgugugccuguaaucccagcuacucgggaggcugaggcacaagaauugcuugaaccugggagguggaggcugcagugagccgagaucgcaccaggcagccguuccaggaaagugucuaccaagcccgccuucuaugcuagaaugaauacacaaaaauccauucuaauucugggaagacacaaaaauaucuuuguguccugcucuuccucaaagagagaagagaaaauagccacucagcaaccaacagccaauguuuagaaaagaggagagcuggcucccuacauagcuggugaagucacacccacuuucuaaacaauuccacaucagugcuggaugguuccuccacccaugcaugaaacuagaagaaacagaguucuaaccccugaauguuccucauuaacucacacaauuccaagggccuaggagcaauuuaaguuacaaaauagcaaaaaagccacacugagucuggcucaagucagagcuggaugccucaccuuguccuucaccagcagggugcacugugggggaugggggaaaugagcaguaguucucuggaccaucaguuuaaaggaggagucuggcuugacauuggguagauacuguuuccacaggauggugccagagcugcucucaaugccaaaaagcugcaagauaaacaaauacuuggcucacuacuagaaagagaaaccaaagaacugagucuguccuugaaaacuagaaccaguguuaucccucacugaaggcuuuuuguuccucacccucagaauuugaaaagguucaguaacuggagcuuaaaccccacucaccuugccugaggcuguuaccaucaccaucaucuucuggagguugaauucaucucuggccagggugucaauguugaucucauucuuaaucugacuccggggcuuccgagcaucauaaaacauuuuccagaggugggaaguccaugcuugcagcaggauaagcugagacgagaggcguuucaggaacauccccagcaagccaucugguguaaaggaaaaguaacauacucuacaucagacuagggguccauaaggagguacaugauuuuccuaaugagggaucucugccucuccucuggagcaauaaaguccacacucuaggccacaagcccaaagggcaguccuguaucugaugcccaaagucucacacucaggugaggcucaugcaggagcuuccaaaaacugcuuaacuggcucuuaacaacuaaacccagcuggaaucuuggaauaggagacuaagaggucagggaucaggcaugcaggagacagccaugcugugaaugucuccaccacagccccacauccaagaugcuaaaagaagguuucugggugccaugacaaagccagaagagguaugaguguggggguggagggugcaggucagugaauauguaucaugagcagguacuuccaucucccauugcuucauuccuacuuugucagcuguuuaaccugcacccaacagacguacuugcaacgaguucccaggaccaucauucacucuuucccugauuccgucaaugaagccacugcccuccaaaucuccuccauuggagaccacagauuuguaaacagaugcaaggaagcaagguaaagagcauggucucuggaaucuagcaggcccagauuaagaucccagcuucaccacucacugcgggguaacacugagaaauguacuucaccuuuuugcuucugguuccucaucuguaaaguggcauguaacccacuggacuguuccaaaauuacaucauacgauguacauaaaggauuuagcgugguggcugguacaugguaauaacucacuaaaaaaggagcagaaccucugcuuaucuuauuuuccacccaccucugcucaaggaagagaagugagaagcaacaggacaacucacaagcauggcagucaacacacacacacacacaccccaaggauguaccucauugguccaaguuaggaagaaaaacaauuaaccaaaagcuagccaugugagcaggcaacgagcaacaaggcagcaagaagcagguuuuaccuugaauugcuggauccaggcagcagaaauaaacaguaaagucaaauuaauccucagcuuaagaaaaugugcauugccuagcagagugccugguccagagcaggcccucaacagcuauccguuggagggcuggaugaauggagagaagagagaggguggggggcaggacugaaucagagcagagugaaucaaguucauccuggcaguugggaccauggccagcuuuagagggcacugggcuguuuccacaauacccagaucaacccaauggugucuccagacagauauggcugcugcuuuagggacaaugaguauaaggugccuggcaaauuuuuaguacacaggcaaugguagcuauuacaauaccaaguuaagacuuuauuccccccaggcgcagcagcucacgccuguaauccccaacacuuugggaggccaaagcuggcagaucaugaggucaggaguuugagaccagccugaccaacaugcugaaacccuguugcuacuaaaaauacaaaaauuaaccgggcaugguggcgcaugccuguaaucccagcuacucaggaggcugaggcaggagagcugcuugaaccugggaggcagagguugcagugagccaagaucgcgccacugcacuccagccugggugacagagcgagacucuugucucaaaaaaagaaaaaaaaaaagacuuuuuucccucagcuuucccuagagggauuuuucccuagcuuucccuagaaggauucacaguucauucuuucacagaaaagaaugguuucauaaaccauauggccaugaaugcaccggaaccucaucacagagcucauucagaaaagacuagcaaucugcccagccuaggaagccagagaugcaugauacagugucucuuguggucauuuccagacuggccccuccagcaacucugcagcuccaaccucuuagguucauaccugccuuuuugccaaauucuccuuccagcucggccugugccccagucagggggagguccaccaucucuaggcacaccacuucugccagggacuccucacggcuccacagcaccaccuucccugcuacaggaaacauuuuuacaaagcuaagccuggggcugggcacaguggcucaugccuguaaucccagcacuuugggaggccaaggugggugaaucucuugagcccaggaauuugagaccagccuggacaacagggcaaaaccuuaucucaacaaaaaauaaauaucagggcugggcacaguggcucacgccuguaaucccagcacuuugggaggccaaggcgggcagaucacgaggucaggagaucgagaccauccuggcuaacauggugaaaccccucucuacuaaaaauacaaaaaauuagccaggcaugauggugggcgccuguaguuccagcuacucgggaggcugaggcaggagaauggcgugaacccgggagguggagguugcagugagccgagauugugccauugcacuccagccugggcgacacagcgagacuccgucuugaaauaaaauaaaauaaaauaaaaauaaauaaauaucaaaaaauuagccaagcaugguggcgagcgccuguagucacagcuacuuaggaggcugagauaggaagaucacuugagcccgggagauugaggcugcagugagcuaugaucacgccacuguacuccagacugggcaacagugagaccuugucucaaaaaauaaauaaauaaauaaacaaaagcuaagccugucucccagauuuucuagagagacucuucucgcugacucagggauuacuacaagcucuugcauaaaaggagaaauggcagagcaaggggcuggaaucaauaggucaaaggaggaaaguucuguaucccaccgagaaugccaaguuauucuucaaaagcagguaacggggccgggcauaguggcucaugccuguaaucccagcacuuugggaggccaaggcgggcagaucaccugagguuaggagcuugagaccagccugggccaacauggugaaacccugucucuuacuaaaaauacaaaauuagcgccuauaaucccagcuacucaggaggcugaggcaggagaaucgcuugaaccaggaggcagaaguugcaaagagcugagauuacaccauuccacuccagccugggcaacaagagcaaaacucugucucaaaaaagaaaaaaagagccaggcacgguggcucacaccuguaaucccagcacuuugggaggccgaggcagguggaucaccugaggucaggaguuugagaccagccugacaaacauggugaaaccccaucucuacuaaaaauacaaaauuagccaggcgugguggugcaugccuguaaucccagcuacuugggaggcugaggcaggagaaucacuuaaaccugggaggcagagguugcagugagcugagaucaugccacuguacuccagcagucugagcaacaagagcaaaacuccgucucaaaaaaaaaaaaaaaagcaggugacaggccaggcacgguggcucacaccuguaaucccagcacuuugggaggccgaggcaggcggaucacuugaggucaggaauucgagaccagccuggccaacauggggaaacccugucucuacugaaaauacaaaaauuagcuggucgugguggcacacgccuguaaucccagcuacucaggaggcugaggcaggagaaucgcuugaauccgaaagguggagauugcagugggccgagaucaugccacugcacuccagccugggcaagagagcaagacucuaucucaaaaaaaaaaaaaaaaaaaaaaaagcaggugacauuuggcuaugaacgaaacacucagggcacacuccacuugaaucucuuccagaaaccugcagccucccaaaaaacagucugauuggaacacauuggaaggccuggggaaauaaaaaaauggguugaaugaggucuacuuacccaacugcugcaggaaaaguagcagaugauccucugucugcaccaaagcccgguagcccacugagucauccuucuucaagaacaccuggauauacagcuauaagccacagucaagaccgguguagucagugaggauccaaaugccucugagagcaccagaccccaggagucaaagccuggacuuaacagagguacaggccauggcauuauuugaugucuaaacaauguagcuauuaucuggaugccaguaagugauacauauucuuaggagccaacauaaugaugcuggggucucccagaccuuuccauggaagaaccugaguacuccacggguaccacgccauucauccaugcucuaaucacaccccacaaagugagcaggaggccgggauuagacuuuccgcuuuagaaacgaagaagccacagcccaagcagcugaggaacacaaccagaugcacacagaggcaauacuggguagugaugaggaguccaggcugugggguuagaccugaaucugaaccgcagugacaccucuuacuggcuccgugacucuggcuaugguacucgaucccaccaggccacagaaucauuuuaaaaccaggucaggaacaaccgcuucaugagaguguuuggaggguuaaaucaauuaauguguaaguuaaaagcuuagaacagucccuggugcacaaugaugagcuggcauaaauaauacccgccuuuacugugacuucuaacaagucaguggcucagagagcacuagaacacauguuuagagagccuaauccaagccccauggcuaagaccuggcccugaggaaaggaagccaugugcugagaagcccacaggacagucugcaaagaaaggcucugccuuacccgcucaggccgagugccgcucuguuccaggcuaaauguuaucgugguguccagcagccgccgaccugucuccacgagguauagguuaaugguguaggucugauugaagcaagccagagaguccuaggaguacagacagcacgugucaacuacagguaucccccgaaagcaaagcccaccaaaggaaguccaaggauugggggcaaauacccuagagaaggagccaggccagaaggggaaauauaugcaaaggagaauaaaagagaaaagcaagcuaaauccuaaggcagaaauaaggugccugaguaaauaaaugaaauuacaacuaccauacuugucuuggaagccaguacagaguagcagagacuucugagagagagguagggcugagcaagguaagacugagcaagacaggaggcagggaaacgcuuagauggaagccacagcaggaaccuaugccuccagccaggggcucaugccucugcuacaggguaacugcacagaguacuacucaacugugccagccaggaucccaaaagaaauggggacgcugaggcccagaggagaaaguggcuagaaacagacucuagggauucuaccuccuaaucucccgguaaaaugagauuaagagaaacaucauuuaauuuacaguacuuaggaaaccucauuugaagcugggaacucuaggaccugcuccuaaccaaagcucuucccccaacucucuuugguggccuccugcgucucuaggucuggcauacugcccagugccacaccauaccuuugaacuagacuucuccgaaaagcuccccauugacccaucuucagaacugcuacuuuucugcuaugagaaagagaaggacaggagaaaauucagccaaagggucacuucccagucacugaaaugaagcuuuuguuuuugucuucuuagcacuugagagaagacaaagcucauuucucaccccugcccacaaagccuauucaacccuuaauagccccauaugaaaguaaggucaucacauuagggucucguuccuggggagaaauggggugugcagaaagcucuauaguugaggcaagaccucacuucucaacagccuccugcccgcuggguucaaacugaccaggucaaugugcccagacuucugauuuucaggguuccuaguggagaccaggaaggaaaaucccaagugcugacuguuguucucaauacucaccacuucauuccgacaggccaugacugcagccaccgucuucuccccagugguggcaaagcucacuagggcagucugggggaaaagcaaggcaucagcuccuaaaugggaccaguacuagccagcugccuuacagagggucaccucuccagggaaggcccuuggccuuagaguugaaagugcuccccacuuuggagcagaauggucaggcauuuaagagcagagggaggccucaguugcaucuacagcugaaaacagaacucucccuaccuccaacgcaggcacaggucaaucuuaaaucccaugcugcuuguucuuacuaucuauggggaagcucucauuuauguccccauauuuccuuuggacuaaggaaggcacuaguuuugcucuaaagauccuuuguaauacucaggaggaaauacaccauuucuaugauaaggcuaccuacccccucucaaaccacuuacgggaaggugucaucaaucuugggccuaagagcaaacguuuccagauucaaaagcacugccuucuagcauccaugucuuggagagaucuccugaauccuagcaaaccauguugccugcaguuaccugugggaaguuuuuaagcaaacucagcguuccauaaugguacugcagcagagcauaguggcuuggggacaagugcaggaagaacugggcccgggaagcguccacuggguugggcuggguaggcaggacccgggguuggaauccacuuccaaauucuaagucgagagacuggaaggcaagaaggaggaggauuauggcuaacagcugacgacucccugacccaucccaggcucacaaccucugcccuacuuugccgggggaaguaacugggccauggcagguggcuccaaaugcuccaguucaaguuccccaaagaggaaagugacugauuuccucuuacaccaguucagccagaggccugaauggcuuccacugcucaggaagagucuaggagaaagacccuccaggggaaucaugccaaacuuucuacuccccgcaggaaaugccucaggccagaagaagcaguggcagccucucaccugcagugggaucugucucaacucccauuccgucuccagagccaaaguuuggagggaacgugagcucgggucaggacacaccaggacagccucauccaccacaccacaggcuccagacaggugcugcagccacggaguugaaacccuaaccuacagaaaagucaucguuaacaggaagcucgugaaagauuuuuacauuucccucucagcccaacagcaauauugcugccagcaucccacuggggguccuaagcucaaagguucuucaugguugguuguauaggaguucuuccuguccccugaaaccccacccuccaaccuccugagagccuucaaaguuggaaaaaauaucaggauuuucuuucuggucacuggaaaaauauauccgauaauuuuaaauaccuggcacuucagaaucagcacuucuuuacuauauuugccauaugugguguccuacugugauuucacagcacuguaagauacuuacaggcagagacuagaucuauguaauuuuuuagccaccccagaagauaacacaugcaaauaugaguacuuuaaauagaggccuaaugggaaggcagcuggcaagugaccagaaugagggagcauaaguagcuuuugcaucugcccagccaaguucccuguuccccaguacaaagaaaucuaucaagucucccccaaccccaccuuauucacaggcuccugucacccuccuguaccugcugaacaaucucuccaucuuccacauuaaacuugacaauguucacauggcugaagggaacaacuccgagggcccacaccaccccagagccguaagaauacaccaucugguaguggaugcugucacuaagagagggaagaagaaaccgcagcgucagcuuucaacccaggacaggauuauccucaggggcugccaggccucagccagaugucacaaacuaguaauucccaaauagguuuuguuuggcucacacaguuugggggcuuuuguuguuguuguucuuaauuugaauuaguugucaacauuuagaagauauuauacuucacaaucagauuucuaaauuuuccuacgguuagaagauguggcaacacuaggccuaaauacagagcaccaaucagguggguaaggcugcccccuccaggcaggccaggagcacugcagcucccauccagccaguguugcucauggauauuucauaacccgccucauagcauuuucuuuguuguguuuuuuuuuagacagcgucucacucugucacccaggcugcagugcaguggugcgaucacggcucacugcagccucuaccucccgaggcucaggugauccucccaccucagccucccaaguagcugggaucacaagcacgcaccaccaugccuggcuaauuuuuuguacuuuuuguagagaugggguugcccaggcuggucuugaacuccugagcucaagugaucuacccaccucaggcucccaaagugcagggauuacaggcgugagacaccaugccaggccagaauuugaaguuuugaguccugcucuaaacuuugaaaauggccacagggugucuaaguagauccuuuuaucuuguuccuucucucuuguuccuucccaauuucgaugcuuucuaccagcaggaccucgagaaaccauuucacaccucacucagccuacccugggucuucuugaguuguucuaacucuuaauaugaacgaaaggcucagucagaacuagaacuagaacuagaacuugaacuagaagucagaaggcacaaaguaccauaaccaugagcgagugaguggcucccguagcauggcucgcccuagcaccccaguuugagaguguucuccucagugcaaaggaaacuccaggcauacuccggaguuucacccauacucacagccuucaagauauucugagugcaacacacuccauggaacaccaacaagagacaggccuggguuaaagcaaaugcuucgggucccucgaggagaaagaggagcuccuagagaguagaacgaggcagcuauugccugugagcaggcagccuuaccuuucugggagauguuccacccacuugaggugcccacuggagaggugauggagggcaaguguagucuucuucaggacugcgauguaccuuacagacuccugcaggccaaccagcccaagugccuggaaacugaacacaaguacagguugagagcagcccacaccugcagagccucaggcugggagagacaguccagaacaguacccacuguugcuuaguggguaagaaaacaggcuuuggggucaaacacagcuggauccuaacccuggcucugccucuuguuagucaacuugagauucugcacuugcaaccauuuggccacacuacuugcuucccugaaaccaucuguaucuccuaagggcuguucccuccuuccccugggacuucacagcaacuggaccuacccucugccacauauccaugagacagugcugucauuacugugcuaccugccugccucccaauggacagcggaauccucaaugacagcaacugucucacagucccauguguucucaucgccuggggcucagcacguguuuaccaaaugaauuacuaucagaaaauguauaagcuaauacaaaugacccuaucauuugaacaacuuuaggggccaggcccgguggcucaugccuguaaucccaacacuuugagaggcugaggugggaggaucacggggucaggaguucgagaccagccuggccaacauggugaaaccccgucucuacuaauaauacaaaaauuagccaggcgugguucacaugccuauaaucccagcuacuggagaggcugaggcacgagaacugcuugaaccugggaggugaagguugcagugagccaagaucacaccacugcacucuagccugggugacagagugaaacuaugucucaaaaaacucaauaaauaaaaauaaacaacuuuagcaaagauguuaacaauaggucaggcuguucuuuaaacaaaacuaaacaguggaaguuuuauauuauguucuuauaucuggaacauugcaaaacucacgaaucacagugaaauuaggaacagcauucaagcacaagcgcaaacauugcaccuagaaacucugcaucuaacaggcgcucaauacauguuggcugagcaagcauauccacaauggguacucaaugucaauggcuggcucuucaguggucccugggaaaaagccaaaagcccagaguugcugucuaugcagaucuguguuccggugaagccuuuaacucagucaagauaaaauccaguuucuccccuaccugccacuguccaggguuaucucccaguucaggcccccgauguuagucucccaggaacgcaugauucggccuccauuggacacagugaucacaucuggaaaagaaaagaucguggugaagucauuucccacuugcucugucgcuuccuagggucccacugugagcaguggccucaccucugauuucuggaugcaaauacauguuaaacagguaccuguccuucacugucaggaguccccagucuccuuucccuaccagacccuguacagaucaaggagccaaggaaugggacagggagcuggccgcacaauggagacacgggaggacucugcuuacccuguccgugcagcagcauggcauccacagccccuucugccgugcccuugucaacauggcgccacacugagagacaugaaaguuagacauuacuaugaacaaaagguggcaacccagaagacuaagaaauaaaugaagagcucuucauuugcacagcaauguccaauuuuaucucgagggagugaaggaguauagcuaacuggcagugauccagucccauucacgggguaaugaggguagaagggguuaagaggggccacuacuguccaggccccacuaccaccccaucaaacauauaaacaaacaacaauaagauuaauaaaauccauccaauucacaagaaaaauagugaucauaaauucuauuucccuuauuuuagugccuaaaaacauccggccaguguagguaauuaagugaggguaucugagaguuuacugcaaaguagaauaauguguuuuuugcagcagcaucuuuuuuuuugagacaagguguugcucuauugcccaggcuggagugaacuggcaugaucacagcucacugcagccucaaccugcugggcucaagcaauccucccaccucagucucccaaguagcugggaaucuaggcacacgccaccaugccugauuuuuuuaauuuuagacauggggccucacugugauccccaggcuggucucgaacuccugagcucaagugauccucccgccugggcuugcagcaauaucuuauuuaaggacacucaggauucaagcugagagaacaaaccgcaaaggucaguuauaggaacauacaaauauucaaagaugguaagacugaaaaaaaaaaaguaucagaauccacuaggagaggcaucuuuuggccaacauguuccuuauucaggaaucagccaggcagaguuggcaaugguaagucuuucaucccugaggcagccaguagacacaguucucaguucacucacagaucuccccaguucgggaauuuaaugcugcaaucacauucuucucuguggcuacaaccaacuucuuggauccaggggaaaauuccaaggaggcaaacuugaccuucccaacauauugcugucuccugagaaaaaaagaguacaggggaccauaaggagcuaaaaucaccauuccacaaaaugcuccggaaaaaaaaucacagggcuaucaccaucacauucauuuuaggacacauaagacguguuuguuagcugggcgcaguggcucacaccuguaaucccaacacuuugggaggccgaggcaggcagaucaccugaggucaggaguucgagaccaaccugaucaacauggagaaaccccgucugucucuaugaaaaauacaaaauuagcugggcaugguggcgcaugccuguaaucccagcuacucgggaggcugaggcaggagaauugcuggaacccgggaggcggagguugcagugagcugagaucgcaccauugcacuucagccugggcaacaagagcaaaacuccaucucaaaaaaaagaaguguuuguuagugaagagcucugaccaaaagcaagauuuccauucaauguagucagaugcaaagagaguaagagaagaaaauuagcuccuaauagauaauacuaacucuuccuucuaaauggaagcacauauuuaccuucagauaagugacacccaaaagggcaccuuaccuuucuuuuuuuuuuuuuugagacgaagucucacucuugucccccaggcuggagugcaauggugcaaucucagcucacugcaaccuccaccucccagguucaagcgauucuccuaucucagccucccgaguagcugggauuacaggcaccugccaccacgcccggcuaauuuuuuuguauuuuuaguagacaugggguuucaccauguuggccaggcuggucucgaacuccugaccucaacugacccacccgccucggccuuccaaaguguugggauuacaggcgugagucaccacgcccgacugagaucacagcacuucuuaacagcacagagcaagcaccuccuuuguacuugguagccuaccaugugaggcuaauaauuuucucgauuaggaucgcuugagcccaggaggucgaggcugcagugagccgagaucacaccauugcacuccaaccugacaagacucugucucaaaaaaauaaacaggccaggcgcaguggcucacgccuauaaucccagcacuuugggaggccaagguggguggaucauuuaagaucaggaguucgagaccagcuggccaacuuggugagaacccaucucuacuaaaaaugcaaaaauuagcugggcgugguggcacgugccugucaucccaacuacucgggaggcugaggcaaaagaaucgcuugaacucaggaagcagagguugcagugauccaagaucgugucacugaacuccauccugggcgacagagugggccucugucucaaauaaauaaguaaauaaaauacuguuguuuuaucuggauauaaaaguaaugccuccuuauuacagaaaaugaguggguggggggaacacuuauaacaauuuaaaaaucuccaccaggcacgguggcucacaccuguaaucucagcacuuuggaagguccaggcaugccgaacacuugagguccggaguuugagaccagccuggccaacaugguaaaacuccaucucuuauaaaaguacaaaaauuagcugggcgugaugggcaccuauaaucccagcuacuugggaggcuaaggcaggaaaaucguuugaacccuggaagcggagguugcagugagccaagaucaugccacuguacuccggcgugggugacagagcaagacucugucucaaaacaauaaaaaauaaauaaauaauaaaaauuuuaaaauguaauauaucacucuucuggauugaauuguauccucaaaaacuccuguguugaaacccuaucccccaguguuacaguauuugacggcaaggccuuuaaaaauguaauuauguuuuaauaaagucaaaagggugaggccuuaauccaauagaggaagagacaucagggauguguaagcacaguaaaggccauguaaggauacagcaagaaggcagccuuuugcaagccaaugagcgaggccucagaggaaacaaaaccugccaaugccuugaucuugaauuuccagccuccagaacugugagaauaucaauuucuauuguuuaagccaccuagucuaugguauuucauuauagcagccugagaaaacuaauacaaccaccacuauagauacacuuuuuauuauuugagaugggaucucacugugcugccuaggcuggauugaacuccugggcucaaguaauacucccaucucagccucccaaguagcugggauuucaggugcaugccauugugcccagcuuuguacauauacuuuuaacguuuuacuauacagucaugcacugcaaaacaauguuucagucaaugauugaucgcauauacagcauauacagugguggucacacaagaguauaauggagcugaaaaauuccuauaaccuaguaacauuguagcugcuauaacauuguagucgaaugcauuaaucacguuugcggugaaggugguguaaacaaacccacuguacugccagcuguauaaaaguacagcauauucaauaauguauacuacauaauacuugacaaugauaauaaaugacuguguuacugguuuacguaucuacuuuuuaugguuagaguacuccuucuacuuauuaaaagaaaauuaacuguaaaauagucucaugcaggugcuucaagagguauuccaagcuggccgcaguggcucaugccuauaaucccagcacuuugggaggcggaggcgagcagaucaccugaggucaggaguucaagaacagccuggccaacauggugaaaccccauuucuacuaaaaauacaaaaauuagccaggcauagugcugugcaccacagucccagcuacuugggaggcugagacaugagaaucacuugaacccgggagguggagguuguagugagcugagaucaugccacuucacuccaggcugagcgacagaguaagacucugucccaaaaaaaaaaagagguauuccagaaacaggcauuguuaucacagaugauagcuccauggguguuacugcuccugaaaaccugccaguaagacaguauguggagguggaagacagugauauugaugauccugacccuauuuaggcccaggcuaauguguuugugucuuaguuuguuuuuuguuugcuuguuuuuugagaugcucuuacucugucacccagacuggaguacagaggcaccaucacagcucacuacagccacgaccucccaggcuuaggugauccucccaccucagccucccgaguagcugggacuacaggcacccaccaccaugcccggcuaauuuuuguaugcuuugcagaaaugggguuucgccauauugcccaaccuguuuuuuguuuuguuuuguuuuguuucugagauggagucucgcucuguugccaggcugagugcaguggcgugaucucaacucacugcaaccuccgucucccagguucaaguaauucuccugccucagccucccaaguagcugggacuacaggcgugugccaccacgcccagcuaauuuucguauuuuuaggagagacgggguuucaccauguuggccacgauggucuugaccucuugacuucgugauccacccgccucggccucccaaagugcugggauuauaggcgugagccaccacgcccagccccaagcuggucuugaacuccuggacucaagccauccacccaccucagccucccaaagugcuaggauuacagauguuagccacugcgcccggccugugucuuaguuuuuaacaaaauaguuuaagacugaaaaaaaaaauuuuaguauuguaggaaaaagcuuauagaauaaagauauaagaaaaauauuauuaagucaggcaugguagcauaugccuguaaucccaguugcuagggaggcugaggcaggaggcuugcuugaguccaggaguucaauaucugccuggggaacauagcaagaucccaugucaaaaauaaauuuuaaaaauauauuuuuguacagcuguaaagucuguguuuuauacuaaguauuauuacaaaagucaaaaauuaaaaaaauaaaauguuuguaaaguaaaaaaguuacauuaagcuaagguuaacuuauuauugaagaaauuuuauaaauuuaguauagucuaaaugcacaguauuuauaaaguccacaguaguguacaguaauguccuaagccuuuacauuuacucaccaaccacuuacugacuaaccccagaacaacuccuaguucugcaagauacauucauguuaagugcccuauaccaguguaccauuuuuuaucuuucauauccuauuuuuaccauacauuuucuauguuuagauacacaaauauuuaccauuguguuacaauugccuacaguuuucaguaaaguaacaugccguacagguuuguagccuaggaagaauaggcuguaccauauagccuagguguguaguaggcuaaaccaucuagauuuacauaaguacaugcuacaacguuugcacaagagggcauuucucaggauguauucccaucauuaagugaugcauaccuguaugucuucauuuauuuuucaaucugaaaacuguaggccaggugcaguggcucacaccuguaaucccagcacuuugggaggccgaggcagccagauugcuugagcccagguguucaagaccagccugggcaacauggcaaaaccccgucucuacaaaaaauacaaagaaacuggagaggugugcaccaguagucccagcuacucaggaggcugagcugggagggucacuugaaccugcaaggucaaagcugcagugagccaugauaguacuguacuccagccugggcuacagaaugagucccugucucaaaaaauuuuaaaaagucuuggcugggcgcaguggcucccaccuguaauuccaacacuuugggaggccuaggcggguggauuaccugagaucgggaguuugagaccagccugaccaacauggagaaacccugucucuaccaaaaauacaaaaauuagcugggugugguggcgcaugccuguaaucccagcuacucgggaggcugaggcaggagaaucgcuugaaccccagaggcggagguuguggugagccaugagaucgcgccauuacacuccagccugggcaacaagagcaaaacugucucaaaaaaaaaaaaaaaaaaaaaaaaaaaaagucuuaaacagaguccuuuuccccccucaucagccuaaccuggcccugggcucagagcagagcugcccaagacacuaagcaguuaggaaaugccauucauucauucauucauucaugaaaauaaaauuaagaaaauugcauauaucaaguauucugcaaaauuagauacacauaucacccgauauauauguguaacauacacauaugacauugugaacaguugugcacaucauuaaaaauguaacauguuuuauuugucacacugucuggcauaacagguacucaacauauaugcgaaucaacuuuuccaagacagaaaauacuucagaggaggagaaaucugaccugggcccugaagaauaaaguguaaauagcaauaauaacagauaacgcuuaaugacugcauucaaugagccaggcauugugcuaaguaauuuaaugggauugucucauucauucucacaaguacuguaagagauaacggacuguuaguaaacccauucuacagacaaagaaaccaaggcacagagugguuaagucacuuuccccaagaucacacaagucuuaacuaguaaaauucaaacaaaagcaagcuacuccagggccuuaaggaagacgugggugggugaaugaaugaaugagugaauggcauauucuagcugcuuaguguuuugggcaauccugcugugagcccagggccagacuagguugaugagaggggaaaaggacucaguuuaggacuuuuaagacgaaagcuccuguucacuugccuacaagacaccaauucgaguaggaauuaaaguucacugacagcuuggcgaccucugacaccugguagaccagaaaccucacagucaaaaaaaucgaaccugacgagggaggacgggaucagugaucucugaccggcaccccaagcauuccuggauggcagggccggcuuacacgcaaggaucagcuuagaaugaccccuaacacuugguuuaaggcucugcuuccaacgacuuuaaauccuuaauaauuuuuuaacaaggggccccacguuuucauuuuguacuggguccugcaaauuaugcggccaauccuguuaagugacaaccuuuagcagguaggagacagguacuggggaaacagccacuuaucucucgaauauguuccacacguacgcaccaaucaaacuugcccacuuggucuucguagaccgcggccgcaggaaucagcagcguagcccaaagccagaaacgagaagcccacucagccgccaugaugcgagcgcaugcaccacccaccgccgucccggcaugcacc

SEQ ID NO: 191427 - RNA, 31809 nt, Homo sapiens
aacccguccauugugcgccgcugccccgugucucccuccagccgcgaccaugcccaggaagaaggcggcggcggcggccugggaggagccgagcucgggcaacggcacugcccgcgccgggcccaggaaacgcggcggcccggcgggcaggaagcgcgagcggcccgagcgcugcaguagcagcagcggcggcggcagcagcggcgacgaggacggccuggagcucgacggggcccccggcgggggcaagcgcgcggcgcggccggcgacagcaggcaaggcgggcggcgcggccguggucaucaccgaacccgagcacaccaaggagcgcgucgugagugagggucaggguagacgggugggcgcagggccggggccggcgggcucagcgacgcggcacggcgcgcguuccagccgggggccgccucgcgucacgcucccucccggcggccgggccggcgcaggccgcgggcugaaucauugccuccgccuccgcgcaacaaaagggcucgguacggggcgcgcggcccgcggccuacccgaccccgggcaccgcgcgggcgguuggcgguuggggcgcgcgcccgggcccgcggcgggggaggggcggccgaagcccgcacgagggggucauggccccgcccccacagcucccucugcgccccuccccccccgccccgggaaaggggaccucgguaaguucgcccggccuggaagagggggcggccagcgggccccacacguccguggccgccgcugcgcccgggcgccgcggggagggggcggccggcgcucugcggggagcggccguuugcgccggggcuuugagguucccgccgccucggcuccggcgcccggggggggcggggccugacggccgccgcgcaugcuccgcagagcccucccccgaggucggggaagccccccggcugagcggugcucgggcuuuguuugccgccggugguccgaagcugcaggaugcucgcgagggcucuguuguagcccccccaagugaagaagcaucuccuaggguccugggcgggcuucuguuuucucaaaucuuaauuaaggucguggcugacucaaguuaacguucccgaaaaagccugcagagccggagaucugaacccggcaucugccgccacagcaucuccccacccccacagaacuuucuuuaaguuugguguggugugggauauguuuuucagaagagggucuaaguuuucaccagauucucagauaacccccagagagcaagaacuuccaccugggguguagagccugacacccggagagguuuuuuuccuuccauaagugcccaucuccuaaggguguuuaaggguuaacagcagagugcuuuccuccagagaagcgcaggcagugucuaauaacacauuuucuacguccguuuuauagauagggaaacuggggcacagaauucgagggccuuguccaaagucauggauggaacuggaucuccaaaugcuguaacuccugaugucccugcaaauugcacaugggaauaugcuuuguaaaagugccuucugggugaaaggguuaacauguuaggcaguggaggagagcccgucaaaagcugucaaaaggucuugcccggggucuuggaucaggcuagacuagacaauggccaaaguauugagaaacuggaacacaggaacuguuuuccuuugacgucuagucugcugugccagacuccagacauuugcccuccgaacacaguauguuaggaugaaacuaaaaagaaaggccaggugagcuuccgcgucuccuguauccuauuuugagugaguuuccaaaagcaagauuguguuuagacauccaagacugcaguuaucagcuguacagcuccagacuguuggaacgcugaauuuugccaucagagcaaaagauccuuaccccaugcugagauugacccaaggagguagagacagggagugugugagggacacuggcucucccuggcccaccucugucuccagcugugcugcuugaagcugcuuugucaauggaaauggcacauuuguuagucuuuuuuuuuugaggcagagucucccucuauggccaggcuggagugcaguggcacgaucucagcucacugcaaccuccgccucucagguucaagugauuuuugugugcugaucagccucucgagcagcugggauuacaaguguguuccaccacacccgaauaauuuuuguacuuuuuguagaggcuggguuuuaccauguuggccaggcuggucucaaacugcuggccucaagugaucugccugccucagccuccuuccaaagugcugggaugacaggcgcgagcccuguguuggguugcauguuuguaagucuuaaugugaguaaacagcaguccauugcagcuuuuaaguuccuguuuauacacauaaauacguuauuauuuuacauauguguauaagcaggacucuaaaagcuacaucuuccuuucucuauccacuuaaaaccaacaggggcccaugaugcccauccuuugggcugucggugcuguucuagaaucagagcaccugggaggcugaggguucagcauaugaugccccuuuaugccucauggaaagugcacacccuacauuuaaguuuugcuuuuuuuuuuuuuuuuuugagcuggaguuuagcuguuguugcccagguuggagugcaauguugcgaucucagcucacugcaaucuccgccucccggguucaagcaauucuucugccucagccucccgaguagcugggauuauagacgcccaccaccacaccuggcuaauuuuuuguauuuuuaguagagacgggguuucaccacguuggccaggcuggucucgaacuccugaucucaggugguccacccaccuuggccucccaaagugccccacguuuaaguuuuguuagcaucuacugaguuugguccauguucggggcuggguccaugcagccccauugccuuuccauaggccuagggcagcccucugccccuuguccuggguuggccuccugcccagucucccuggccccagguuucuggucucuguuucucuguugagcaguccuagggacccugugugcugccacaggcagacagcaguccuuguugcagaaagaaccuuuuuuacugagcauuuugcaugccuugccccgcucaggguugcuaggaggaggucugugugaaagcagccgcccaggaaauguccaaaaccauauugccuucagugaccccaaagcugcaggugucgggcuuguagaagaugagccaaauacuuacauuguugaggggcagaauugccuugaguaaaagaugugcauuuuauagaacauucuuauggcagaugagcguugucauugccuagguguuaagaaaaaauucaaauucuuuuuuccuccgcucucacggccacacucaacaaccaacaccagacuucuuccgcaccccccaccccagauggagucuugcucugucucccaggcuggagugcaguggugugaucucagcucacugcagccuccaccuccuggguucaagcaacucuccugccucagccuccugaguagcugagaugacaggcaccugucacugugcucgguaauuuuuguauuuucaguagagaugggguuucaccauguuggccaggcugucuugaacuccugaccucgugauuugcccgccucccaaagugcugcgauuacaggcgugagccaccacgccccgccucccaacacaagacuucugugacuagacguaaagggaggucucccccugcuaucaagcaagcaaucaguucugcagcacacaccggcuggguguccuccaguucaucucuugacacuauccaccuggagguagauuuccucaucuugagggcucaguccccaagacuguccuuccaccccagacaccaguugcaaguccagucccugguagcuucugaccaacuagccucuaguugggguucucaugacccccucuuuggggucgauuaauuuauuggaauggcucacagaacucagggaaacaccaguuuauuauaaaggauauuacaaaggcuauggauaaagagaccuguaaggcuagauguggcagaaggggcacuguguuuccgugcccucugcagaccacccaccugguacauguucagcucuccacaagcucugugaccugguccuuacagguuuuuaacggaggcuucauuauguaggcaugguagauuaagccauugaucaucacuuuaaccuucagucaucucccuccugagguuggaggauggggcugaaagucccuaggcucccacugccccauccggaagcugccugggggcugccagugucagucauuagcauacaaaaagacauugcuuuggagauuccaaggauuugggaaguugcaugccaggaacuccaaauauugauggcagugucacacuaggguagauucaguccuaauucuuugcgcacuucauaaccuccuaaagcaaguaaaggcagcagccuuggccagauccuacaaaacaggugaguguugcaagcugcccaggucuuuguaguuuuuccagucuuggguugccaagguuuuguggacccugagacagauguguugaaucugaaaggagcaaauaaauaaaacugaaagccaacccggaagucuguuucaguugauggcccuuagguaauuggucgaugccggcauuguucccgggggucuuaccuccccggagcagcggucuucuacauggaccuauguuaaaagguugacucugggccccguaaacgcgcaccuugcauuuggaucauaauucaaaaauugcuuuagacuagaaaucccauuuuguugauugaagaagcucagugccuuuucuguccauuucugugugucucugcccagguuaugugaccaaguugcuggaggcagccaggugaaaugacaugaaaaucacucaucucauugggcagacuguuugccaggcugucugcugcguggccuuuauacacaagcagggucgcagacacugaguucguccaaaaaaacaauccguaggcccaucagggaaggcuggauuccgccugggagggcacacugagcuucagacacccacacacccacuggcacccccgcccugccccgccgccccggguggagcccgcaagcgcgggagucucucccacgauuggcuguuucuggucucugaggaagaggagcaccccuuaagugagaaggggugcugggaguucucuguuacucuauuuaaauguuaauuccacauaaggcagaggaaagaaguuauagagaaauaaaagaaagcagcuuagagcaaacaauuauguaaauaauaacgaaauacacuaaccuccaucuaaugugugaggaaauaggauccaugacguaaaaacuugaauaacaguuaauguccuucauaggaaucugaccaccgucacuggaguagacucaguuuaccgggguuuuucacacauacacacguauauauguauauguauacacacguauguauauguguguguguguguauauauaugugugugugaguguauauauauauuuuuuucuuuuucuuuuucuuuuucuuuuuuuaagauggagucucgcucuuucgcccagucuggagugcaguggcgcgaucucggcucacugcaagccccgccucccggguucaugcccuucuccugucucagccucccgaguagccgggacuacaggcgugagccaccaugcccggcccacaaauacauuuuuauuggcgugguuggguuugccuauaaaugcuuagcuagcuugauggaucagucuucaugagcccuugaccaaauguccaggucacccaggaaacucccuccccaaggccaaggccacugcgguuaagcucuggcugucugaacuugccccugaaccaugcccucuggccugauggagcugaggcuucugguguggccucagcacugugaaguuuugcugcagugguugcaucucaguguagggugguuugacuucaaugguucauacugagcacaggugcccaugaaccuccgccugccuggucugcaguugcuggcauuccagggcucuuuucuaggcuugcccucuggccugggagcuuggucuccagugccuuagcacccuuccugggucucuacugcccccuccaugccaacuugguaggcuugggcagaggacccagaggccucuccuuccacagggacuucaacagaagccauugaauauagaccuguagcauauuccagccaggccugccaguuaaacaaagaagggcagauaaccaggggaagcuaggcuccaauucaaguaaccugaguugugggugcugcaggggcugggccacccucugauuaaggucauuuucuaaauaauuuaaaugaaccaaaguuguucucccuuuccguguuguuucacuucccuccccccaacuuuuuuuuucucuuuuugagacagaguuucgcucuuguugcccaggcuggagugcaauggugugaucucggcucgcugcaaccucugccuccuggguucaagcgauucucuugccucagcuucccaaguagcugggauuacagacacccggcuaauuuuuuguauuuuuaguagagacaggguuucaccauguuggccaggcuggucucaaacuccugaccgcaggugauccacccacuuuggccucccaaagugcugggaugacgggccaugagcuaccgcggcuggccucacuuccccuuuucaugaggacugcaggaugcauuccuguagauugaccaucuuuuuccuguuacauaaugugguggagugggcaagcgugacggaaccuauaucuugggggacgcccuaaucagguuugggucguguaaagguuccuauugaaguggaaaucauccgucaugaagauguguaaucuuagaaaugcgugagccguacugccaaagcauacccauggggugaucacacuguagagguuagaaugauugggccuggagcugcccuuuuuucuuuuucuuucuuucuuuuuuuuuuuuuuuuuuuuuugagacagggcuggcuuugucaccaugguuggucuugaacuccugaccucaggugauccgccugcuucagccucccaaagugcugagaugacaggcgugagccaccacacccagcccacauauauauauauauauauauauuuuuuuuuuuuuuuuuuuuuuuuuuugagauggagucuugcucagucgcccaggcuggagugcaguggugcgaucuuggcucacugcaagcuccgccuccuggguucacaccaaucuccugccucagccucccgaguagcugggacuacaggugccggucaccaugcccggcuaauuuuuuuuguauuuuuaguagagaugggguuucaccgugcuagccaggauggucucuaucuccugaccucgugaucugcuugccucagcgucccaaagugcugggauuacaggugugagccaccgcgccuggccaacaaauacauuuuuauuggcaugguugggaacuuucaucggcguuauuuuauuggcauuuuaucggcacuuugggaggccaagguggguggaucaccugcggucaggaauuugagaccagccuggccaacauagugaaacccugucucuacuaaaaacacacaaaauuagcugagugucuguaaucccagcuacuugggaggcugaggcaagagaaucguuugaacccgggaggcagagguugcagcaagccgagaucacgccacugcacuccagccugggcagcaacacugggagugcaauggugcaaucucagcuuacugcaaccuccgccucccggguucaagggauucuucuaccucagccucuggaguagcugggacgacaggcggaugccaccacgccuggcuaauuuuuuuguauuuuuaguagagacgggguuuuaccauauuggccaggcuggucuugaacuccugaccucgugauucacccgccucagccucccaaagugcugggauuacaggcgugagccacugugccuggcccccuuuuuuuuuuuuuugagacaaggccuggcuaugucaccuaagcuggagagcaggugugaucuuggcucacugcagucuccagcuccucagcucaagcaauccucccaccucagccucccaaguaacugggaccacaggcucauuuuucuauuuucuguagagacaagguuuugccauguugcccagccuggucuccaagcucaagcaaucugcccgccucggccuuccaaagugcugggauuacaggcgugagccauugcgccuugccagacuuuuuuccugaagccuuccaagaacaauucuguaaacugaaggaaaccccuuuccuuuucacguccaggaaagauguguaagagcggaaagugauagcagugaaugcuucccuugccaguguggacugagugaggaguucagaauugagucuuccacuaacaaccuacuugaaaaaguauauuuugacauuuaaggaagcaaagugcugagaauauuaugagugccacccagaauugaacaauggccuuuuuaaauggcguagauuuucguugacaguaugagaguugguggcccugaugacuuuguguugagagacugaggaugaacacugaaguaugcuggcugcugugacagcuuguuccuugagagccgggccccugggagguccuguuucacucaccauuggcucccgggcucauggacagcggcaugagggugccaucaaaggccgccugauucagaccccugcauacccaccaaagcuguguucugccuggucucccuucaguggagaaaucgaaccuuguucucuacuguuuucuuccugaguccccauggaaaggcucucggcagagugggcagcagaagugaugugaggcuccuaagguuugaggucgcaggccgugcuugccaugugaaauagagacuuggcccuaggaugagcuggauuuaacgccccugaguguccggcaggcuuccugcaaauaccucuguacaucaguuugcgaaggaggcauguauuuggguuuuuuuuuuaguguuuugcaaaagcuauuuuaaagggaagucaaaggauaaaaaugagccugggcuuagcaagugagcggcugugggcagguuugggguugcccgcauugccacuugccgaugagggaggggaguguggggagacucuguucguguggaggucacaggugacauaagggcuaacugaaugauuuucuuucguuucgugcugucauuggacagccuuggaaagcuaggugcagacuuacacacuaauucuuuuuuccuuucucugucucugcagaaacuugaagggucaaagugcaaagggcagcuuuugauuuuuggggcaaccaacugggacuugauuggucgaaaagaagugccuaaacagcaagguaugagaauggugccucaaaaacccauugagugcuucuuaagugcuagguucuguugaccaccugccugguagguauucccuucauuuacaaaugcauuuucacagaggccaagugacuugccugaggccacacagccacuguagugaugagcuggauuugaacccuaaucuuagucuuuuaaaggcacaauuuugaagugacucacuaauuccguuaagauuaaucaggaaaauacaaguaguauccucaaaugaacauugccaccuuuuccaucuucccucucaccucacuuguuuucauuaaaaugaagagaccaggucugugagauggugucagaauguccuagacauuugucaaaugucaggugucaaaauuucaggcauugcagaagaguccacguuucuuugcaagcugccaaauuguugcaggaacugguuugacagaacagucuggagcgggggaaagcagagagguccuuaagaaguaauguuuuguccccaguuaccuuuggaaaacuggugucuuaagggaaaaggcccauccaggagaaggaaggcuggcauguagccaacuuuuauggcuucuugauuucaucuggaaagacucccaaagugcuuuccagcauugcuuugccccaugaacaaauauuugcacgcuggcucgucuuggcaccuuaaaacaggggcguuggaaaucaccuuguuccaugaaaacaccugggggccagcugaauuagaaauggguuuaaguugcagguagcagcagcgcguuguuuggaaaaugcccagccuucaggcccaagccagagggggccacguccacaugguggcuuuugucccagggaagcaccuccuggucuacaguaacguaagcccaggugcugauggcgccuuguugccaguccugugcccguguugcaucauuucucaaagccguucuucaacugagcagcccaguugacauugaagauacagaagcccagggaagggcaguaaauaccaaaggaagcgaguggcagggccaggguuggagucccacucucuaguuaacucuguugccucccgcgcauguauguugcuguagaucuggugaaaaccagcagccuggaugucuugguuuuugcaagauagcaccacagcaagccacacaguagcucugugauugggaccagaccccagggauccggaggccgugggaauugacuucucagucugaccgcagagccugggacugcugcagggcguuuaauuugacuugcucccccucccccaccccugcccggucccuccagucccuccagcccuuccuugggaggccggaagaaacccaacccggcuccucaggagccaguggcauccugggcacugcagggaaagaugcuuugguaaguccaggagcaucugaccaccugagacuccccuuggccaagcaaguucaaguguggcaccgcacccuugccuggcgucccguggccuccuguguugcggcacagggucgugaugauacucgucaaucaugccaucauuuugucuucauggcaaagagaccuuggguuucucuuuaucccuuccgaguuuuguuuaauacaguuccugaaucuuaauuuaggugccaccuccuugaguuuuucuuaaguuuuaauauagaccaugaggcuuuuauuuuugguuugcucuuuccccaggaaauuguugauguuccucuuccuccuuucaggggaggugucugcaggugugcugcuucaggugccaugcgggaucggcuggccccugcccgccugcggccaggagucuugcccacuugcccccacaccugaaugagggagcauguggugcccucugcugagggcggaggguggggcuggaacguacuucacagauacuuucuaggcagccaggcgcuugauagagacauuguagccuuuuuaucaguuccuacauuggaucagucuuacacacucgauuuggcaguggcuagcauuucaggauaaucaccacaauccuggaaauacucuugagcaucucaauuucaaaaauuaagauugcugggcaugguggcucacgccuguaaucccagcaguuuggaaggcugagucgaguggaucacuugagcucaggaguuaaagaccagccuggccaauauggugaaacccucucuacuaaauauacaaaaauuagcugggugugauggcacacgccuguaaucccaguuacucgugaggcugaggcaggagaaucaauugaaccugggaggcagagguugcagugaaccgagauugugccacugcucuccagccugggcaacagugaaacugucucaaaaaaaaaaaaaaaaaaaaaaaaagaaaaguaagaaauuggcccugccccauccucuaauagggugugaagggggguuugugaggaagaugcugugguuuucuuucccauugagugcucgcugcgugccaggcauuugugagggucuaggcuggagggagccuacagcuuuagcccuggguggcuucucauggagugggagggcuggggggcucaggaagagagcuguggugggcugagcagggcugagcagagcuggggcaggggagcccugggggaaggagauuucucaguggauguugcccuggagggcuuccccaaggaggcgaacuggugcuugacuugagcuuucaggaagaaguaggaggugggaaggacauucuaggggaagcgaauauaugggugggugucaggggagucaugaaguggcugucacacuggacgggugagaagggagcaggagguggggugauacugugugagcagugccccuccucaaggggccugauggagcugcugggaacaugaagacaggacacucgggucaccccucagaaagagccuucuggcccagggugaaggccggagauggagggcaggagagccugggaaaggaggggcaggcggcagggagugaggaggagggguagguuacugucagggugagcgggguuuccugggucagccucuuccucagcugacggcuguggaaagccagcacuccugccuccuggacagaccucgcaccaggucccgggcacuugcgggugggcgugcucaauggcagaacacguggggcugagcccugugagaggugggacccagagagggggcuggggccgaauggguguaaagguggcaggugacgccaggccugugccagcuucuggguauuuugauuuuugggccuucagaggcaucgcagagauucgaagugaaaacccgauccuugugcagccucccaacagccaaggcaggguggcacccgaggaacaccugucccugguacccucgggaaguggcugcuugguggccagugacauuuuggaggucaccccaccaccccaggugucugaucugcauucucauucucucugcagcugcuuaccgcaaucucggucagaauuugugggggccccacagauaugggugccuggcggggguccgggugcggacaguggucucgggcucgugugcugcacacagccuccucaucaccacggaagggaagcuguggagcuggggugaguaccgugcgggugcugggcacuggggaccacugucaccagcuguccccacacagcacguucuucuguuugccuggaaaagagacucgcgucuuauaaggcugggcuccuucguucacagcccaugucuuuuuuccuaauucccagcucgucucuugucuacacgcuacaugcagauccccuuccccccugacauuuuuugcccauacgcagccccuacuucuuugauuccuuguguuuacacaaggaacauuuuccugaaucuucugcccgaagcuugaucuuuucugauacugaggugugugaguguguuaggcaggcuguccuuccagcagacaguuuccuuccucuuugaggcacgauaugacaugagaccucuguugcugccacuugaaaugccacuggcuuuucuaccucccgccucaugucauaggaugcugcgucccugccgccauggcccucgugucugaggucugcccaagucuggucugcaggcuuggcagcucacuguccguguugucugcuucuuaggauauuuccccagauacuucaguuugcuuuuuuggaguuguucggcuuucccuucuguuuuuccucaccugggcacucgggauggguuccaguucuucuguuagccucuguccacggcacuguccucugcagccggccggcccauuccugcccguguccucuuccagaucauuccaaucauaggguaugggcuaaggcucauuuuauccccagcccuuuuggugacucccggccucugccuccagcggggcauauuggcguuuguccccacccuuugucgcugguccucuggcuagcuuuuaguccauaugacugcauuuuuauuuugggcuguuugaaccguuuuuugugauuucaugagcugcuguaccaaaguccaaauauauuaacaucuguugucuucccugcacauggcuaauuuuguaauucuguugaaaaaagcuaaagugugucuggcccaaauuuauacuuuauagucucuugaugacaugcugacauugccacaguuuuuguuuucucccgguuggcauagaugugugucccuucccccagagcaccccuccuacuuuguguuccaacacugaacacagccuuuuaugucaguguuccaaacuuaaaauaccucaguucugaucucucgcugagcuucacuugcgugguggcucugaaagcgcccucaguucugacccugugggcagggacaauguaugucccgccaucaagacgugugauccccgagcagacagugcaguuggugaggacaggguuggaaggugucacaggcccacugcucgccacucuagaaggcagggggcggcgucuggugugaguagaguaccacgggaggguggcugacgcauugcucauguggggucuccaucuguggcccgcucacccuguccugccgcaucucaguccacugagacuugcacuuguugcucuguauucacaugccuuucacaugaacuugggcagcucccauuggaagcugguguaucugccucuccugcucgagugccagugcuggcccuucagcccgccguucuuuaauuagagcgagucagaggcugguuucccuucgucgcaauuccuucuguagucagaggcugcuccugcaagccuucuccaggacagcuggaacucaucuuaauggcucugcugucugccuuuaucacaaccuaagggugaaaaguucauugcuggagaagguugcaaaacccccuagaauugcccugacuucucaccacuguaagaucuccgucaguuuccccacgucagguuacaugugugguuuuucucuuaucgggagggauccgagaguggccgguugaauuuuuguuuuggaacuugguaguuuguguugaaaccuagaugcgguguaggggcucccagcccuccuuuuggcccacccaacuuccacgucuguuuggaguugaauuugguucugcagaggacuuggggguagggguuggcccucaggccugccuuccgcuggaauucacagauacagggccuuggucgcaccugcagcaguccuggagguggggcugggcguguuguguugaggguggaucugugcuuugucaccaggguuccuguggcugagaguccuugaggggcgaucccuaggggugggauuggcacuguuaugugagcaccauuuacaggguagaaaaaggaagagaaauauugggcagacaccaaaugguccucaguggaugcccagagcaccaaagugauuaaacucuggugagccaggugucaaaauggggugcugucuuaaaauacaucucagaggguagggacggggugguugucuugcaggcacucuaagugggaacggcguguuucugcgagcaugcccgccugugcauggugucccuaccacacugagccucucauuucccuuuguagcagagacgugggaggugugcacggguggucccgcugcugccccagggaaggagguccggggagcugcagcaggcgccauuccagcgggcagagggccggggcguucuuugcucuggaucuuggcuguugggaauuuggaggguaccuuccagagacagaugggcaucauuugagaguguguuuguacucgccuucuccugguggugccgccuggaccacccucucucuuuucuacuuucucucaugugaucugcaggucgaaaugagaaggggcagcugggacauggugacaccaagagaguagaagccccuagacucaucgagggucuuagccacgaagugauugugucugcagcaugugggcggaaccacaccuuggccuugacggguaaggagguggcugcuggugucuccucucaguuuggcaagaggccagguggucugccuuggggauggggcguggggugguggaguuccccuugugacucuuggucaggaucagaaagaggcccugagaaccuuggcauggaguggcuucuugagggcauugggagccuccccaguggccauaggaggcccaucugggaguaggagacgcugcccucuguuucucugcacacccaguuucugaugugaaauggcuuugcugugaagcgucugcacugccagcuuuugggcagucucacuugccuucugccuggcaaaugagcuguuuuuauuauuuugaugccuuugauucuaaaucuaguucaaaacauucaccauuaucuucccuuuugugauauuuuuccuuucuuccagaaacgggcuccguguuugcguuuggggaaaacaagauggggcagcugggccuuggcaaccagacagacgcuguucccagccccgcgcaggugaccccuccucagcuccggcuccauggcuuuuuguuucucuuuacuuuuguguuugauuuucuaagguggggucuccguuugaguuaauuuaccccuuguaaaaacagggucuggauguuuaguuacaugcuguagaguuuuuuuguuuguuuuuuuguuuuuuguuuuuuuuugagaacggaguuucacucuuuuugcccaggcuggagugcaauggcgcaaucucggcucacugcaaccuccgccucccggguucaagugauuccccggccucagccucuggaguagcugggauuacaggcaugugccaccacaccuggcuaauuuuguauuuuuaguagagacgggguuucuccauguuggucaggcuggucuggaacuccugaccucaggugauccacccaccucggccucccaaaguacugggauuacaggugugagccacugcacacagccuugcuauaguuuuuaaaacaggcuuaguuuguggucggguugaaaaccauccugaaaacauuuuguuuccaaauggagaaaucuguuagaaaugccuugucguaagccuguucuguuccaaagaaagugagugauguuauauggauguaauuguacuucccccaaauacuuuguuuugaccuuguauaaagucaccagccagaugcuuagaauacaaauacgagauaggcagucuuuuuuuuuuggaggggagacagagucucgcucuguugccaggcuagagugcaguggcgcgaucucagcucacugcaaccucugccucccggauucaagcgauucuccugccucagccucccgaguagcugggacuacaggcaugcuccaccacgccuggcuaauuuuuguauuuuuaguagagaugggguuucaccauguuggccaggauggucuccaucucuugacuuccugaucugccugccucggccucccaaagugcugggugugagccaccgcgcccaggagauaggcagucuuuuuuuuucuaagaaacuugaguuggaggggugagauuuauaccuuaaaaacaaacuacuacuaaaggcagaagaaugcuaagugccuaauuaguggucuaggugaugaaggaagggagggacuugguuuuauugaucuuaaagagacaguggcuaggcuuugaacugcucugugcugggagggugggggucugagggugcuucuuuacauaucuucuaagcuuuguguucuagaaaugccuucagcuuuugccuucagaauuacugaguuuauuaaacuuccguuuguaaccuaguaauuguuucccaccaacaugcagagagguagaggcuuuuuaucagucuuuaaaaaaaaugaaagucuccuuucuugucuuuucagauaauguacaacggccagccaauuaccaaaauggccuguggggcugaauucaguaugauaauggacugcaaaggaaaccucuauuccuuugggugcccugaauauggucagcuggguauggaaguacauuuuuuaaaagcucuguaaucuaacuguauauauucagaacuagagaucaguguggggcugcacacacguguuagaaauguggguaauugaucucagauaauagccuuuguccguuaaguggaucucacguucagcagaacagcgcguccucauucacaggauuauggaguauugcaacacugccucaauggaaaaguugggacuggaguccuacaaaagauuucuuuuuuucugauuugggaauucauuuauauaaagggauuucaaaguuaaaaaaaaaucagaccaccuucauucaauuucacauuuaaagauuaugccuuuauugaaaaugagaaaauuacggaaaaugaacguuguucuggaaacccuggccugggcgauuauuucggguugccacgugaggagcccugguggacccccuccccgugcgucaucccuagccagaaucuaguuguccagaaacuuguuucuucgaucucauugguggaaaaggagaauucaggcaucaguucucaguuaguggggggagugucuuccgaccugauggucuccauucuccuucccaucggacccuaagugcgguucccugaagugcgcuucccgguuguggcucugccuccacuccagccccucuggggaggccuccgcgagguguggcgcgggcgcccucugcuggccgcgcgcgcuccugcagccgcagcgccuggcagauggaaaagguaaaaauagcgccgagcccgcuggccuuagccucggggaacagugacuuugugaaacuaaauauacuucaagucagaagugaauaagagagaacagccccuuacgcacauuucacauuucgcguugguugccgugguggagcccgagacaguuggagagcgguuuccauggccacagcccugcugcggugcccagcagcgguccgcuuccugccacgugcgcgcuccugcugccuuggccuccccucugcaccccggcaagucgauuuuccgucaggaagcaugacaugcuguuggugauaaaaacggcucacuuucauggagcagugacugugugugccaggcaccauguaagcacuuuguacaaauucgcaggugcucaguuacacucaacuugcagguaguuuggaaaucggcuugauuuguagcuacagaaucgcuuauucucagcguauuacuugcuuuaaggcagguguuuguuucguuguccaaauccagauagaucacuuuuagaaugaaccuaaauccgacuauggccgugucucauccacacacacucaugccuugugcccccuuuuuugcagugcacugaacugggcugggcaacgccaagauaagaaagacggagucucccucugucacccgggauggagugcaguggugugaucucaguucacugcaaccuccaccuccuugguucaagcaauucuccugccucggucucccaaguaguugggacuacaggcgcccgcugccacacccagcuaacuuuuuuuuguauuuuuaguagagacgggguuucaccauguugaccaggcuggucucaaacgcuugaucucaagugaucuacccgccucggccucccaaaguguugggauuacaggcaugagccaccgugcccagccaugccauuuaacuuuauuuuaaagagcugucaccccucuagagggacagggaagcccgcuguucgauguuuucuggaguagcuucuguccuguacuucuggagaaagcagaugugugcagcucuuuaaaggagguggaaaaagcagucaccaaaugugccuccucuccugucugggaguugugucuguucaguauccacugugucgauagcaaauaaaaggacucuaaucauuuguugacugccuugcugaaaccuuguccggaagagugcaaguguuuaaaaauaccauuuuugugagaaaaguagcgacauauccggaaaugcauucuauuuacugugaugcucuuacauucaucguagccuagaaggugggggaauuucuuaguggggacccucagacuuuuauuguuuuuuuugauacggagucuugcucugucaccaggcuggagugcaguggcgcgaucucgggucacugcacccuccgccucccggguucaagcgauucuccugccucagccuccugaguagcugggacuacaggcgugcgccaccacaccuggcuaauuuuuguauuuuugguagagacgggguuucaccauguuggccaggauggucucaaucucuugaccucgugauccgccgaccucagccucccaaagugcugggauuacaggcgcgagccaccgcgcccggccaagacccucagacuuuuaaacggacagauguuccacuggaagggauuaugucaacaguagagaacugcugucauaagacagugauagugagcagagaucaugccaccgcacuccagccugggcgacagagcgagacucugucucaaaaaaaaaaaaaaaaaaauagaaccugcuuaugagaugaguguuauaaggcgcccuguaaacaagcccaggaguuuuauuguguguagcguaguugugauuccagggugcaguugcuccuugguaaccugggggauugcuuccaguacccccuguggauaccaagaucuuaagaugcucaaguaccuuauauaaaauggcauaguauuugcauguaaccuguacacuuaaaaucaucucuagauuacuucaguaccuaaugugauguaaauguuauguaaguaguucuacuguauggucuuacuuguauuguuuguauuaucuuuuuuuuuuccuuguuuccuccuccccccagauauuuuuggaccacuguugguugaaccuguggccauggagggcugacuguauuuaaauagcacagugcucaaaaacacacauaccaauaagggcugaggugcacaccagcgugccguauggagggggauuagccacaagccgggggcuaguuuacaaacugauaacaacaaguuuuuuuguuuguuuuuuuuuggagacagaaacuuguucugucgcccaggcuggagugcaguggcaugaucucugcucacugcaaccuccaccucccagguucaagcgauucuucugccucagccuucccaaguagcuggacuauaggcacccaccaccacgcccagcuaaucuuuguuuguuuguuuuuguuuuuuaaaguagagacaggccuucacuguguuggccaggcuggucucaaacaccucacuucaggugauccacccacuucggccucccaacgugcugggauuccaggcguggcccaccgugcccaaccaaacugaugaucacagugugggaacaggagcaguuuaaaacuauaaacuacuuagcagcccugcugcugcagguggcugcaggagcuugggugucuggcguguucucaggacuggagcagccgggcuucugguguguggugugcugagcugggucuuugcgaaccagucccugggucauucggagugugggaauugcaggcuuuagccacccguaaccauacguuuagguuacugguaauucauaaaaacagaggccugggauuguguauggagcuuuucugucuauucuuggucuuuuaggggcuccuuguggucccuccagugggguagagaucuuacuugauagaccauuccuugaucagcagcuucaacuuuuuugacugcaacccauuguaagaaauaaguuuucuuuugcaacccaaucugaacguauaauaccuuaccuggaauuguuguaacauggugccauuauuauguguagaguauucuuugucauucuguucuauucguuuuuaaaaaauaacuggucuuagcucacaaaauugauuucacugacccacucacugugcugugccuaagauuggaaaugcugccuuuguugaccaacgugugcuggucuaaggcccagaagggccagauuggggugcugccggggcucacuacagaguccgugugagcacacugacacgucccuugugcuugugcugcugcugauggccggcucuguggucucuacaggacacaacucagaugggaaguucaucgcccgggcacagcggauagaguacgacugugaacuaguuccccggcgaguggccaucuucauugagaagacgaaagauggacagauucugccuguaccaaacgugguuguacgagacguggccuguggcgcuaaccacacggugaggcucggcuuuucucacuuccugagagucgcaccaggauggaagggguguuuaugcucaaguuuccugacgcuuggcuuuggcuaggaacugaucccagguagacaucugcuugcuucuucaagagggcuuugcaccuuggccaaaggguccuuggucccagggcaggguucccugucacugccuccuauguuaacuucucccgugauuuaaauagacacaucuuaaacacguagauguuuugccgcccucaccugcaccuuaagguaagcacuuucugcuuuuggcuuuuaucuaacauaacaucacagacaucuuuccaggucaguagauggugccccauacuggggaugugagucguuuuuaaucaguagguugucccccccgcccccccccccuuuuuuuuuuggagacaguuucacucuuguugcccaggcuggagugcaauggcgugaucucggcucaccacagcuuccaccucccagguucaagcaauucuccugccucagccucccgaguagcugggauuacaggcaugcgccaccaugccccggcuaguuuuguauuuucaguagagacaggguuucuccauguuggucaggcuggucucaaacuccugaccucaggugaucugcccaccucggccucucaaagugcugggauuacaggugugagccaccacgccuggccuagguuguuucuuuaaaggucacuuuagauaaacugcagugcaaucuuuuguuuguguaucuuuuuuuuuuuuauuugaggcggaguuucacuuuuucacccaggcuggaaugcaguggugggaucucaacucacugcaaccucugucuuccuguuucaagcuauucuccugccucagccuccugaguagcugggauuagaggcaccugccaccauuccuggcuaauuuuguauuuuuaguagagaugggguuucaccauguuggccaggcuggucucaaacuccugaccucgugauccaccugccucggccucccaaagugcugggauuauaggugugagccaccgcgcccggcuguuaguguaucuuuuaauuuuaauggccuuccugugguucuucugucugagaaugccuaggagucucuuuguucuaugcuuuguugaaaaagccugggcuaggauuccagagaucaaguugguccuccccacugaguggucucagcucaccaccuccuucccuuggaaucuucuugccgaugaagaaugcccagggaauugggcuaggacuaggguaggagauuucaguuugugcaaguccaaaaacugauuuguuuugucugauguagucaggggaaauaaaguuggcucuuguuuagggccuuauaggccaaguuuuuuaguaaguuguagauucccaugguuuagacaugaaacaucaaagaacugaauuggcaugucagaagaugggaaaacgagacugaagaagauaaaucuuaaacacuugaagugucucugaguucauuucaucagugaccagguacagguuaccucuguaccugugggugagggaagucuaaagaaaaauccaggccgggcgcagugguucauguuuguaaucagaggacuuugggaggccaaggugggcagaucauuugagaccagccugagcaacauggugagacccccaucucuacaaaaaaaccacaaaaaucagcugggcaugguggugcacacccaaguccuagcgacuugggaggcugagguaggagaaucgcuugagcccaggagguggagguuguggugagccgugaucgugccauugcauuccagccuagguaacagagcacgagacccucucgagggggggaaaagaaacgaaaaauccaggaacagguaggccuuuucuguucuuucugcaauugaaucuguuuuuuuuuuguuguguuuuuuuuuuuguuucguuuuguuuuuuuuuuuugagauggagucucauuccgucacccaggcuggagugcagugacgcuaucucggcucacugcagccuccgccucccagguucaagagauucuccugucucagccuccugaguagcugggauuacaggugcacaccacugugcccagcuaauuuuuuuguauuuuaguagagauggguuucaccauguugcccaggcuggucuugaauuccugaguucaggcaauccaccugccucagccucccaacgugcuaggauuacaggcaugagccacugcaucuggccgaaucucuguuguagugggaaucaaaugauugcccaacucucaggagacauagcccuguugcuucugauuaaggaaaggguuaagacuuguaacuuaaauaaauaaacagaacaaaaaaggauuggaaaauggagucccuggcagagaaaauagcaaacugggcuuauugaaugcaugccauuuugcuacacuugcuccuguugccuccucccccacugcuggaggcgggagguagaggaucuuucugcuggaggcaggcaaaggauauuucuuugguuuuuggagacaggguuucaccauguuggccaggcuggucucaaacuccugaccucaagugauccacccaccuuggccucccaaaguguugggauuagaugugaaccaccgugcccggcugguaggggaucuugaauguugcuguuccuuugcccuuagcauuugcaccagguugucugcacagaaacgaugaccccucuuguugccuguuggaagucuguuuguuccaacccuguguuuucuuuccuugcagcugguccuggacucccagaagcgagucuucuccuggggcuuugguggcuauggccggcugggccacgcagagcagaaggaugagauggucccccgccuggugaagcuguuugacuucccugggcguggggcuucccagaucuaugcugguuacaccugcuccuuugcugucagugaaguggguuagugauuucugcccccuggcuuaucagugcucuggugcggaaccguguagccauuguccugucccuagaccacgaaccccaauucucuuuaccucccaguguucuuuauuuuuuugagacaggaacucguuguguuguccaggccggugucgaacuccugggcucaagcaguccuaccaccacagcguccugaguagcuaggacugcacaggcacgccaccacgccuggcuccaguuaucuuuuagacagaacacuuguuugccaucccguccucuuuucacccugauaauacugaagaugagacucagcucucgaugucuggucacgcugggaacauguuuugucuucccuuagguggucuguuuuucuggggggccaccaacaccucccgugaaucuaccauguacccaaaagcagugcaggaccucugcggcuggagaauccggagccuggcuuguggguagguggcagcaucuccuguggguaugaggucucuuccuuucaugggggugucagacacacccauggggugccccucccugauggggcucuguuucugcugccuguugggcuguccucagcaggccaucugacacacugaaucccagaguccggggguacaggaggggagagggcccauuugcugcuagaacagauggcuguucccugucuugugggaagaaagucauuuugaagguuucuguucaaagaaauaaacaagcagagcuugauguauuccuacgcugcagguugaaaauuauacguaguuggaaacguagcaggacuugaguugcugugacacugggaagacgacauugucuuggcagcagugguuuguaguucauuucaggacaccuguugaguuagcuagcacuucuugcugaggaguuggauuuaucagcuggcagguguggguggaacaguaugaggggccucugucggcguggcuuuaaucuguugaaggcucuagcccugcccaaaucauuaugcaugaaggcugcucccucuggaacaggcuuucacuuuauccugaucuggucuccucuucccaaagcgaccucccacugagagagagcugugcaggaugcacagcaagguccccugccuuuggccccuaggccugucuaagggcuuuguuguuuuguugaagcguugaguggccugcacggaacaaucuuaggauugaggagaaaccuguuggcccuguuauuguguuugcuacuuggaaugaguacgccaagggaaaaguggcagcucacacucaugcccuugagccauagcugcgugggugcaggucuggggcugcuggcccugcagugacagccugccuguuugcaggaagagcagcaucauuguggccgccgaugagagcaccaucagcugggguccgucaccgaccuuuggggaacugguaagcugucaccugugcgggucaggggaaguggaagccagucaggguggcucauggccuuuggguucucuccaccugucucccaaaacacacagaagaaaaacauuugggauuccccccuuauuguauuaagguuugcaacacgauugagucccaugaguuuucaaggacaauucugugcuagucagauaauucugagucaucucugcacauuuguaaacucugaaaauugggacuuuucagauccgguuuccccucacauuuuguaaaccacaguuggguuaugguaggaaaagggccuguuuguucccucuccccuggaggccuaagucagugggaaacucacaguugugggugauuugaggacauucuucauuuuuccaaauugaguuuaaaccuguguuucuguuguuaauaccaguuacuugagugaugagguuagaacucaugacccucaauuucacacacguggccuuccgcaaacaaaugucuuucauucuuagauccuggugcuaggugagucuuuuuuuuuuuuuuuuuugagauggaguuucucugucacccaggcuggagugcaguggcgcgaucuuggcucacugcacccucugucucccagguucaaaugauucucaguucuccugcuucagccuccugaguagcugggacucuaggcguuugccaccacgcccagcuaauuuuuguauuuuugguagagaugggguuucaccauguuggccaggcugucuugaacuccugaccuuaggugauccacccgccucaaccucccaaagugcugggauuacaggcgugagccacugcaccuggccaaggcgggucuuugaguuuuuguuaggaagacuagcuuggcuguggagugcauccugaucugccuacacuagucaugguuugauucuccgcuuaacucuugguggucuuaguuuuagucccuuauuucuuguuagaagcacagucugucucccucuccugcacucuugugguugcaagguacucuugugguugauggagaggaggggaaggaagggcguuccuuggucccuugagcuguggcugggauggauggugaaugcaccuuuuucucggggcucugcacacccuuggagucuggcucagaugcucugguggcccgauuugaaacauugacaggaaagagacagagccuggcccaguuucuacagauaguucuuagaggaggaaggauguuuucuggggccuaucagaaauagacuuugaccuucuaaauauaaauuuugaaacuagaggggagcaagggagacuuuuuggggagcuucucaagggugagaaguuggccuggcaccuuggagggaacaucuacugugugggaaggcccgagguggggccuggcaggagaugaaaccagggacaugugggcaggccugggcuggggagggaggguccuccucucccgcccugugggacccucuguuucaccugagccagggccuucagucuuucaauugcccagcuccacaccuuugcacaagacucccccuuagcugcgccaauucauccaguuccuucuaccucugggagggaaacugguucucuggugccauugcuaauagucucccugucacgcuuaagcccuuuuauuuuguuuuguuuuggauggugauuauuccacucuggaugguggaggcaucaagggcauuuggucagcccguguucuuggucgcuuugguccugaagggccgcaguugccauucuuccugcacucguggugucaucucuugucaccagugccauacuccccagaagggacuugugcacacagaaguccugcaggcuagaguugggcaccuuggucuuccuuagguuaagcgcuagucgccugcugguggcaccuuuuguggauaaacuuggaugauuccaccuggcccuugugugcaaggguggccgggcuugucaugggccagagggcaucaucacuggcuucugguuagugggggccaggaaauguugccgugauuccccacuuguggacugagccacauggauccucgauugcgaacaucuuguuugcuucgccagggcuacggggaccacaagcccaagucuuccacugcagcccaggagguaaagacucuggauggcauuuucucagagcaggugagugggggcagcugugccagcucggggacguguccguacccagugguaugucacuccucaugauuuugaucaucgcagucuguuuggguugucuuguuuaccaucucagcuggcuuuccuggugucucacgcuaagauuuguuugagagguaacaaucauucugcaggagagagugcacaggguugcuggccaggcuggguggcuguccucacccuugaugacagauggcaccaacuggccgcagcagauccacucucgggcgagcacaucgcucgcgucuccaucacacccaggacucagauccacugggcuggaggcagguccgcagguccacagaguagaggcugcguggcugcaggagucagauggcggggugaggccccugcggcucagucagccagccugcuggcccugucugccaagacacagagagggguggugcaccucacccaggcaggauugugagccagagaggggggggauggaaguggagcuggagccauguccccaccugucccugcugauaagagguggcccagugggcuuccuuccagcugggucucccagggcagccuggaaggcucugauuggcagagcguugguggcagucacauggaaacuagcugucuugggcagaggggcuuuuugcaguuuucaagggcacucuguuuuucuccaugcugacccgcuuuagcagcccaguuuccagagucucuucaacgcauugauuaguccaggcgccucaggcacacccaacgcugauuuguccccccaggucgccaugggcuacucacacuccuuggugauagcaagagaugaaagugagacugagaaagagaagaucaagaaacugccagaauacaacccccgaacccucugaugcucccggagacuccuccgacuccacaccucucgcggcagcugucauuuccaugugcacugggacgggaagucaaacgaggaauuuaaaaaagcaaaaguugaccgaaggugcauuuuuguuuagacucccugagguuccguuuuacacaugauccaacguuaacuaccuuuuuuucuguaugcuuuccaaaguccuuuuuuuucccuuaauguugaauuaaaauacuugcucauaguugauuuaccauuccuacaaaagaggcagaaacuuugagcaaucuagguuuuuuuuuuuuuuaaguuuuuucuuucuuccucuccugaauacacuccccaaaacaccccuuuccaguuacaauuagcaucgugauccaagcagaugccacauggaagaggaaucgccauuuacucagaaaaaaugucccuuacaggaaccggcagcagcuaggcagucaccggcccgccuccauccaaaaucacgcucgcgugcuucggaagcauccgggucacuccuucuccgcuuuuucuugcagaugggccuaggccggugucgguucuguuucuccccuuggcugccuguacgcccacagccuucuggcugcgacauuauagaaucggccguguccccccuggugggggauuggggaucuguguuuagccauuuauaucuacuuuagcuguuaaagagguccaaaugaaaaucaggugauuguggaaccauggggacuuggggguggggcagaggugggaacauuuguaucaguugagucagcuugguggcucccuguggagccagggcugagccuugucacgcgcacucgccaauuaagagauggaccagccagcagucaagugcauucuccaguccuugcaagaaggaucagcccuuucugugccagccucgaucgccuugugcuuuggucucuuuuucucccccccgccuggauccugccucgcgcgggccguccuguugcugagacucgggguaccguucugcugacccagcucccuuuagucacguuugcuuggcucugguaccaaauaguugggauuaccgaagaguccccuuccuugcgugucagcacggaugcugugacugccaccugcguccucgucaagugcccgagcucgccgccgugugugcugcgcugagugaguuaugaggugccuuucccggaacccuccucucgccuggacccaagagaggcgacagcuguggcuggggcucuugguuuccagagggucuggacugguuugggugcuuuaaaauagauauuuaguucaguggugcuuaugggggagaugggacuagaacuuaagugugagacuuggguggaugggaaaguuaaauauuggucucuucaaguuuuuuuuuucuuuugcuuuguuaccacuugucacugucuccauguuaaaaugccaaaaaugauguaguuguuguugcuuuuuucccuauuuuccaccccagucgcuccuuaccgugacuccugcccuuggagggcauguagcagugucuguccugccagucccaaggcccugugggaggagacuggccugcaucucucuaagacuuagucugacgccacgcgcaucucuuguucuguguucaaucaguaguccaggggagaagcuucugcuacuucagagcuuugcuaaacuaaccuaauuuguccaaaucaccccaaaaccaccaucucugacguaagcuuccaugcgacagccugauccguuucccuggacaggucucuuuccuggaaugcagcccaggcaccugugcuccuggcacccuugaggucucuccuuugagccguggucaccgagaggguugaggacgcagcacccgaggucccagccuuugcaggagccucccugggcuuagcuggacuuagaucuucgguggccucauguaaacguggcagccagccucuucuagaacccuagcccagggacuggagcaggaaagggaccuucaaagugaagacugccuugucccgcagcuccuucuggcuuagauugaaaaaugggcuuccuaauggguuaaauccuuuaaaacaaggaguugugggggaagggugucgugcacuccuagagaaagguacacaguugcccgguugggaaugugcuuggcgcugacccugcgggcaucugacuggucuuccagcucaggaaaaagaauuugaaagaggcuuagcgugaaggggaaucaaagaggagguugugauuuggucgaaggugccugguuuagugcuguaauugucuuauuauuuuuuuuauauauauauuucuuggaguaaacauuuuaaauaaacaacaacauugucuacugucuugga

SEQ ID NO: 191428 - RNA, 35441 nt, Homo sapiens
acccgggaaaccggaagccgccucccacuugguugcucguacgcggcuaguggguccucaguggauguaggcugggcgccgcgauguucgacgggacaccggcggagagcgaccucgggguuaagggguggggcugacgucaggagccaagauggcggcgguggucgcccucuccuugaggcgccgguugccggccacaacccuuggcggagccugccugcaggugaguccuggagccucagagagggaaaagucaggaaagccacagagacugccuggagcugauggggcugcggagagacugaggaagcauagggcaaggccucagggagauggaggaccuccucccccuggugcagugcuuugguuuggcuucgagcaucccugucaaguuaucuuucugcgccucgcagcagcuugugaguuagggcacgggcaauuuuuuacagcuaagggugcgggggggggggacguucagaaaggggacuugaauugcucaaggucacauggcaagcgaaugacugcuggaaccagaauuugaauccagacauuggaguuccaagcccuuuuucugccaccaaacuaucgccucuguagaaaagggagaccugcggggugugaaggaugggaauugggaagcgagguaauuccucaagggugcgagguugaggaccgggaugggugaggaaaggacaugugaauuguuggggacagggcaggggaagggagagauggagggaaaugcacccagcccccuaccucgaaggaucccggaggugggugguggggguugcaggaaagacuggguuccuuaaagcagugucaccacaguuucacuaguauccucucaguguuucugacucuaaaggucauauaauaauacggaccucauagaguugacauggaaugacagguagagggcuuggcgcuguucuuguuuauuacuaugccgugugcaguaacagauuuucccacgccccuuguauggccaagaaacaacacauuucugaccugccuucuaagugggaacauuuagaaggggaagggaaauugcuuuuguauacauaagggacuaaggauuugcaaauccuuucuaagucuguuccucuucugggauucucaacaaccccuuuaaggugggcaagcaagaauccuuacccuccuuuuuggagcuuugaaaacuugaggcccccagaaagaaaauuuuuggcuugcucaaaauaucacauucccaagaagcagaccugaggcaguuuuuuaacaugguaccagaaaaacuccuuagcauagaucuugggacaugguugguguccaagaaauuuuaguuccucuuccucucuugcacuuaaaugaggacaucuuucaucuuaagugccugcuauggcugcauaacacaguacauauugcccauguuccaauccugguucuauccagcaugcugugugugaacuuggauccacucugucugcaucagccuuucugaaaaggggagauagaggaagaagacagccuaccagagccucaagcugacauccucucaguauuaaauugaugauugauaaugagcuuguuuaccuguuccuuuuauaguugcugagcaaacaauuaaauugugagagccccacuaacgagagaguuccaagccccucuucuaagaaugcauuguagaaaaggcuaauuucauaggucauuuuuguaauuccaggcaaggucuuugcagggccuccugagggcaacagaaaauagaagagccccaaggccuccccuuccuugugggaauguacauguauacccacaaaagccaccucaaaagaauucaguaaugagcuugguguguuaccuguggguaacauucagguucagguucugaauucuuuuuaugcuuauagucugaccacugaaccacaauucugccuguaaguauuugacuguaguauauuaacuauuguuuguguugccuuauuucuucaucuggacuaugaacuccuuuaggacaagaacuaccuacuuaaaaguguguaucuugccaggugcaguggcucaugccuguaauuccagcacuuugggaggccaagguggguggaucaccugaggucaggaguucaagaccagcccggccaacauggugaaaccccgucucuacuaaaaaaauaaaaaaaaaauuagcugggcgugguggugggcgccuauaauccuagcuacacaggaggcugaggcaggagaauugcuugaaccugggagguggagggugcagugagcugaaaucgcaccauugcacuccauccugggcgacaagagcgaaacucagucucaaaaaaaaaaaaaaaauuuaaaaaaugugcaucuuguuccuuaggcuggcagggcuaggauaccuauuuacaaaucagaauaauacaaagacugauaagguugccaaucuuguagagcaaaaauuuuuuucugggcuaugcuagaaacuugacccccccucccccggguuaucuuaugaggcagauauuaauacuacccacccuuuacaaaggaagaaauagaauccgaaaagcuaauaauuugcagaagaauacacagcuuguaagugauagagcuuggauuucaagcaucaccaaucacacuuuucagcaagccugcaccuuguauuuuacucaggcuuaucuucauacaguccuuuuugcuuucuuccucucuauuuccccaccuucuucucuggccuccaaaucuuuauccacuccauccaacuccaagccugcacccuaaggacacuuuacuggaggaacaacaaccagccuucagcaccauucagaauucacccuucucaguucaguuguugcuuaccuugcuuaaauuauaaacuaugaaauucauacuauccaagauuuccuaggaauguacuuucugccuugaauacucauuagucuuuagauuaacguaaaaaugcuuucaaggggcccucuuuccuuuuggauuuguaguauaaauugcugggcagguaacaaggggaaaaaaaucauauagucucauuguaugauuagagcaacaacuucuuuuguuccuuggaucucauugugaaauggaauuaucuuuuugcacuguugcguuuuauguuugcguuuucaccacugguuauaauggcuaaaagguuggauuuuugaaucaagugaccuguguugcuauaugauccuauccucgucuuuuaacugggaacaacaaaacauuuuucauagagauguuauaaagauuagagauuauuuggcaccgugugugacagauuauaaagguucgaugaaugaaaucuggcaaauuuuuagauauauguauucaacgaauuuuuugguggaacacagauaacauaauccugagaauuaacucuuuguacagaccucaagaugagcaaagcucuaucacuuucagaaccaugaccacucuggugauuuugauuucagaaucuucuuucauucugguaaacccccuuugccccaccaaauauuguaugaaauacauuuuuuuuuuuuuuugagacagagucacgcucacguuguugcccaggauggagugcaguggcggaaucuuggcucaccguacccuccgccucccggauuucaagcaauucuccugccucggccucccaaguagcugagauuacaggugcccgccaucgugccugucuaauuuuuuuguauuuuuaguagagacgggguuucaccguguuggccaggcugaucucgaacuccugaccucagguaauccaccugccucggccucccaaaguacugggauuacaggcaugagccaccacgccuggccuauaaaauacauuuuugacacaaaacaaauuuaaauuaguuguacugaaaaaaaaaaaaugaugacauuuuggggcacuccaaaacugauguugggauaugucgacuuagauauucaguguaguacauccuggcauugcucuuauuucacaucauucauaugauaagacuuuuuaaaaauuuaaauuagcucuaauacaaacuuagucucuuuuggaaagauaauacgugaucaauuauccguguagaguggauaugaaacagauauuuaaauguuauaaagaaauguugaagggaaaaccucauugcagguaaccacagucaucccacaggccuugugguucugauacccagcuugauagagccuaaugccuguugcccacugacaauacuaaaucaggcuuuagaacuaggggguuaugccuggcacaguggcucacaccuguauguaauccagcacuuugggaggcugaggcagguggaucacgacaucaggaguucaagaccauccuggcuaaaacggugaaaccccaucccuacuaaaaauacaaaaaaguuagccgggcgugugacacgcgccuguaaucccagcuacuugggaggcugaggcaggagaauugcuugaacccaggaggcagagagaucucgccacuccacuccagccugggugacagagugagacugucucacaaaaaaaaaaaaaaaaaaaaaaaaaaaaaagaacuaggggauuaugcuccagucccagauucuguuuaaagcccgguuaggggccaggcgcgguugcucacaccuguaaucccaacacuuuggaacgcugaggcagguggaucacuugaggccaggaguuugagcccagccuggccaaauggcaaaaccuugucuguacuaaaaauacaaaaauuagcuggacuuuauggcacaugccuguaaucccagcuacccggguggcugagacaggagaauugcaugagccugagggguggagguugcagcgauccaagaucgcgccacugcacuccagccugagcaacagaaugagacucuccaaaaaagaaaaaaaaaaguccaaguuagggccagacacaauggcucacaccuguaaucccaacacuuugggaggcugagaugggaggauugcuuaagcccagaaauuccauaccagcuuagccaacauggcaagacccugucucuacaaaaauuagcuggacaugauggugugcaccuauagucccagcuacuugggaggcugagucaggaugaucgccugagcccaggaguuaaaggcugcagugagccaugaucuccagccugggcaauaaagcuagaccaugugucuauaaaaauaaaaaauaaaggccgggcaagguggccuguaccuauaaucccagcacuuugggaggccaaggcaggcggaucaccugaggucaggaguucaagaccagccuggccaacauggugaaaccccgucucuacuaaaaauauaaaaauuagcucggcgugguggcaggcaccuguagucccagcuacucaggaggcugaggcagaagaaucacuugaagucgggagguggagguugcagugagccgagaucgcgccauuguacuccagccugggggacaagagugagaccccaucucaaaauaaauaaauaaauaaauauuuuaaaaaauaaaugaaaaauaaaaguguccaaauuagaaguaaaaacuugaaguagccccauuuuuuaaaaggcauauugucccacuuacccuacuaucugccucaggcacagcagccacccacucuggaaaauaguuuugucaguugcuuaaaaaaaacuaaacuuguagcuaccauacagcccaacaauuacacaccuggguguuuauccugagaaaugaagauguaacguucacacagaaauuuguccacaaauguucaucucagcuuuauucaugucaccaaaaauuagaacacccccaaugucccucaguaguuacaugguuaagcaaauugugguacaugauaccuuggagugcuacucagcuauaacaagaaaaaagcuauugcuguacacagcaacuuggaugaaucuccggagaauucggcugaauaaaaaaagccaauuccaaaaggcuacauaccagaugauuauauugauauaacauucuugaaaugaccgaauuugagaaguagagaacagauuagugauugcuagggcuuacggaguacaggggagguagggugggaggaaguggacagggcuauaaaagggcaauguuagugauccugugcuuaugggaauguccccuaucuugacuagcacugucaguauucugguugugcuggugugcuacaguuugcaagauguuccuguuggggagacuggguaaagaguaugugggcccuggcaugguggcucaugccuauaucccaacucuucgggagggccaggcagaggaucacuuggggccaggaguucaagaccagccuaggcaacacagugagaccccuaucucuacaaaaauaaauguaaaaaaacuaacugggcaugguggcgcaugccuguaguccuagcuacuggggaagcugagaugggaggaucgcuugaguccagaagguugaggcugcagugagcugugaucaugccacugcacaaucagugacagagcaaaacucucucucuuuuuuuuuuuuuuuuagcuugaguuucacuuugucacccagggugguauacaguggcacagucuuagcucacugcaaccuuuaccucccaaguucaagccauucuccugccucagccucccuaguagcugggauuacaggcacacgccaccacacccugcuaauucguuuuuuuguauuuuuaguagggacgggguuucaccauguuggcugggcuggucuugaaucccugaucucaggugauuucccaaccucagccucccaaagugcugggauuacaggugagaagaguauguggagucucaguauuauuuucuucuuuuuguuuuguuuuguuucuuugaaacagcgucucacucugucacccaggcuggagugcaguggcgcaaucuuggcucacugcaaucuccgucucccagggucaagcgauucuccugccucugccucccgaguagcugggauuacagacaugugccaccacaccgggcuaauuuuuguaucuuuaguagagacggaguuucaccauguuggccaggcuggucuugaacuccugaccucaagugauucgucugucuuggccucccaaaguacugggauacaggugugagccacugcaccuggccucaguauuauuuucuauaaaugcauaugaaucuauaauuauuaaaaaauaaaaagguuggccaggcacgguggcucacgccuguaauccuagcaguuugggaggccaaggcaggcagaucaccugagguugggaguuugagacuacccugaccaacauagacaaaccacaucucuacuaaaaauacaaaauuagccgggccugguagcacaugccuguaaucccagcuacucgggagacugaggcaggagaauugcuugaaccggggaggcggagguuguggugagccaagauugcaccauugcacuccagccugggcaacaagagcaaaacucagucucaaagauaaauaaauaaauaaauaguuuaauuuuuuaaaaaagcauuuaacuaugguuauaugcaguaacauaugaaucucagaagcauuauguugagugaaagaagcuagacaugagacuacguaccguaugaugccauuuauaugaauucuguaaaaggcagacucgugaugauagcugaucaguugcuaaggguaggaaaaggggacuuauguuugccaucaagggcacaaaagaccuuuuuggauggaaauacucuguuguaauugugguaggauuacauugcuuugucaaaacucauuauacccuuaaaauuagugaauuuuauuauaaugaauuauaccuuauuaaaucucacagaaaaaagaccaaaaaaaaaaugggacauuaagcaagcaaaguccacuggaguugauaccuucaggaaucuuuccucucacuuccucccaaauaccacaagguggcauuagauguucaugucaguuuacaaaaugggguucccggugaaaaacauuuguagaaauggcuuuccuuuuguugaugauuuuagccagcuuggugauaagguaaaacauagcuuucaucuuaacuuucauuuucuucauauauuuucuucuuuucuacuguuagcugauguuuguauuuucagcuucaguuaauacgggacacuuuaccaagaaauaauguuacugguagacggucuugaccacaagucgucaagguuuuuagcauguugaacaaaaaauuggacaaaacacacaagcaaagcaacagaagacgaaagcauagauuuauugaaaugaaaguacacuccauagaguaggagugggauugagcaagugguucaagagccccagcugcacagucuucugggauuaaaguacccuguacggguuuccuauuaguuacacccuaugcaaaugaagacuuggcccgagacgaaucagaggcuguagugaagacucccugucucuaaacccuguucuccugccucaguaauaaacaccacugcaucuuuuuguaauuagucaauuaaccuuccgaguuuuuacuuuucuauaucaguuuauuuuaaaaauuagcaguccuggaguauagucuuuucuuucuuuuuuucuuuuuuauuuuguauuuuugaaaaagagucucacucuguugcccaggcuagagugcaguggcaugaucuuggcucacugcagccucaaccucucgggcccaagcaguccucccacuucugccuccugagacgcacacuacgacacccagcuaauuuuuuuauuuuuuguagagaugggguuuugccauguuucccagacugcucucaaacucaugggcucaagcaauucucucacuucugccucccaaagugcugagacugcaggcaugagccaccacccucagaccacaccccacacuccuuccccuuaauucugguuugucaagccuccacuuagaugacaugugaggaagccuucucugacucuucacucauugaagucucugcuguauucauccagagcucccuguacuuucccaacaguaucgcucuuuauauucaucgugaauguuuaauuuaacucuuguucacuacaaaguaaguucugugaagaugaagguuuuuguguauuaagugcugugucacuagccccuaauaccaugucugauauauuagcauaugauaggugcuuaauacuuguuggauauugaaugccugccuuuucuaagaagauuaugugucaguaaugugugaguuuauauccagcguuacaucuguugugccagcaaaauggaauuaucuuguauuucuaauuuuuuuuuccuuuuugugaacuuuaaaaaauuucaggccucccgaggagcccagacagcugcagccacagcuccccguaucaagaaauuugccaucuaucgaugggacccagacaaggcuggagacaaaccucauaugcagacuuaugaaguugaccuuaauaagugaguaucucugugaaagccagcuauugaaggagaguucuugauuugauuuagggacaugcuuuucacauccuuggaaggcuuaaaaaucugagaucauccgauggcucuguuuuuaaaacaagaaugagcuugggccgggcacgguggcucacgccuauaaucccagcacuuugggaggcucaggcgggcagaucaucugagguugggaguucaagaccaauguggccaacauggugaaacuccccucucuacuaaaaauacagaaauuagcuggguauaguggcucaugccuguaaucccagccacucaggaggcuggggcacaaaaauugcuugaacccaggaggcagagguugcagugagcugagaucaugccauugcacuccagccugggcaacagagugagacucugucuccaaaaaaaaaaaaaaaaugagguuguuaccugauucagaagaauaauaccaaaauaauucccaaaugaaaguaugacaaauuucuagaaauacugguauaauuaacuuuaugcacaguauuuaaagucauuuaauauauuaccauuuuuuuaaugcugaauguauugauuauaucuuauacaucuggaccuguguuuucuauaauaauaacagaaccgccagaaacuugccuugaauggacaagguagggaugugguuaaaauguuaaaaauuggacuggcguguuaguuuucuauuucugucagagcaaauuaccacaaacuuagugacuuaaaacaaccuaaauguauuaucuuauaguucuguaggucaaaagacugguauagucucaucagacuaaaaucaaggugucagcaggcugcauuccuuucuggagccuagaggaaaauauuuuuugcucauuugcgcuauugguggaaugcaguuccuugugguugugagcccgaggucucugucauucugcugacuguaagcugagggcuguuccaagcuuccagaggcugccgcacuccuuggcucuuggccucuucuuccaucgucaaaagcagcagcagcagguugaguucuucuucacaucacaucucucaaaaccacucuuuuuccaacaucuuucacuuuuaaggaacuccacaguuagccaaagaaaagaaagaaucuagcaaguuagucucuagccuccugcugcuccacuccacgcccccauauaaccagaacuguucucugaucuguuuuauguguaagugaauaaguguuuuauuuguuucaaacaaaagcuucuguggcaccaaaaaaaaguuugaauaccacgaauacucuaaaugcuuacuuugacuuucuguggugacaaguaagugcuguuaaugagguagcauuaauugauauauaaccuucuuaaauagacaaaauuuucaaauacucagcaaccaaaagucccuagcaaaauucaaaggaauagaaauugcacagaccacaguuuuggaccgaaauacaauaaaacuaaacucauauuaaaaauauaaacaggccgggcgcgguggcucaugacuauaaucccagcacuuugggaagccgaggcagguggaucacucggggucaggcauucaagacuagccuggccaacauggugaaaccccaucucuacuaaaauauaaaaauaagcugggcguuguggcaggugccugugaucccagcuauuugggaggcugaggcaugagaaucacuugaaccugggaggcggagguugcagugagccgagaucgugccacugcacuccagccugggugacagagcaagacucugucucaaaaaaaaaaaaaaaaaaaaaaaaacucauaaaacaaaaaacccuacugcuuagaaacuaaaaaaaaguacacuucuaacuauuugaucaggaacacguaaaaaauauugccagauacuuagaaaauaaagacguugcaaaucaaaacuuagagaaugucagagaauguggcuaaaacuggaagaguuaaauuccuuuuuuuuugagucagggucucgcugucacccagguuacagugcaauggcaugcucacgguucacuguagccucaaccucccaggcucaagcaauccaccugccucauccuccugaguaacugggacuauaggcacaugccaccacacccagcuaaguuuuguauuuuuuguagaaauugaguuucacuauguugcccagccuggucucaaacuccugggcucaagcaauccacccauuuuagcuucccaaaguccuaggauuacaggcaugagccacagcacccagcccauaacgauuuuuuagugauaaaaaauuuaaagaaucuuuggguuuacuuccaguuuugucacaguagcucucaucagacuaacccuccuacaaauaacaaugaucaacuccggaaaaaaauauaagaaacaacugccugaacaguagagaaggaccacgagugggcagacauuggaggggaguugauacuuggaagaaugaaauggcauuggacaaauuaccauuuuacucuuacaugauuuugcugaggacaaguccaaguugguaugggaaguaacgggacuaacaguuggauggaaaaccacaauccgacugggugcauuggcucaugccuguaaucccagcacuuugggaggccaaagcaggccgacauggugaaaccccaucucuacuaaaaauauaaaaauuagccaggcaugguggcacaugccuguaaucccagccacuugggaggcuaaugggggagaaucacuugaacaugggaggcggagguugcagugagccaagaucacaccacugcacuccagccugggcaacagagugagacucugucucaaaaaaaaaagaaaaaaaaaucuuagcuugaauaacgagaagacacauuuugggccuuccacaaccacuaggaaaugagggggaaagccuagaaagaagagaaacacagaggaggagcacuaaaugcuguucaugaacucugcccacaucuugcgugcagccauauuaauugccuguguaaaauuuuaaaauccacacuuuucagaaaaacauaaugcaauccagauucucuacagcauauuaauuuuucuuuuuuuucuuuuuuauuuuuuuauuuugagucugaguuucacucugucaccuggacuggaguacaguggugcgaucuuggcucacugcaaccuccgccucccggguucaagcgauucccuugccucagccuccugaguagcugggacuacaggcgcgcgucacacaccgucuaauuuuuguaguagaguugggguuucgccauguuggccaggcuggucuugaucuccuggccucaggugauccacccaccucagccucccaaagugcugugauuacaggcaugagccaccgcgcccaguggaauuuaaagaauuuuuaaauuuccucauagauaaaggaaauuaugcucauaaugaaauaggaaauuucaguggagaaguagaaacuauugaaaagccaaauggaaaaucuaguacugaaaaauauaauauuugaaaaggaaaauuuaccggauggccuuaacagcagauuggaaauggcaauaagaagaaucagcaaacuuaaaaauauuaauagaaauuauauaguuuuuuguuguuguuuguuuguuuguuucuugagacggagucuugcucugucauccaggcuggagugcaguggcgcaaucuuggcucacugcaaccucugccuuccaggcucaagcgauucucccaccucagccuccugaguagcugggauuacagacgugcaccaccacgcccagcuaauuuguuguauuuuuaguaaagacaagguuucgccauguuggcaggcuggucuuaaacuccugaccucaagugauucacccgccucggccucccaaagugcugggauuccagacgugagccaccaugcccggccgaaauuaucuguucuuaagaaaaagaaagauuuuugaaaagggaaagcgcuccugugaucuauggaacagcaucaaaaggucuagggcaggcaugguggcucaugucuguaaucccagcacuuugggaagcugaggcaaaaggaucacuugaggccaagaguccaagaccagcuugggcaaccugugagaccuugucucuacuaaaaaaauuuuuucuuugaaaaauuagccaggcgugguggcacauaccuguaguccuagcuacuugggaugcugaagcaggaagacagcuugagcuuaggaacuugaggcugcuaugagcuauaauugugccacuguacuccaaccugggcagcagaguaagaccaugcaugggugaguggauggauggauguaacacacauguaauuggacuuccagaaaaaauggagagaaagaaaaggcaaaauaaauaucuauuugaagaacucauggccaagaauuuccugagcccaugaaagacauaauucacauauccaagaagcuuagugaaccccaacuagguaaauaaaaauaaaacuaugcccuguuccaugaagucaaguugcugacgaccaaaaauaggagaaaaucuugaaagcagcuggagaaaaacaacauguuacauacaaggaaaccaggugaaaaauugcugacuucucaucagaaacuagaggccaagagacagugaaauaccaucuuuaaaguacuaaaagaaaaauugucagccuggaauuccacguucagaaaaaaagauucuucaagaugauuaugaaauaaaaacauuuucagguaaacagaaaagaaaagaauucauggccagaagaccaguacuacaugaaaugcuauaggaaguuagucaggcugaggaaaaauaauaccagguggaaacuuggcucuuagaaaaggaaugaagagcgcuggacauaguagauauaaaaggauuuuuccucuuaauuuuguuaaaauuaauaugacuguuuaaagcaaaguuauuauauuauauucuguaauauauaacucacauagauguaaggcauaugauaacuauagcguaggggcugggaacagcagguaaauagaccuauaauaauguagcaggauucuugcauuacauaaaguugcacaauaguaacucuaaacagguauaaagaguuaaagauguaaauuauguaaaguauaauucuagaguaacuuuuuuucuucuucugagacagggccucacucugucauccaggcuggaaggcaguagcacaaucauggcucacuaaacccucccaggcucaaccaagcaauccucccucccugagaccuccuaggcucaagcaauccucccaccucagccucccaugucccugggacuacaggcauguaccacuaugccuggccaauuuuuuuuuuuuuuuuuuuuuuguagagacagggucucacuauguugcccacacuggucuccugggcucaagcaguccuccugcaucagccuuccaaagugcuaggauuacaggugugagccaccaugcccagccaagaguaauuauuuuuuuaaaugcaaagagauauagcuaaaaagccaauauauaaauuaaaauugauuucuaaaaauauuuacuuagucuaaaaauauuacuuagaauaagaaaagaagaagagaacagcagcaaaaugauggaacaaauaguaaaaugauagaccuaaauccggccacgucaauaacuguauugaauguaaaaacuauuaaauacucccaguuaaaaagccaacagugucagaauagauuuuuuuaaaaaaagcaaaacccaaccauaugcuguuuuaagugcaagaaaaagcgcaagaaaaaauaaagaaauacauuugaaaaucaaugugauucaccauauuaacagaauaaagggggaaaacccauuugauugcuuuaauauaugcagaaaagcauuuggcaagauucaacacucauucaugauuuuuaaaaaugauaauggguuaaauaauuuucacaguguguauauuuuaacagaauaaauaaauaaaacuauaaggaauuugaauuaaaaggaauaguccuaauuuuacuuaaauaauaacugcuaauaggaaaagaagggaacuucaucagccagaugaagacugugaaaaucacagcuaauagcauacuuuauugugagauauugaacacuuuccccauaagaucaggaauaaggaagguuguccacucuguauuugaguucaacauuguacugaagguucuagccaguccaugaaaggcaaguaaaagaaguagaaggcauauguaagcuuggaaaggaagaaauuaaacuaacuguagucacagguaacaugauuguuuacauagaaaauuucagggagucuacaaaacuaaaagaauaaguaaauuuagcaaggcugcaggauguaaggucaauaugcaaaauacuauuuguguguguguguauuucaauggcuacagauaauucuauuuaugcuaacaucagccauucaaaauuuuacuggaggcuuagccagggaaauugggugagaaaaagaaagaaaaggaaauuggaaaagaagaaguaaaacugucucucauagauaacauaaucuuuuacacaaaaccuugggcaggcucaguggcuugugcuuauaaucccagcauuuuggaaggcugaagcaggagaauuuuuuuuuuuugagacagaguuuucgcucuuguugcccaggcuggagugcaauggcacaaucuuggcucaccgcaaccuccgccucccggauucaagcaauucuccugucucagcuucccaaguagcugggauuacaggcgccugccacuacgcccagcuaauucuuuuguauuuuugguggagaugggguuucugcguguuggucaggcuggucucgaacuccugaccucaggugaucugcccaccucggccucccaaagugcugggauugcaggugugagccacugugccuggccugaagcaggagaauugcuugagccugggaguuggagaccagccugggcaacaaaaugagacccccaucucuacaaaaaagcaaacaaaaaauuagccaggcugggugcgauggcucacgccuguaaucccaacauucugagaggccaaagcaggcagaugacuugaguccaggaguucaagaccacccuggacaacauggcaaaacccugucucuacuaaaaauacaaaaauuagccaggcaugguagcacacaccuguaaucccagcuucuuggaaggcuaaggcacaagaauugcuugaaccuagguggcagagguugcagugagccaagaucacgccacugcacuccagccugggcaacagagcaagacugugucucaaaaaauuugccaggugugguggcacacuccuguaguccgagcuacuugggaggguggggugggaggaucacuugaacccaggaggucgaggcugcagugagccaugauuccaugcccuacacuccagccugggcaacagagggagacgcugucucaaaaaaaaaaaagaaaagaaaauauaagacauugcccccuaggaacuauuagaacuaaugaacaaauucagcaagguuggaggacacaaaacugguauacagaaaucaaauguaguuuaguuuuuuauuaugcauaauuuguccauguuuauuucaaccuaugucugucagucuucauuuuauauuguaccauguuuuaauuauaguucuauuuccuucuaauccgacucugaaacccuacuuuguagcuauguauacacacacaaaaaauagcuauauucuuucauuuucacaacagcauaauucuuuuucugaaaauacuggcguguagcagauauuagcagauaaauguauuuuucuaggcuaggcaugguggcucacacuuguaauacuagcacuuucuuugugaggccaaggcaggaggauugcuugaggccaggaguuuugagaccagccugggcaacaauagcaagacuuagucucuacagaaaaaauguguguguguguguguauacauauauauuuauauauguauuuauauuuauauauucauauuuauauaaauauuuauauuuauauauucauauuuauauaaauauuuauauuuauauauucauauuuauauaaauauuuauauuuauauauguaaaacccugcuuaccuagaaaaaagccuguaaguacuguuaaaaaaacaaaaauuggauuucuauacacuagcaaugaacaauccuaaaaugaaauuuaaaaacuauuuuccauauaacagcaucaaaaaagaaauucuuaggaacaaauuauaugggcaauaagacaaaaccccaucucuacaaaaaaaguuagcugggcuugaugaccuuccugugccuauagucccagcuacuuggaggcugaggugggagaaucacuugagccugggaggucaaaccugcagugagcugugaucacaacacugcacuccauccagccugggcgacagagugagauccugucucaaaaaucaaauaaguaaaagacuuauaugcugaaaaacuguaaaacauuguugaaagaaauuuaagaagacauaaauaaauggaaagacaugcccuguuuguggguuggaagacuuaauguuguuaaggaggcaguggucuccaaauugauuuccagauucauugcaauccccaucaaaaucccaccugccuuuucugcagaaguugacaaguugauucuaaaaaucuuauagaaaugcaagggacccagaauaucaaacaauuuugguaucuauguaaaaucugagaaaauuuauguuguacucuuuaaugagcccuaccuauuaggaaauuuagcaugaaacagcuuaaagagaggacuuugacuuuuuaauauuuuucucugucccaguaugaucugcaggauuacuuuuuaccuuugauuugaauuuauuuauuuauuuaucuauuuauuuauuuauuuuuuugagacagucucgcucugucucccaggcuggagugcaguggugcggucucggcucacugcaaccuccgccucugggguucaagcaauuuuccugccucagccucccaaguaauugggacuacaggcacgugcaaccacacccagcuaauuuuuuguauuuuuaguagagacgguuucaccacguuagccaggauggucucaaucuccugaccucaugauccacccgccaaggccucccaaagugccucccaaagugcugggauuacaggcgugagccacccaccuggccaauuugaaauuuuuauaggcugcaaauauuagccuuuguaauguaaaaaaaacaaagauguuguugucauuuaaaauaugcuaggacaagaacaggcagaucauuagaauaaaaauguagcaacaaaacagacucaauuuuaucuaaguucccaguauuaaauaugggagaaagguauuacaaauaagaagcaaaagaggauuuagucagugauuugggacaacugauacaguuuuugcaguuuuaggggaguaacuuaaaauuuuuuuuaaguagaaaaaaauguaaaguauuuaucagaccucaggaagggcaguggucuguuuaggcuuaaaagugauagauaauguuauaaaagaaagaauagccaccuuuauuaauguaaacauuuaacucauguauguuuaaaauucuguuaccaaaauuagaagucaaauagcacauuacuauuggcagugagggaggaagcagaaauggcaacagauauaauauauaagagccucagaucaugaaaaagaauuuccaagacccugguaaacagaggcaaagaauguggacagacugagucucuagaaugaguccucuggaacagagcuuugugcgggcaggugguauucgucucuuuuauucucugcuacauccccagcaucuagaacagaaccuggcagaguaaauguucaauaaauaauugggaaauaaagaaaaauuaguaaauuuaugacaaacauucaaccuauguaguauucaaaagucucgauuuaaaacacugaaaacaauaacacuucuccaguaucagaauagcaaagguuuuuaaagcuuccaauucccaguguuagcagagguccagcagaaaggacgucuacauagugcugauacaaauacagauaaugggccagacgcagucgcucacaccuguaaucccagcauuugggaaggcugaggcagguggaucacuugaggucaggaguuugagaccagccuggccaacaugggaaaaccuaucucuacuaaaaauacaaaaauuugccgggugugguggcaugcaccuguaaucccagcuacucgggaggcugaggcaggagaaucgcuugaacccggaagguagagguugcagugagccgagaucgcaccauugccucacacccauaaucccaacacuuugagaauccaaggcaggaggaucacuugaguccaggaguuagagaccagccugggcaacauggcgaaaucccaccucuacaaaaaaauacaaaaauuaagcuggaugugguggcacauaccuguagucccagcuacuggggggcugaggcaggaggaucucuugaggcugggaugcggagguuacagaucugagaucgugccacugcacuccagccuggguaacagagcaagaccccgucucaagaaaaaaaagaaaaaaaaugaaauacagauaguacuaaaggaaaugacguauuuuuaaguauauuuuuaaucucaugcauagaaaauuagugaguggaaugggggcaggguggcaaccagaaaauagauuuguggagcacuuacuguaugccagguacuaugaaaaauuacauauuuuuauguaauuuucacaguaacccugugguguaaauauuaacucuacagauaaacugagguucagagaguaauuuccguagaaucacaguuucugcaugaugauuauuauaguuaaacuaugauuuauaugucagaugcugcuguaaagaucucguguguauuaacucaccuccagcaauccugugggaugcaggugcugcucucugcacucaguggauuaaaugccuaggcagaaauuaaaucauuugccugcaagcugguaaguggcucagccauggugcagaccagucucuuggcugccaggccggcacuccaggucccacgcccagggaugcuccgcuuaguaccaugucacugcccuuguauguucuaggaggcucacagugauuugacugggggacugugagugauugggugucuuuuauucucuguacuaugucuucucuuaugguuauguauuauuaauuacuauuuaaaacuauugucuacauccuaaaaaucaaacuaaaauuugaaauaaauuauuuggaaaaacuuugcagggagcuucagaaguaaaaaacaaaaacucggccacuguauggaaguugugucauacuugucuacuacuacuuuagcuuuccauuuccuagaaauguguuugcacugugaucaucaaaauagaacugugcaguacuuaaaauguaagaaucugcaaaaacaaaacuacagaacaaauuccgaaggugaccugagaagaccaaauggauaagcuaauacauccaggugucuccgauuauauuaugauaaaguguagggagguugaacguuacauaaauaccacuggauauuuuucuuuguuagauguggccccaugguauuggaugcuuuaaucaagauuaagaaugaaguugacucuacuuugaccuuccgaagaucaugcagagaaggugagcauuucauuccuguugggcuccagauacuuguggucuuccaaagaggcuugggcuggccaaagcugauagagacaucuggaaaacagcugcagcucucugcugggugaacuugcugugcaaccuaauuccuuuucuuggguaaaugcauccaaaauucuaaccauggugcaaguucugguuucugaguuuacuuuccuucaggagcauucuauccugugguuacugcaucuggcggucccugugagcugcuccacgcuucaaggccuagcuaggaccugcuggcuggcaccuuccaugcugcugagcucuuuuauuaagggagcaguggagaguuucugucuggcacuuaugcuuguccagcaggggagaugugugagucucccucagcucccagcaugacauguccuugguagcuguguucuggauuggcugguacagugucucccucagcaugugguuacuugugcugcuggugccacaugagcccauuugaggcagugugcagacuaacauuuucuacaugaauagcaauguauucauuuucuguauuagaaaaauauaauuacugccgggugcgguggcucacaccuguaaucccagcacuuugggaggccgaggcggguggaucagcuggcgucaggaguucgagaucaaccuggccaacauggugaaaccuugucucuacuaaaaauacaaaaauuagccgggcgugauagcggacgccuguaauccuggcuacucgggaggcugaggcaggaacccgggagguggaguuugcagugagccaagaucacgccacugcacuccagccugggcaauagagcgagacagucucaaaaaaaaaaaaaagaaaaauauaauuacuaaugaugguauaauagggauauaagugguuuuuuaaugugaauuuaagcaaaacaaguuaaagaaaacccaagagauacuuuaaagaaaguugauucaggugguucucagguauagcaaaaauugcacagggugcagugaagaccgacuggccugauguccguggagccagacugugugcccggcucuguucugugcacuggacaugagguagaugacugugcuuauuaucuaccuucaauuuaaaggugaggcccagagaggguaauggacuuccacaaggacacauagagagugacuugagagccgggagucagccaaagcugucagacuccagacuccagaucugcucucucaggcacugacuuggcuuggaacaccugggauaaaacaaaagcagagaguagcuugauucugugaggacacugagcuuuuuucuaagaaaaccuuaaaaaaaaaggaaaagccaguauugauaccggcccauggcuuuuuaucuguucagcuguacauuucaagcauuucaagucuuuuaagacaucuguuuugauucagcuaaucuuauuuagcguugcaaaugcugauggauauuaugauaguucggcugaguccugcuguucagggaacauucugcggcaguuaaacagcagccuuccccauuaaguccuggcaacacaggaaagguagaugcuuuucaguaaccuuucccuguaggacucuuucagaaccaagaacauaaggugugacccaucuggacuaaaaaaaauaaagcagaauuguaucaauugcuacuccuuuuuauucccaucuuguuuuucuuauuuuuuuuuuaauucccaucuuguaagagaauucccagggagccuuuuugagagaaaguucauuggauuuauuuuuuuaauuuuuaugccauuucuuguaaaagcaaacugcucuaguuggaugccagguauacauaaauguauugauaauauccagucucuuggggaacucuaggaguauuugcuuaagacacaucuuuggguucccuuacacucuuucuaagauuuacaggagaaggagagucuuacugucuuuucuagucuuaugaaagugauaaccgacugggcgcaguggcucacgccugugaucccaguacuuugggaggucuaggugguaggcuagcuugaggcuaggaguuuaagaccagccugggaaacauagacucccuuuccauuaaaaaaaaaaaaaaaaaaggugaggccaggcauucagaggccgaggcgggcagaucacaaggucagaguucgagaccagccugaccaacgugguaaaaccccgucucuacuaaaaauacaaaaauuagccaggugugguggcgggcgucuauaaucccagcuacucaggaggcugaggcaggagaaucacuugaacccgggaggcagagguugcaguaagccgagaucgugccacugcacuccagccugggcgacagagcaagacuccaucuaaaaaaaaaaaaagaugauaaccagugcaacuuucucaagcaaucagguuucucugaccuaaugaucuucaaaaaacagcuucagaggacuggcacuagagguuuagaguacauaaucauuuuuaaauuccaaaacacccaggaaauuuccauauacaggaaguagguccaggcuaagaaaauucucaugucgggguccugggucagcacguuuuuuguuuaguuugcuuugcuuugccucaguuucauauuaguucauucuucuccucuuuggaaaguccaugcugagucagcuuuuguggauuucauagccccaggguacuaugcugcguauuuuaugaagacaauagaagaagccuuaccucugucaaguguaguggcucaggccuguaaucccaacacagugggaggcaaaggcagaaggauuacuugaggccgugaguuagagaccagccugggcaauauagugagacaccugcucuacaaaaaacaauuauuuuuuucuuuuuuuugagauggaaucuugcucugucacccaggcuggagugcaguggcgcgaucucugcucacugcaaccuucuccuccucaguucaaaugauucucccgccucacccuccugaguagcugggauuacaggcacccaccacgacuuauauuuuuaguagagacaggggguuaccauguuggccaaacuggucucgaacuccugaccucaagugaucugcccaccucagccucccaaagugcugggauuccaggugugagccacuucacccaaccuacaaagaauuuuuuugaauucgccgcacauggcggcaugugccuguagucccaacuacucaggaggcuguggugggaggaucgcuugagcccagaaguuugaggcuaaagugagcuacagugagcuaugacuccaccacuguacuucagccugggugacacagcaagacucagccaagaaaaaaaaagaagaagagcuaucucuuaauaaucuguauccaggucacuucaaccuuaagaugaccaagacaauguugauuuacuuuacuuuuggguauugugucuguuagauuuguguucaaauaacaguggcuuuaaaaaaucuagguuuccaggcgugagccaccacacccaccccuacucaggaggcugaggcaggagaaucacuugaacuggggaggcggagguugcagugagccaagaucgcggcauugcacuccagccugggcaacaagagcaaaacuccuucucaaagaaaaaaaaaaaaaauaggcuugacgggugugugguggcccagaccuguaaucccagugcuucgggaggccaaggcaggcagauuacuugagcccagcaguucaagcccagccugggcaacauaacaaaacccugucucugcaagucucgucucuacaaaaaauaccagaaaauuagcuggguguggugggcuacuucuguagucccagcuacuuaggaggcugaggugggaggaucacuugagcucaggcauugaggacugcagugagcugugauugcaccacugcacuccagccugggugacagagugagacccuuucuuuaaaaaaaaaaaaaaaaaaaaaaaaaaaaacaggcugauuuuucuucaaaacacgugacacauggagcuagaacugcuguggaaacuccauggugccagcagcgcccaggccucuggccuccuccagugccauacuuggcauguggcuucuaaccucaagguugccacauggucauagaguaguuuuuggaacucaagccauuagaaccacauucgaggcaggaagaaggaaggaagggagaaaagccaacaggcaccucugucagaggaauguugcaugucagugcugccccugauggcacagcaaggaggauccagaagaaaguauuuggggcaggacugauuccggauaugggugaggauguguuaaaugugugucucuuucaggcaucuguggcucuugugcaaugaacaucaauggaggcaacacucuagcuugcacccgaaggauugacaccaaccucaauaaggucucaaaaaucuacccucuuccacacauguaugugauaaaggaucuuguucccgugaguuucugcaucucucugguuuuguuuuuauuugcauggggggcagugcuauguguguuacgcuauuaguuuuucagggcaggauuuguuugaguauuuaaggcuccucuucuagucagauaguaaauagaugggacuguuuccuauauuauggcaggaggaggaccacagugucacugagagauuaggaaaaucuccagaucugagacaguguggccagaguuuaauuaaagaauuugaauggcagaagauaaacgccuagaaaauccuccagcagcucauuuggugagguuuguuugagaauaauggggcacagaauuuuagaauuggaacauucccagaaaugaauaauuuggccauaacuacaaagaaaucauguggaaaaugccaguugggaaagcaacagcuguuuaugagucccacuuuaauuucuaccucccuauauuugaacaccuuugcugacgugguguuuucaagggcagaaaggacugugggauuggcagguuucccaaguaggugagggagagguuuccuaaccaugcuuaacauugugaccauuuuuccuuuuguaaucuuugcauauauucaugacaaaggaaaagagucuggcuucugccuggcauagaguggacgaguagucaguguccaagaaaugggguaaauaaagcugaggugaugauggaaucugauccuuuucuucuucuucuucuucuucuuccucuuaaccacaggauuugagcaacuucuaugcacaguacaaauccauugagccuuauuugaagaagaaggaugaaucucaggaaggcaagcagcaguaucugcaguccauagaagagcgugagaaacuggucauuagucccuauuuauuguuucaaucugaagaauuuauugcaaagaugauugccaggaguguggcuuggcagggaacauaagcugaugcaagccauuuaguguauucuggagaggaacuggcacaaggguggggcacucauccucuuagggccgggugaguagugugaacccgugaauggcccagaguggaccaaggagcuagagcccugugccccgccugcaggggcgggugguugcuguguggcuacuccaucuuuuucaaaagaaaccaguauguaaauugccugggcuuuaaaaagugaccacuaagucagaacuguucccucacugggggcaaaaugaaacacauaugcuggccaguuguaacuaccaccguccugcuuuacaaaugggagugaaauguuaauggcaaaacagagucaucgauauucuuuccugacaccauacuucuggugaucuguggggugggauuauuccuggccugcucacucucugggaguugccauuccuguguacaagcuguaaaaucuuaaagcggaggcaucauuaucaaguuuucagucuuucuucuucuacacuacuucuacuccucugcgaagaagucuucucugauuugcauacucccugcauacuuguggacgugagguaggaaggggaccaaauggagacagagccccaccugcaggucugcacagggccaagggcaauggcugugucuucuuccuuucuggaucccuaggcccuggcgcauguuauuuuauccauaaauauuaguuauguaaauacuguaaaaauauauauaaauuuuuuaaaaggccagaugcaguggugcauucugauagucccagcuacucaggaggcugagguaggaggaucaccugagcccaggaguuugagagucugagaguuugaggccagcccgggcaacauagcccagguuuugucucuaaaacauauacauauaugugaauauaugaaaaguaucaguuguaugaaugaauaaauuaauucuaccuuuugagacuugguaaauauuuagcauccucuccuguugcccauaaaacguuaagaaaggggaguccggccaggugcaguggcucaucuguaaucccagcacuuagggaggccgaggugggcggaucacuugaggucaguuguucgagaccagccuggccaacgugauaaaaccccaucuuuacugaaaauacaaaaauuagcugagugugguggcucacaccuauaaucccagcuacucaggaggccaaggcaggagaaucucuugaacccgggagguggagguuucagugagccaagguugugccacuguacuucagccugggcaacagagcaagacuccgucucaaagaaaaaaagaaaagagaaaaaggggaguccuaguaagugugcccagucugucaccaucaagauagugagggucagcacaguggccugcaagucagaguaagccugggaugagacuucagagcugcucuucucagacugcagcucugcuccucaguuucuaccucccagagucuugugcaucccagaguccaggcugaaccgggcccucuggcccagcgaguccuuugcauuccuaggcaaggcuggugcguagcuagugaacaucucccugaugugguauuauuagggauugaagaguuccccugagcauguuugguuuucuagauacaaguugaguauuccuuauccuaaaugcuuggguuucaguguuugggguuucauauguuuucagauuuuggaauauuugccuuacacuuacuaguugagcaccccaaauccgaaaucugaaauccaugcuccagugaacauuuccuuugagcagcauauuggugcucaaaaaguuucagauuuuggaacauuuuggauuucagauuuucagauuugggaugcccaaccuguaauagaaauuuacucauuuacucauuuacauaccaaacauuuaacauuuuuuggcuuccuuaaauuaguaugcugaacuuaauaaauaauuggaaaauguggagaaauuuauguauguauuuauuuuuaauugggcagcccccaaaccaaaauagguucagagaggcuccaucauuuuuuaaauaagcuauaauuuucagccuggggaacauagggcgacccugucucuacaaaaacuuuaaaacuuagccaggcauggugguaugcaccuauagucccagcuacucaggaggcugagaugggaggauugcuugagcacaagaguuccaggcugcagugaacugugauugugccacugcacuccagccaggggcacacagcaagacccugucucaaaaaaaaaaaaaaaaagaauuuauaauuccaccaccaaaacauaaucucuguuaauauuuauaguuuccuuuguuuuuuguuuauuacauuauauuuuuauguagcugggaucaaaauguaaauaugcuuuuauauccugcuuuuuucacuuauguuauugugagcauuuucuucauauucuuaaaauuguucauaagcauuaacuuacacuuugcuuucuacugcuucagauguaugcaccaugcgccauaaaaccauuucacuguugcuggacaaugaaauuguuuccaauuuuuuacuguuagaaauaaggcuagaugaacaucuuuauccuucaaguucugcccaaaacauucuaauuucuuauuacagauuuuucuaggaguggguuaaagaauaugacuauucuuaaggcucuuaauccugugaccuuaugccuucuagaccaguggggccaguugacacucccaccagcugucuggacauaacauagauuugguugaagacucaugguucaaucacaaccaucaguucugucucaucuguucucaacugucacuucaggugucagugggccccuuucauuuugcuguuuuuaauccauuucuguuguuuccaaacucagaaaguccgguuuguguuugggacuuguugggcagauugacccaguguggcaggugugaaagugcaggaagccagagccagcugccggggccacauccugguucugcugccuauaguggcacgucccugggcacauggccuaacucacucuccucgccuugguuccuuaccuguaaguggaacuugcuggagucaccucacaggauuacugugaugaucaguuaaggaaagcguguaaggcgcagggccuccgucaggauuggcaguggcagucacuggggaugauguugauguucccagugaaaaccugagggcccuucugcugagcccagggcagaagcagcuacagacucuugcugcuucagccccuaggcuuuugaaucucucccgucuugaccucauuccaggaagcuggaauuuaugggaguuguuuuuguguucuuguuuucuauuucuuuuuuagacaagugagagguucuuguuuauuaaagggaaagugcacuauacguggauuuaagaacccugggcagauguuuacauuucacuugcaagaucuuuauuaaucugcuaaauaucugcaaaucaccccuuggauuuugcuaagaaaauucacaugcaaguaggcacuuuguucaugcacugaccccaaagguaacauuuaaucagcugaagacauagcagagucucucccgucacaagcuccugccucucuuuucuccccauacaggacgggcucuacgagugcauucucugugccugcuguagcaccagcugccccagcuacugguggaacggagacaaauaucuggggccugcaguucuuaugcaggugaggugcuccuuaauugcuuuaagagaaauugaaacucaagcauccagaaguccaagaggacaauagauugcuguaagccagccauucugaggggccugguuuccuucauugccauccaguccaaacaggguaauugguugcauuguauucacuugcuuucgguaaaucuggggccuugucugcaaauugccuuuguuucagugcagugagggucaccccaaaggggugcaaaccaugccuugcagauguuuaaaauguauuuccguuugccugguggucagaggcucccccucucccucucauaggauuuguaacauaagacuuguagcgagcaagcaggggagaaagcagugucuuugaagggcagcugcccagcuaugagauuggaagcuguuucccagcuaaugaaagccuggauuuagggguugcuuagaaagaaaauaguauugauguucacugcaaagaaagucacugucuuuguucccagaaagcuugugcuuuuuuagauacgugcuuuucacagacucuaggcaacucaaaaaccaacuucucuuucucauuuucccacaaaaagagaaguuacagguuugugugaccacaugagcaauauugauucccagccaugugaagauuggauaaugaaguacacucauacuugucacuuuugccagcugcuccgaguuggggauguagagguccucuaaguaacacugcuagagcaggccuauggucaugugauuaacucguuucagccugcugaucucaggcugcugagagcgcuguguaaguucaaagaaucauuaagugggacaaauacuaucuguagacaggucuguuaaaucauuccuuuacucagagacagcaaguccagcauggguaggugccaugaagacagauaagaguuauaugauacagucccugccuucaccaaauuauaagcuggguaggaagcuauugagcaaugugaaauaauuaggagaugauacccaguguguauaauuaagcacccggguaccaggugcaguauggaucaaagguuugcagggaccauuaaucaagugaagcuacaaguguugggaaccuuuccuugaaagauggacaagaauuaaagaguauggagaugaggcaucuaagcugagugaauucccuuuccucugcacucccagagcuuugaguugagccagggugccgcucuggccuguugauuggcagcucagcuaaucaucccugguuuuccaggccuaucgcuggaugauugacuccagagaugacuucacagaggagcgccuggccaagcugcaggacccauucucucuauaccgcugccacaccaucaugaacugcacaaggaccuguccuaagguacguggggcuggugacccucagcucugccucagagcugacacgccagaaguagcaugugcucacaaagaggugauuggcagagagcaacccuagucauuugagaaggaaagggaccagcauaugccuguccuuucagugugagccuaggggcuaguuuggcucuuaguugcaaggaguagacugacucgggccaccucaggagcaggcuuuauuuguaggcuacacagggacauugugggaguuaaggaugcacaggaacccaugagcagguaccugcguucaaccuucccaggaaacagaaagcgaaagccguuggaacgugggcagcugugaggacuucauuucuucuccaucuuucucgcgaugucagcugcuaaucugcucugcucucuagcagccuguucuuuccuucggcucuguggagguuuucucugacucaaagcucuggcuuucguuccucuuccugcucgcauuugcugcugcuuuuggcucacucuggccuggauuuugccucccagcacacuuccagcuucagccacccgccugccucccagcacuucucagcacaguuuccugagagggugucgcauuggcccagcucaccuucucaugccugcacaucagaggccacagcuggcuacagaccggcugcccuuuggccagguucugucucagucuguuuugugguacuaucacagaauuucagacuggguaauuuuauaaagaaguuuauuugacgcacagcucuagaggcuggcgccagcaucuaacaagaaccuucgugcuguauuaccccauggcaaaaggcagaagggcaagagaaagggagcccaagcucagccuuuuuuuuuuuuggagacagaguuucgcucuuguugcccaggcuggagugcaauggcacgaucgaucucagcucaccacaaccuccgccucccagguucaagugauucuccugcauucgccucccgaguagcugggauuacaggcaggcaccacucaugccuggcuaauuuuguauuuuuaguagagauaggguuucucuauguuggucaggcuggucucgaacucccgaccucaggugauccacccaccuuggccucccaaagugcugggauuacaggcgugagccaccgcgaccggccccucucaucuguuuuuuuuaaaagacagggucucacuguguugcccaggcuggggugcaguggcgcaaucauagcucacugcagccuggaacugcuggccuuaagugauccuccuaccuccugaguagcugggacuacaggcacacaccaccacaccugacuaauccaaacucauccuuuuaucaggaacuuacuccuaugauaauggcaauccauuugugagggcagagccuucauaaucuaaucacuucuuaaaggucccaccucucaauacuguugcauuggggauuagguuuucaacacaugagcuuuuggggacacauucaaaccauagcaggugucagcccugguccagucagccuugcccagugggcagggaagggcuagggcugugugguucagaacacggcugcccuccgagcaaagacugugggugauuucacucaaaaguugcagugagucagugggcggcaagguggaaaacuguaggguggccaguuagccguaaaaaaagaucacacuguguguuugaaaacaugaaauccaagcuguagaauucacuuauuuuuugccuggaaacccucuguguuuccaguggccucgcugggggagcccacaggcuucagcucccuauugccugggcuuccaucuggguccuguccccaggacugugguuuaccaugauugugccugugaauagcuacugaccucugaggcaaguuaugcuauaaaagugcuuggaacagugccuggcacauaguaagcacccaauaaaugucaccuuauguuauuuuuuaaaaaaacaugaguacugggcuuguuugagacagagauagcaucuucagugguggggccuggcuguguguuucuucagaagcucugcgagugacucuaaggugcauuccuggucacaaaccugugcauggaggggaugggugcagcagacaacugagacagccaagaacagguucucugugccuugcccucccuucuguaaaacagggcuggaaguugggacugagacauagacauaggccgaucaugaaacuggaagggacuugaaaaccaucaaguuuaauccccuuauacagauggggaaauugagccccagguggggaggggagugacucgccccagaucacugucaggucagugggaagguaggacuagaguuaggccgucugccuccccauccagugcucuuucuuccugcauggauuggguauguaccaaccuucuaagucuaaacacccuuacugacccuguggggaccggaaauacacagguagauccagauucagaaggauauacagugaaaauucucccucccacuccacccagccaccucccuagaagucagauucuugugugaacuucagagguguuuuaugcugcacacaaaugcauauguguccucuucugucuuucuuauaucacauuuaucuguauuuuuucacccacuauauuuuggagauuaucccauguugguauaugaagagugucuuuuugaccagccuggacaacauagugagaucccaucucuacaaacaaaauuuuuuuuaauuagccaggugugguggcacgcaccuguaguuucaguuacuugagaggcugaggccggaggaucacuugagccagguguuccaggccacagugaacuaugaucacacuucagccuggaugacagagcaagacccugucaaaaaaauauauauuuuuucuuucucuucuucucucaagaucucuuuucuuucuuuccuuuucuucuuucuuuccacaacacuuuuuuagggggguagacuuauccuucuaaaaugaggggaaccuucacuaacgucagaugaguacuugucucauuuuaccaaguacuugcuugguaaaagcaaguacuugguaaaguacuuccuacuuucuacuucaaugaagcuggcauucaguggguuuaauuauugugccuccugcaaagcagauguuaacagcuguaggggcaaacugcagcuaauaccaaugguauuggccaguugaaaucaucaugguuuuacaaaggguuaauagagaggguaguuucuuccacauacuuuugagagcugguauaugcugauuucugcugcugccuauuuaauaaugaugauguaaaagauuuagagaugucuggcugauuuugacauuggccuguaguccuagaagagacacuacccugagugucuuugagcagucagagagugcaccucugcccugggccuguuuaccuguuagagugagccacacaagaaggaauucaacguggcagagcucuugccagagggagcugaccaucuucaaauguuaaaaaagguagacagaagagagcccuuagcccaaccccuaugguuuugagggacuugauuugcauucaccuugcuuggacacugaaccagcugaggaaggaguuucacccaagauuguggguuuucccuuucaguuucaguuaucauuuguuauugauucuuuucucuuuuuucaagggucugaauccagggaaagcuauugcagagaucaagaaaaugauggcaaccuauaaggagaagaaagcuucaguuuaacuguuuccaugcuaaacaugauuuauaaccagcucagagcugaacauaauuuauaucuaauuugaguuccuuuaaagaucuugguuuuccaugaauacagcauguauaauaaaaauuuuaagaaauaaauguuauucuacuuuauuaacaa

SEQ ID NO: 191429 - RNA, 32486 nt, Homo sapiens
uuguacacaaucauuuguuuuauuugaaaacaugucuacacugcauugagcaccaacacaggugugaccaagaaacccacaguccuguccccgcaggcacuggguccaguguaugacuugggguggacuguuauuuuucacagugaggggggaagaaaggauaggaaagaaaagauggccauuaucccaacuccuguucaggaaucugaacaaugaguuauuuaaacucauccagcucuucucauuccccuucucucaaucagcugguguucaaauauggaaucugaggccgagcgcaguggcacacgccuguaaucccagcacuuugggaggccgaggcgggcagaucacgaggucaagagauagagaucauccucgccgauacggugaaaccccaucucuacuaaaaauacaaaaauuggccggguguggugguaggaaccuguagucccagcuacucaggaggcugaggcaggagaauugcuuuuugacauccugacacauguauaauugccgggaggcagaguugcagacuacguuucacacacacacacaaaaaaaauggaaucugagcugguggggccagcuggauuugggaacacacagacacacuguuuaaaauaacauccagacaucauugcaaaaaaugggaggaaugggcugugcuuccgaaugauaguuuacuuuuuccuguuuuaugaaugcuuacaaauuuagaggauaccagaauugcacaaccgccaucaugacagagcaucugcucaguguaaaaacuuuguuuaggaaaaaaaaaaaaaaauccaauggauauaugggaagagaagugccaggcuggauggugcugagacagaaugaccccuugggcuccuuuauuuuguucuuuucaacaggaccccacagauauuugcgguaugucaugaggacuggggaugucuucuauuuuuaaaucagguauuuagucaagcugcuuuuaauauuaagacuguacaaauugauuuuuguucccuguaucuuuccucagaggcagaaagugaauguuauaaaacuggcagauuuuauuucucauaccagaggcucacacaggauuucuuucugcaugggggacaacuggcucuugguuucaaacacacuugagccucuagcaccauuaagcauccagcagcuuccucggcauccaggcugagauauccauauuccagaacaaagcagccaaugugaaggaugugcaucacugggaagagagaaggcugcccccuuagcccuggcuccucaucaucugagggaaguggagggggcaggugggagcaagcuuagagucaccaagucauggcuggagaaggauuuggguaaagcaacucuagaggcugccugguggccuacuugggagaaacaaagugccuuugagacuaucgacuuccugcuugugaucuaaaauggaugucuuugaaaugauuaaucuggaccagcuaaaggcaguuguucaccacguguuauccaaguuuagauuuccuaguugauuauucacaccagaucaggcuuuaaaagauagaccaaacuagaccagaauguguacauuucagcagaucagcaauugcaaaaugcuggugcuauuuacugacguagcacuggauccaaggacuccguggauauaaauauuuccagauuccucugcauuuuaacaauaacaagaauggucagacggagacacaugguuacagcauauaauaucgauccaaugguccaguguuaguuacaaaucaguuuauacaguuuugcuccauuuucuaugaauuuugucuuucaaauaaucuuuuauagaauguauauucaaaaacauguuugaacagcaaauguuuagaggagccaagucuggugaacggucuuuccuucgguuauuuuggcaagcggagaggucaccguggauucugagugggccaggcaaguguuccacgggucaucuucucccacgagcucagggacagggcacagagucagaaacggucuuuuuuuaagcacguuggcagcagggcguaacccuucagcucuuuagggccugugaaaauagagaagggugacggucgugucucuuacuggcauugugaauaguaacuccgugaguccuuuuuccuauuguccuuugcucuaaaucuuccaaguucugacaccuggugaucaucucuuguuccugacauuccuccuccaugccuucguccucacacagcagggucaaacugccuggcuuuuccaaacacgcuaaguccacagcuguguuguccccuguaucccucaacccuccagguguuuaucacuuguccucuccccucccuuccaucauauaucaucccuccaacucauauaagaaaaagguuuuuggcugggugcgguggcucaugccuguaaucacagcauuuugggaggcugagguggguggaucacgaggucaggagauugagaccauccuggccaacauggugaaacccuaucucuacuaaaaaauacaaaaaauuagccaggugugguggugcaugccuguagucccagcuacuugagaggcggaggcaggggaaucgcuugaaccugggagucagagguugcagugagccgagaucgcacuacuccauccagccuggugacagagcaagacugucucaaaaaaaaagaaaaagaaaaagaaagagaaagaaaaagguuuccucuggccaugaguguagauauucugaauucuuaaggaagcuuaauaaggagaaaaaacuccuucccuucaacaacagucaaagcuaggagucuaugaccacguaugugggugcacgcagggcaagagcggaagaucucaaugaaaaagaccccauccucaguggaacuccuaauccgaaugggcugccgacucugugacaggcgguuuucuagaagccuuuucucugaugguuggagacgggcugauuaggcaucagauuaaaacuugguuuggguuuucuuccaaguucaguuaguuggaaaauuaaaacaagagaucaaauguggucagaucucaacagaagucaacuuacaagccaccucuggcucugacucucuuauuuuggaaauuuauaaggucuaaguagacauuuguccuucuggggaaacuucagauguaguccuuuugaagaugaagaggcucuuucuuauuuuuaagagacacagucuugcucugucacccaggcuggagugcaguggcacaaucauagcucacugcagccucaaauuccugggcacaagugaaccuccugccucagccucucaaagcacugggauuccaggugugagccacugcacucaagaggcccaaguaaggaacuuuggaacaugaccauuguaccagagauuauuuuuuugagacagggucuuacuauguugcccaggcuggucugcaggugcccagcagcugagacuacaggcacgagccaccacacccagcuuauaucagagauuucuauuaguucaaagauuugaguucuagacacgauggcuuucauuugccuaucacauggguguaagcuauuuacuuacgaguaccuucccgacauuuuucgcauaaccacaacgaugauugcaccaaugaagccgauggcuaguaagaccccaacuaugauuccaaccagggucacuguugacaaaccaucugaacaagagagagaaaaaaagcaugagccccagaggaaaaaauacaucggugauaaaauauguaacauauaaacaaagccacugcccuacugcacauagcaaauauugcucuauguuguuugagcauggagcauuucuuccaaaaggagaaaauuugggcuagucuaauccuauuuuacaaaugggaagauuucugggucugaggaucuaucaacguaacauucacauuggcuuaaguguuaauuuuuggguaguguuuacguaugacuauuaaguuggccccuauuuucauccuuaguaaugaugaacugugauaugacaccauuccccauaucugacauuaagggaauagacucaucugagguuugcuuaguuucaaauacaagaaauucccuuuucucucuuuaaaaaaaaaaaaaaaaaaaaagcuugaaaucuguucucggaauguuuucuauucugcucucauugacugcaauccagaaaagaacgcaauucgucucaacaauuagcuucaaagaaauuuuuaaaaaaccccaguaagaguauuuugaugccaaaaucuagccuaccuuucucaacuguugucugugugucuccauccacuuucucugugaauagaaagauauaauaauguagaauuauuaggguuuaauaacuauaauuuaacaacuggcaaaagaugaauuuacccaaguggaaagcagcaaaacauaaaccaagaggauggcuucuuaaauaaauuggauccagggauuuuuaaacaagccccgauguggcacugucuuuguaacuauuauuaucuaauuuaugaacccuuauucacaccaauggguucauagcacuuuucuacguauuaauuuuauaguuuagaaagcagaguaaaggaaacugagccacaaagaucuuaaauaaaugaucaaggaguaucagagguuaagguagcagaagaauccagagcuguggauucuuaguccaaugucaagaucacagagaagggacagacugugaagagguauuacucacuuugagauuaauacuuuaguuugggaagaugugaccaagauugugguuagucucaauaucuauuuccugcuacuucuuugguagcaaaauccaaauuuuuacaaggcaacaauaggcccagcuaaguuucaugagcaaauauacccuuuguguuugugccacuguuauuuuagggucucuaucugcagucaaacccagucuaauaguuacaaggugaguauuugucauugugaguuucuuuugaauaauuuuaugcaauaaccuauuuaaaaauaaaaaugucuuuucuucuugaccucuuuauauaacgaguccuuaacuccucugggugguggcuauugacuaguuugcagauagagaaaaagucaagaugccuugauuuagaaguuaaucaucaaucaggcccugcccuaaaaucuuaguucacagcuugcaaaauaccccagauauccaguagcuucccuaaucagugguaaaacuagccaacuaucauguaaaagaugccuacuuuuucuaaugguuggguuugaaaaccaucccuuuugugccaagguucuccucagcacaaggcgccuccacaagauggccccaggguagaggucccagaaaccagcacucccugcacaagcugagcccauggguauagagcacguaagagcucaugcugacugugcuaccccaccauauaggacacggcuggauuugagcuuucccagaacaaagacgguaucaaaucaacuccccaaaugucacugauagaagucaacugcccgaagagauaagucaaucauuugcuuaucacguccuaccacguggcagcugauuccaggcucuuaauauaccauuaucaaagacaccauugguuagaaaauauauuacuaaaguuuguggaggauuuguuacuaaauuagagcuuauuagugccauauuucccaucucccucccaauggcacugugaucauaagcaugcaucauacaugugcacgucaucguauuuggguguuucacagcaaaaccgaacaucugcugcccuaauaaaauuaccccuucaaaacugagugcuuauaaugacauuuuggcucacaugugaaaaugucuuggaauaacgauguauuaaguaggaaugugcacucagucacaauuuuuuugugacaggaaggggcaauuuugugacaggguggggcaggggacaggaagaaacaguaacaugaguuacuucccaggcaacugagaauuuuuuuaaaggaacagaaaaugaguaugaaguaugacagaauauucaacauggauggcagaauuuucugcugcuaauuagcugucaacccacguuacaaaugagcaauucuccaaaauuuugaaauguuuuccaaugaucauuuauauugauuauucuuucuuugcuuagcucaacuuggcuuucucugguguuuaaauguuaaccauuucuuuaacagcuuggagugagcuucagguuuuaucucaaagcccuuuauaagguuccccccacuccccgccaacacugugguaaaacauacaggauaaaauguacuaaauuaaccauuuuuaaauguacaguucagugguauuaaguacauucacacuauuguucaaucaucaccaccauccaccuccugaaccccuuucaucuugcaaaacuggaacucuacccacuaaacaguaacuccucauucuccucuucccccagccccuggcaaaccaccacucuacuuuaugucucuaugaauuugacuauucaaggggccucauauaaguagagacaugcaguauuuuuuuuuguacugguuuauuucacuuugcauaauguccuuaaguuuccuccauguuguauuaugugucugcauuuucauuuucaaggcugaauaauauuccgucauauacacuacauuuugcuuaucuauccaacuauccauggccacuugaguuguuucuguauuuuagcuauugugaauaaugcugcuauaaacauggggguacaaaaaaaaagcuuguuuuuguuuguuuguuuguuuuuuuguuuuguuuuuuuuuuugagacggauucucgcacugucgcccagguuggagugcaguggcgucaucugggcucacuguaagcuccaccuccuggguucaggccauucuccugccucagccucccaaguagcugggacuacaggcgcccgccaccacucccggcugauuuuuaguauuuucaguagagacgggguuucaccguguuagccaggauggucuugaucuccugaccuugugauccgcccgccucagccucccaaagugcucggauuauaggcgugagccaccgcgccaggcggagaacagauucuugcaccaugcaugcagacaugaacucaagguaacgugcuaaguauucauauagaaucuauuaagauuuacagaggauggcugagugucgugcccuugggugucaacacaaaguucuucacgucacauucuauccacuuggaguccgccaugcaaucucaguagcuacuuaacucacccugugcagguguuaucacuaguuauucuagguagagagguacguucagcaacccacuaaaccaaauguaucaauugaaauagaauucugaaccuaccauauaaagcuugguucagaagucacucuugcaucccaauaugcccccuauugauuauucuauuuguugauggacuuuggaaugcaccaauuaugcaaaaguagaucagcccccauggagguggcugguuuucuuacccguggagugacugguggccacguuugaggcuguggcgcuuggacuuuguucuugcgcguggacugugcuuucugaaguuggcagauccucgaugcgaaugccuguuacacuguugacacuuguugccaccuauuguagguguaaaugaggaaaaacaggaaauaaagccuacugucuuuaaaauauauccccugccuuauaaaaggauuuaagguggcauaaaaauauggaacauaugauggcaugaauugcaaguagaagaaaaugaacagaacaauuagaucuugaagagacgguuguacacacauguucauagcagcauuauucacaacagccaaaagugguagcaacccaagcgucugcagacagaagaauggauacacaguauggucuauacaugcaacagaacguuauucagcuuuauuuuuuuauuuuuuguuuuuauuuuuuugagauggaguuucgcucuuguugcccaggcuggagugcaauggugcagucucguuucaccgcaagcuuugccuuccagguucaugcaauucuccuaccucagccucccgaguagcugggauuacaggcgcccgccaccacacccagcuaauuuucuauauuuaguagagaugggguuucuccauguuggucaggcuggccucgaacucccgaccucaggugaugccugccuuggccucccaaagugcuaggauuacaggcgugagccaccacacccagccuguucagcuuuaaaaaggaugaacauucugacacaugccauagcauggaugaaccuugaggacauuaugcuaagugaaauaaaccagucacaaaagacaaguacuauaugauuccacuuacaugaggugccuagaggagucaaauucauaagauagaaaguagaacaguggcugccaggggcugggggaagggaagaaugaguuauuguuucauggguauagaguuucaguuuuacaggaugaaaaguucuggagaucgguuuaaugaugugaauauacuuaacacuacugaauuguacacuuaaaaaugguugagaugauaaauuucauguuauuuuuuuaaccacaauaaaaaacauaugcuaaugagcaccuccuaugggcccagcaugguuccaagcccugggacuauaaugugaauaauauaaauucucugcucucuugaagcuggcauucuggggugggguagcagaauaugaacauuuaguagguaaauaaguacaaagggugguuugauaugauuuugagugcuuugaaagaaauacaagcuagccuugucuagacuagacuagacuagccuuaggaaaauuuauucuguaaagggccagauggguaaauauuucagcuguccaggccacacagucucuauucuaacuaaucaacucuacucuuacaguaggaaagcagccagacaauucucaacugaaugggcauugcuguguuccaauaaaacuucauuuacaaacacagugggcgggccaaaucugguggguaguuugcugaccuaagggcuagagggugacuucugauggaggugagggugagacuacuuuaggcuguuugagauggcaucaaccuugagaugcguaagaaaaaggcagccguucuguaauuuaccccucccgcuguaacgacucuucccgccaaaacugucuuucaaguuagccaaucgggcucaguuuaaauugugcuguccaacuccagccaauggacacaguaguagggacaaacugcauuaagaauaaaaaaacccuuucccgccuuuguucggugugcucuugugacaaccaguccugcgagaaacaaccuucuacagaaauaaauuggccuuggugaaaaaucuuuuguuuaaguguucguuuucucugcgacucugagcuuuacuuccaacagaugugggggugagauuacuuuaggcuguuugagauggcaucaaacuugagaauuauaaggaaaagucagccauggaaagaucugggcaguguucuaggcagagaaaaccaaagccuaaguuggaacaagcuuaguguguucaaaggucagaaaggccaagauggcagaaaaagagaaaguuaaggagaugcugguguacaggucagauaggcaggcaggaaccuccguucuguuaccaaagaaaucauagauucccucaaaggucgaggauguggcucauugaccuccucaaucccucccaaugccuggcaccuucucuugucuaugguagguauguaacacauaugaggaguuaauuaaaauucaucagguuaagaauguguuggucgagaggcuaaauagucuaucaucuuguggucuguggacugauucuaguccuguuuauuaccagucuauagugagaaaacaaauugagacugacugacuuauuuauuuauuuauuuuuugaggcggaguuucacucucguugcccaggcuggagugcaguggugcgaucucggcucacugcaaccuccaccucccggguucaagcuauucuccugucucagccucccgagcagcugggaucacaggugcacacagccacgcccagcuaauuuuuguauuuuuaauagagacaagguuucaucaucuuggucaggcugaucucgaacuccugaccucaggugauccaccugccucagccucccaaagugcugggauuacaggugugagccaccacgcccggcugagaagauauauuuagaacccuuuauagcaaugacauugccacaacacccaagaaaacuuucauuguauugaaaguugggcuguaacagauuggaaauguaaaauccuggcuccuuuuaccaauuugagaagcucuggcuucuacucuccaaccaccugugaucagcacaccagcuaaguggacgaaauugggaaagacaguaacuccucacuuaacguuguugauagauucuuggaaacugcgacuuuaaggaaaaugacaugcagcagguccucacauaauguugguucuuucuaagucauuuugcuucaagucacaguuuccaagaaccuaucaacaacauuaagugaggacuuauucuucuuuguugagccacguaacuauuccuugguaugguggcucaugcugauuuuauagauagauauauuuuuauauaaaguaaauuaauauacaucauagccuugcaugugaucacaugccuacggaaaaaauuccucucuucccaggacacugaccagaguugucaagccagacuuauagcggucuucgcugguuccuggagucaccacaucaucuucggcaccuggcauggcaacgccgccuuccaaaccuguagucucagugucaucuucuggcuggccugugcuggcugaagaagaaagauugagucagagcuuaagguggaaauugcauaagcagacccaacuugucggcuacauucggauuauuuucuuuuccauuucuuuuggaaauuuuuguuuuauuuuugguccuuuuuguggcuuacuguggugccagaaaccaaaccauucuccuugcagcacuucugacacaucaacacccugguuaucuccguugcaaagcaaaggaaaaugaaaacauuaaaagguagagcagccagccccucccuggggccccaucgagguggccuggacaggggacguacaucuuuccuuuucaauaaggaaccagauucuuccuggugucauuucauaugaugaauuaauauauucaucuggaccuaaaaacucuaaauuagagucaacaggaaagauuucuaaacacaccccuuugcagacccgaugcaaaagcggggucuccaucuuuuuauuuuuuuauuuuuuucucuaccuuuucaaauuaauuuuucuuaagagacaggcucucccucuguugcugaggcuagaguacagaggcacaaucauagcucacuauaaccucaaacuccugggcucaagcgauccucccgucucagucuccaaaguagcggggacuacaagugcucaccaccacacccaacuuccaucuuuuuaaaagcaaacucucucuccauuuaauuuuaagacugcuguucacuuggacaauuagaaccacaggcucugaccacagaccucguagauuacauggaguuuuaccucuuacuuuacaguugagauuacugucuacaggggagggucaguaauaugcuuagggaugccaagacaccaacagaacacuuaguacaccaagagccaaacuagcugggugcagugguucacgccuguaaucccaacacuuugagaggccaagguggguggaucauuugaggucaggaauuugaggucaggaauuugagaccagccuggccaacacggugaaacucugucucuacuaaaaauacaaaaauuagccuggugugguggugggcaccuauaauccuagcuacucaggaggcugaggcaggaaaauugcuugaauccaggaagcagggguuacaguaagcugagaucgcaucacugcacuccagccgaaacccaaucuccaaaaaaaaaagagccaaacuaaugaacugcccuuggcccuggcuuuuccgcauuaacauuuggacaaaugaugugucaugccaaugagaaagguuucugggccaggugugguggcucacgccuguaaccccagcacuuuaggaggccaaggcgggcggaucagaaggucaagagaucgagaccauccuggccaacguggugaaaucccaucucuacuaaaaauacaaaaauuagcugggcaugggguugcaugccuguagucccagcuacuugggaggcugaggcaggagaaucgcuugaacaugggagguggggguugcagugagccaagaucacaccacugcacuccaaccuggugacagagcaggacuccgucucaaagaaaaaaaaagguuucugcuggagcagggaauuggaguggacuaccaggcugaauucuacaaugagagauagagcagauaacagcaguauccucuucuucaacuucuguugcagugacccaaacuagucaugaccaugcucaauuaucaucuccaaaaaucaccaaacaacccucuuugugcauuaaaaaugugacucacuggccaugggcuucuucccuaaacuccagugguucuggaaauuccaugacuaaauacaguugcaaaauaaacaagcauacacaucccaggagcgagggggagggaggugcuuggaaauuucuuuguguaaugaaagagcagauguuuguuugucucuaggcagcacuuacauuagcaauccauuccuugccuuaagauaccuuauucuccccacugcuuagacagcacuuauaucagcaauccauuccuugccuuaagauaccuuauucuccccacugcuuagacagcccagccagaggcacagcuaauaaauauuugauuauagcuucuuugaugccuagaggaagccucugaaguuaguucacuuguucuaugagccugcucuuuuauucuagaguccuaauccaguagagauggcuuuggaugagcuaccuacacauuuuuuuaaucuggggguguacagcgagggguuuaccaguuagcaauaaccgaauauuuccaugcaugcaaaugguuugccucuccauguggccuuuugcuggaguagggguagaggugaggguuggugauuggcuccuacaaaaauguaugacuugugguguaggcaaacgcuuacuguguauuuauugagcucaaugggaaauaucccuuugccagacaaguaguccuuauuaaaaaacuuacuaagcuucccauuuuauuucuuccucaccugguuugaacuuaguuaacaaaucaucaauuuuaaaaacguuuucuggagcgguuuaguacaaucacuuacuuauuugguguaucuaacuuaaaacaauccuugcuuuaaaaaaaaaaaaucaagugcucaaugaaauuagauugaauucuuucauagaaagcucaguucauugaaagcguaacuuuauaaaaauuccuucuuguucuuuucuacccuuggcccacagagccaaguacuaaaaucgcucugaauggacaaaaggcguuuuaugaaugauagucaggauuaagaugcaugucuuuugucucaccgcccuagcauucuuuuugcuccaugggaaagcugaacuuuaacaagagauccccaauugucccucuuaguaucuuggcugaaggauucccugggugaagaguuccuacuaggccagcugccgaguuuccagccagcaucucaugucuuuuccccuuccuccugaaauucaaaucauggaugccuucacuuuccaauccucuuuuccccaagacauauguaugcacaggcauacauaugcacgcacacacgcauacacacacacauacagggaugcacauaugugcagacacacaauuguuucuacaaguguagagugacgaauuugccaucauaaaccaauacccacaaccuagcuugcagguucaguucuggagugguguaccagcgugcucacauaaacacccuuuccugccacacccagccucagccaaacacggcucaguggaaguuuccaaaugcggcagcaaacgauccacuuacuuugaaauuuguuguuguugugauuauuuuaaaaaagcuaggcagggcugggcgcgguggcucacaccuauaaucccagcacuuugggagguggagguggguggaucacgaggucaggaguucaagaccagccuggccaagauggugaaaccccgucucuacuaaaaauacaaaaauuagccuggcacaguggcaggugccuguaaccccaacuacucgggaggcugaggcaggagaaucacuugaacucggggggcggagguugcagggagcugagaucaugccacugcacuccagccugaguggcaaagugagacucugucuuaaaaaaaaaaaaaaagcuaggcugaaguuucuauuuccuaggagaagaugauuugauaaaucaacugucacuugggguucuuaauuuuugagaacaaauaaacguaagcaaugcuuauuuauaugaaaucacuaacuaugaauaacuuuuaucuuugcauucaugucuaauaacucgcuagauugcacacauuacaggauggcauuucuuuugucuuuucuuugagauggaguuucacucuugucacccaggcuggagugcaaugguacaauuucggcucacuacaaccuccgccuccuggguucaagcgauucuccugucucagccucccaaguagcugggauuacaggugugcaccaccacgcccagcuaauuuuuauauuuuuaguagagauggcauuucaccauguuggccaggcuagucucgaacuccugaccucaggugauccgccugccuuggccucccaaagugggcauuucuuuuuuaaacagaauuucuuucuuucuaucucucucuguuuuuuucucucucucuccuuuguauuuauagagaugacaucucauuuuauuuuuauauauauauauauauuuguagagacaaggucucacuacauugcccaggcugcucuuaaacuccuggguucaagcaguccucccaccucagccuugcaaagugcugggaucacaggcaugagccacugugcccagccugccauuucuuuaaaaauacuuuagaguuggccaggcacgguggcucacgccuguaaucccagcacuuucggaggcugagacggguggaucaccugagucaggaguucaagaucagccuggccaacauggugagaccccgucucuacugaaaauacaaaaaaaaaaauuagccaggcaugguggugcacaccuguaaucccagcuacuggggaggcugaggcgggagaaucacuugaacccaggaggcagagauugcagugagccgagacugaaccauugcacuccagccugggagacaaaaaaaagaaguacuuuugaguuuagauguaacauucaaucaggcuguuauuguaauaguccaaauucuuaauaaaaaucuuuuaaauaagugauuucagucuucugguuuuauuuacacuucuuugauuuguggagcgaguuguuucauccauuugucuucuuuugugaccguuuuuguaauggucacauggcauucccucuuauaagcacuguucauaccuuaagaauguauucuuuggccuaaaugcugcuggcauuuuuuuuuuuugagacggagucuugcucugucgcccaggcuggaguacaguggcacgaucucggcucacggcaagcucugccuccugggcucacgccauucuccugccucagccucccaaguagcugggacuacaggugcccaccaccacacccggcuaauuuuuuuguauuuuuuaguagagacaggguuucaccauguuagccaggauggucucaaucuccugaccuugugauccacccgccucggccucccgaagugcugagccacccaaagugcugagccacccaaaggcaugagccacccaaaggcaugagccacccaaaggcaugagccacccaaaggcaugagccacccaaaggcaugagccaccgcacccggccuacaucuuucuuuugcaaaugaccaagcuaucaguagucaaacuucuuaaacuuguuuucucuuugacaucacacucacaaacucuuccucaagaucacauaaauauucaccuauguuuuccuuaugguauuguacuuacguuuaauauuuuugucuguuuauuuugaaguauuauaauaaaagagaaauauaauuuccccccaaaagauuagccaaucacccugauaaauccucuuuuccccacugcuucaaaaccagcugucauugagacaaaucuuuucuuuccaauacuaugucauggcugggugcaguggcucaggccuguaaucccagcacuuugguaggccaaggcaggcagaucaccugaggccaggaguuugagaccauccugaccaacauggcaaaaugcugucccuacuaaaaauacaaaaauuaaguaggcaggauagcacaugccugcagucccagcuacucaggaggcugaggcaggagaaucguuugaacccaggaggcagacguugcagggagccaagauugugccacugcacugcagccugggugacagagcaagacauggucccaaaacaaacaaauacuaugucacaguuacaggagaaacuuagcacaaggcccagcuuaaguggccuggacacugccaacuauccccacuccacaugggcccucugucugcagagucuccagaagcuguuucuaaauccgugcucucuucacuguaagcucccucuuccuccucacaucagcugacagcugcugaguuaaaucagugaccagggaguagcuagaauaaaacucaguguuuagggcaaggaggaaaaguaaguauucaaacaggugcauuuggggucguucaagaucuggcacugacgcagcauuguaaauuccacuuaacguggaagacaccucauuguccuaacacccucucacauuugcuacucacaauguaggguuuacauggcgucucccagcugacuuuauuucacaacagcgcugugguggcuaggcccuuagccugccuucacaaagaaucuuguuaggccaguuuagcaagaguccccccaaccccaucucuuaggaauuuuccacccacugauccccucauucugcuugugggcuacaaauccccacuuuuccuuucacccagaggugaaccugagcucuccucccuacugcaaugccccuuauuacaggggucuugacuaaagucuuccguacaauuucaacaagugucagaauuaguguuucuuuaacaaggucggaaguuaagugauguggcccaacgcgguggcucacgucuauaaucccagcacuuugggaggccaaggcagguggaugaccugaggucgggaguucaagaccagccuggccaacguggugaaacaccuucucuacuaaaaguacaaaaauuagcuggccaugguggcgcaggccuguagucccagcuacuugggaggcugaggcaggagaaucgcuugaaccgaggcagaggcuguagugagcugagauugugccauugcacuccagccugggugacaagagugaaucuccaucucaaaaaaaaaaaaagaguuaagugaugugccaaguucaugauucauuagcggacacaaagccaaauauucuaaccgcaucccuggacucaccaacauacaacuaaaaagcagcugugcauuuucgugaugugcucucccggcagcuuugggcuaaaaugccugcugccucccucccuggguucugagauccuuccccuucugcccaggugccauccucaucuucccagaaaucacguuccugguagucaggaacaauugcuuccccugguaccucacugccucuuaugaaaucccaucuuguuagaaucuuccagucuuauuuaaugaccacagucuugaccuccuccaguguguccccuuacuaggagaaaucuggacgaaucuaaacuuucagcaauggcagguuagaaggaagguaugacucacucuaaaggagguguugcuuugagcagcagcagcccucuccccgcuuaacugugcaaguuaaggcagcagcaaaaaccaagacugaagccugcaugaguucaccucuacagccccagcucccagcauuuauauuccuuccacaaauauuuaccaagcaccugccaagagcugggccacauucucaucacuagagacagagaagugaauagguaaggaagaucuccacucuuaaggacuagaguacucuuggagugggguggggucaccauaaaaaaauaagcaacacaucagauaagcuauuaaucccagcacuuugggaggccaagguagacggaucacuugaggucgggaguuugaacccagccuagccaacauggugaaaccgucucuacuaaaaauacaaacauuagccaggcgugauggugggccucuguaaucccagcuacucaggaggcugaggcacaagaaucacuugaacccaggagguggagguugcagugagcugagauugcgccacugcacuucagccugggugacagagcaaggcucugucugaaaaaaaaaaaaaaaaaaaaaaaaaaaaaagauagcuucucgaacacaucaagauagcuucccucaugccuucagaucucagggaacuuucuggccgggcaugguggcuuacgccuguaaucccaccagcacuuugggaggcugaugcagguggaucacacggucaggagaucgagaccauccuggccaacauggugaaaacucgucucuacuaaaauacaaaaaauuagccaggcgugguggugcacaccuguagucccagcuacucaggaggcagaggcaggggaaucccuugaacccuggaggcggagguugcagugagccaagauugcgccacuacacuccaggcuagugacagagcgagacuccaucuccaaaaaaaaaaaaaaaaaggagggggggcacuuucuuggacuguccauuuaagcgaguaccccuccccucuuccacggcacauauaccugaaugcuuacccccacccugcuaccugcucgcuacuugucuguccuacuggaauauaagcuugauaaaggcugccucaucucaauguccacaaugucugaaaucccuggcacauaccaggcacucgguaaguagcuguugagugaaugggugaguuccagauaggggaacagcuggugcuaacuaaccccaaagcccagaacgagcauggggcgcugcacgggagggaggauggucaguguggccagguggaggggcugaggaggacagagauggggcugagagguguggagcggugguucgguagaacuguuuuaaggaugggguuucaguugcauuuggcgugugaagggaagccaggagauguugaggaggggaugaccucaguugagucccagaggccacucuaagucaaguaagugaauaguguguguguaucagggaaggugccaggaucaggcugaagcagggagaagcuuagauucuuucuguuaucuaagaaagacaguggagagggguuggugcuuauaccaggaccuuggcagugaggagggauaagaacuggacaggugauggcuggggagcauuugaagucauuacccacugaggaucagaaauaaaugcgggacaggcaugguggcucacaccuauaaucccagugcuuagggaggccgaggagggcagaucaccugaggugagggguuagcgaccagucuggccaacauggcaaaauccuuucccuacuaaaaacacaaaaaauuagccaggcgugguggcuugugccuguaaucccagcuacuugggaggcugagacacgagaaucgcuugaaccugggagguagaaguugcagugagccgagauagugccacgcacuccagccugaguaacagagugagacgaaagaaaagaaaggaaagagaaagaaaaaaaagaaaagaaaugcuaacccaguagaauccuuuuuuugagacagggucucccucugucacccaggcuggagugcaguggcacaaucuuggcucacugcagccucgauuuuccaggcucaagugauccucccaccuuagccucucgaguagcugggacuauaagugcguaccaccaugccuggcuaauuggguuuauuuuuuuguagaccacagggucucacuauguuguccaggcuggucucaaacuccugggcucaagcgacucuuccaccuuggccucccaaagugagaauucauuuuaccaccuguuacagcucuacugacaaacaacauuuagaguagaaacagaucuacugaacaaagaaggcugccccuuugcgaugcugagucuagauggggacuuccucucguuaaguccucuacauaaaauuuagcuaaagagcuccugugcuguuuccaucuugacgugagugagaaguuucuuccacuccuauuucugcagaccugcagcucccuaaucugaacgcuggagaagccguuucuacagcauuuuaucuugaacuggugaugcugauuuuuaaaguaaacaagauacaagcugaguuacccucgggauuuucaaaggaaacccaggguauuagucaacagauuaaaagggucuuucacguugcucaguguuuuguagcaucuugcgcugcccuagugucuaaaugugcaaauaaaugucuuuguagauggaugacgaaaugguguuggaaugacuuguggcuauugagaagcagaauauuuuuaaaauucauauucugggaagcucugguuuuccccuauagaacaaacucuaggauaacuauuaauuaauucuagcaccuccccaauuacauuugagauaaaguuaugcuuuugaagagauguuaaaaugucuauuugaaaacaaaaacaccgacuucuguuccuuugcccaaacacaggcuuuuguauauuauuuuucuaucacgucucaaaacugagcccagaagccugaaaauaaacacaccccgaacaguagaaaggugccaaccuccaacauuuuccagcacucugccggccacccacugcagucacugaggugcucauaucucucuacaguccuucagcucaguucaaaaaugucccaaacuuagcuguuugcuguugcuucccucagucaaccugaaguggguuccggcaaucaggagaaaggcauuagaauuuucccucuauuagcuguaccuuuugaguugucccuuguguccuguagcccggcccaucuccugaccuauuguugaaggcuuccuuuggaauaucgauguuuugcuuacagccacaccacucugaacacgccugaccucgucugaauauugaugcaaccacuaaccucugaagucccaaagcuccuuuacacgaagaaagccacucccuaacccagagcugugugcccucaacuucaagcagccacuggucgugaucgacauaaucacugauguggccagugaacuuuuuucccccuucaccccuuccauggagucugguaaauugcuuacuggaccaaaaguuuggcccuggaaaaucuagagaacugugaauuaaucuaggcuuuggccugccugccacucuguacccacagacauguccccucacugaauuuuccuccaggcguacauagcgcuaacugaaguccacacugccccauagauuccuagagucuggcaccaugguagguauuuagcagaugccucuugagugacagcuaaguacauuuauacauucagguagaacuuuuuuuuuuuuuuuuuuugagacggagucuugcucugucacccaggcuagagugcaguggugcaaucuuggcucauugcaaccuccgccuccuggguucaagcgauucucccaucucagccucucaaguagcugggauuacaggcaccugccaccauguccagcuaauuuuuuguauuuuuaguagagacgggauuucaucauguugaccaggcugcucucaaacuccugaccucaggugaucugcccgccucagccucccaaaguccugggauuacaguugugagccacugcacccggccggaacacuucuuuaaaauuaucuucuguauuuaugaugucccugccgcuguccaccaggcuucacccccgaguuguuaaacgccuuccccuguaaugaaagagacggcauagcugaagauagcacggcaccugcaaaggggaacuuggcugcccugccguucaauuucgugugagcagcgccaugcccauucacuguggcagguccugucaaccccugugggaugagaccaaugacgagaugagaccugacugugugcuaacggcacugggggcgugugacucuucuguaaaauguaagagaaacaugucaaagcugaggagaucagacacgugucacuaguuccucuggagaaaucaggagaaauccagcacgugaagaugugaaaccgcuuucccugacuacaaacugggaggcagucugcacaguacccccugccccagaguuugcuuuggggucuugggggugggggggagguguccccucugggucaccucccaaaguugagggcagcacuuugaggguuucugcagcugaacugggcaaugaagaagaggggccaaugagagcgacuccauuuuccuuucaauagcaaggagucacauuaagucacuagacaaauugaauauugauguuuugcucacagccacaccaucaggaagggacaggauauaagauccuuaugacauaauacagguaugacauuaucucucaaucagaucuauccucucuccccuuuuaagagggaaagaacugaaaucucauguguaucuuucacagaucuuugcauuuaaccucuaagacaauccacgagguguuuuaauaacaagugcuauuugcuggauuuaugggagaaugugcaaacuguggcgucaggugcaugcucucguuuuuuuuuucuuucuuucuuuuuuuuuuuuuugagaaggagucucgcucugucgcccaggcuggagugcaguggcgcaaucucagcucacugcaagcucugccucccagguucacgccauucucccgccucagccucccgaguagcugggacuacaggugcccgccaccacacccggcuaauuuuuuuuuuuuuuuguauuuuuaguagagacgggauuucaccguguuagccaggguggucucgaucuccugaccuggugauccgcccaccucggccucccaaagugcugggauuagaggcguaagccaccguacccagcagcucucuuguucuuuacagaagucuugcaaacuaguaucauccucauuuuuuagcugacaauggugaggcuaagagguuaagucaacugcccaugaaaugagcaagugccagugcauggauuagacauugccaucuauucagacucucaaacccaugcucccaaccacugugucuucacaggcacugaauacucuugaccagcucccuguuauauuccucucuacuucuaaagaaaggucuggaguagacugagcugcccuagaugguggcuucuguagauuauugaggaggggcugccaagggcaccugcagguucaccuuuuagcucaaucagugcccuuccaaaccccaccucuccuucauugcccagguaaaauccccuucccuucagcgcucuuccaaguugccaggagaaaguaaucuccucuaaacuaguauagaauuugauaacauuuuggcauuuacuaccuccuccccaccagcaucuacaaguuccuugaggguaaggccccauucugcuguaaguuuauggcccagccacuagcacagucucugcugccugaaugaauggaugaaugacauucacaguuuucagaguucaugggagugaaucaacacacucaucaagcacaaacauggcucagaacugcucaguguucacauuagaggcugcugauuacaaccucaaccaagauuacucaacauggggagacguuuuucucuugaccaaagcagaacauucucaguccaagaggaaaugaguucacaguuuuguagacugaaaucacagcucuguaauaaacuuuucuggaacucagcuagggcuggugucacgaacauuccccuucuagggagggccacuuaguaccaaaugacaaaaaccugcuuuagaagugcuguccuggagcagagcuucucaaugggguguguuugggaagcacuugccgucugcucggaaacugaauggaaaucugagcugauucacucauggcugucagcugagcaugcccugauuuugcaagagggagaaaagaagccccuuugcaucugaccucaccguccaccccacgcagcucagacagcccagcugugagcccaggaggaugaggccugcaggaaugugcagaauguggccguuuccacuagcgucccuuggccucaaucucaagccugguuucggaccucgaagugugcuuugguagauuuuuagaaaauaguuguuuuuggcuaagaggaucucuucuguucuucccuugccauuuuucucccuuuguucuaauguaggggaaauucaagcagcaaacuucaucuccagugcuuagcucuggcacucuuuuagaugacugucuucccagguacucaucagaucaucaaauugggugucuuacuauuuaccucaaacucaucauaucuaaagccgggcguauaaauaccuuuuccuuaccaaguugguuccuaaucucucaucccuccuaccugauuuuuaugcuuuuauuaucugcuuucugucauuccuaugugucuaucguguuuccucccucuucuuccugccaaauguuuacuauguaccuaccucgugcucuuuuaagugcucucuucucuaagagacaaguuauguacacaaauaauuaaaauacagacaggagaaucaccaaagcaaucuugguaaaaacaaaguagacucauacuuccauuucaaaacuuacuacaaagcugcaguaaucaagacggugcuacugguaggaggauagacauauagaucaauuuaauccagaauuaaaccuauacauuuauggguaauugauuuuugacagaggugccaagauucuucagcgaagaaagaaucaucuuuuuggccaggcgcgguggcucacgccuguaaucccagcacuuugggaggcagaggcggacgaaucaccugaggucgggaguuugagaccagccugaccaacauggagaaaccacgacucuacuaaaaaauacaaaaauuagccgggugugguggugcaugccuguaaucccagcuacucggaggcugaggcaggagaaucacuugaacccgggaagcggagguugcggugagccaagaucgugccauugcacuccagccuggguaacaagagcaaaacucugucucaaaaaaaaaaaaaaaaaaaaaaaucaucuuuucaacaaaugguaccuugaccacuggauacccacaugcaaaagaauggaguugggccucuacuucauagcccacacaaaaaugaacucuaaaugaaucaaagacccaaauaucagagcuaaaacuguaagaguaaaucgcuguaagcuuggacuaggcaacagcuuccuagaugacgccaacaguacaagcaacaaaacacagauacauuuaacuuuaccaaaauuuuaaacgcuauucaaugguugcuaucaagaaauugaaaagacaacccaguccaaaggaugggagaaaagucugcaauucauauauuuaagggucuaauaucuagaauauauaaaggaggcuuucaaucaacaauauaaaguuagcaaaggauuuaacucaacuuuagugagcaaaggauuuaaacaaacauaucuccaaagauacacaauuggcgaagaagugcauaaaaagaugcucagcaucacuaaucauuaggaaaaugcaaauugaaacuaccagaugucauuucauacccauuagaauggcuacaacguaaacacacacacagagaaagagaacaaguguugguggggauguggagaaaccagaacagcauguauugcugguggaacuguaaauggugcagccacuuuggaaaacagaauggcaguuccucaaaaaguuaaacaaacuuggugugguggcauacgccuguagucccagcuauuugggaggcugaagcaggaggauggcuucggcccaggaaucugaggcugucgugagcuaugacugugcuacugcuauucagccugggugacagaggaagaccucaucucuaaaaaauuuuuuuuaaaagaacgaaauucuggugcaugcuauaacauggaugaaccucguaagcaucaugcuaaguaaaugaagccaggcacaaaaggccacauauugugugauuccagugauaagaaauauccagaauaagcaaauccauagagacagaaaguagaucgauggcggucagggucuagggggaggaggaaaugggaaugacugcugacaguuuggggcucuuggggaaggggcgugaugaaaauguucuaaaauugauaguggugauggucgcauaacucugugauuuuacugaagaccacugaauuguuugcuuuaaauggguuaauuuuaugguaugugaauuacauaucaauuuaaacgugugaauauagucaugagugcuguaagaggugacuaguaacaagucaagaaaugcugaacuguuaagucuugcuggcuuuuauuccuagaaauuuggucucgcugcacaugguggcucacgccuguaaucccagaacuuugggaggcugaggugggcggaucacgaggucaggaguucgagaccauccugaccaacaugaugaaaccccgucucuauugaaaauacaaagauuagccaggcgugguggcacgugccuguaaucccagcuacucaggagacggaggcaggagaaucgcuugaacccgggaggcagagguugcagugagccaagaucgcgccauugcacuccagccugggcaacagagcgagacuccaucugaaaaaaaaagaaaagaaauuuggucucauucucgcuuucuguugucaccacauuuugucucuuuaccuccugaccacccccacccgccccuccaccgcaccugccccuagacuggucccacaaacuagauucaaucuccuauggcuccuucuucauuaucuucugacaaccagcauucaugggccacucccauucucuauuucugccuacagaaaaaggucccgccucuuccacucagcacggacucaucugucuccccaguuuccugccauugcccaacucaacccuucuaacccccagccuccacaacucuugccagcccucaaugcccacgccuauucccacaaaaagcccggacugaucuaauuuccaugcauuuguucaagccauuucuucugccuagaccaacugucccugccaccugcuccaaccaaccccaccauuuuucacagccaagauaaagucgcaucuuccccacaaggcuuuuucuagcuccucccaaccccaagauucucucuuaucucuaaaucccuagcaacagacaauaauagcaugugccgcgcaggacacgacuuuaucuguugcuuguauguucuuucuacauguguagaaaacacgcaccugucuugccucucuuugcaagcuacaaucacagcauaugcuuccucucuaacuuaaugugugugcucuguaaaugcuuaaggggacagggacagcauccuucgauucaguacucccagcacuggggauacacaucaucagcauuauguaugcaaccaacaaaguuaauacaagcuggaaagaaaucauguauguaaaaauaacaaaugguggcagggagcgguggcuuacgccuguaauuccagcacuugggagggcugaggcggguggaucacuugaggucaggaguucaagaacagccuggccaacauggugaaaccccaucucuaccaaacguagaaaaauuagccaggcgugguggcacaugccuguaaucccagcuacuagggaggcugaggcaggagaaugguuggaaccugggggucggagguugcggugagcugggaucgcaccacugcacuccagccugggcgacagagcaagacuccaucucaaucgaucaaucaaucaaucaaucaauacaagugguuugcugccguaagguaagaaguacuugaaggaaucaaccucucgcuuuucuggguguccucaguggcacggauucaagcuauuccaagcauagcugauuguguagcuaagugguuaggggugugggcucuaggguugagcagccuggguucagucucacugcugccauuuacaagcuccgugucugugugugggcuacugaaccucacugagucucuuaauuccucuauaaaauacaagaagcuccagccgaguagucuguugugaggacugaaagaaacagggcuuagaaagggguucacacacgcuaagcacucaguaaacgcuagcuguuauuauauuguuagcgcuauuaacaccagccauucagaaucuagauccuguagcuuuacagauucacauuuaaucuuauggggagauuuggcucagaacaaacuguuucccauuagccaagcucacaagaggccagaaaaccaaauaguuuauuuagaacaggaaacuguuuuccaacgcuuuguaugcauauuugcuguccaaggcaugcccuucucaggggugagauaccccacaagaugcuauuuuuuguauuuacaacaaaagcaaaggguggagcugucggguggaauaaauuuccagacugugacaaaacaaagacaucugauucaucacagaaccaccuugauugagaucagaauauccccagucaccacauaugacaccuuuccuacuaacgguaagcagggaugggguuugccuuguuccccacugccugacuuacacaguagcuauucaauaaauagcuguucaauaaauauuuauugaauaguagcuauucaaugaauuguuggccggguaugguggcucacaccuguaaucccagcccucugggaggccaaggcaggcucaggaguucgagaccagccugggcaacauggugaaacuccaucucuacuaaaaauacaaaaacaguugggugugguggugcacaccuguggucccagauacucaggaggcugaggugggaggaucgcuugagccugggaggucaaugcuacagugagacgagauagugcuacuggacuccagccugggugacagagugagacccugucucaaaaaaauacauauauuauauauauauuuuauauauauguaaauauauaauauauaguuauauauuuauauuauauauuauauauguaaauauauaauauauaguuauauauuuauauuauauauaauaaaaauauuuguuaaaucaguuaauucuuugggcagggaagguuuaaacaucaacaaauucucauucuucuccucuucuaggcaaacugauucccuucucuuuggggcaggacaauauucgcuguaucacagcuuuuuaaaugaguuguguucuguucucccggauggagacacccugaugaauugugggaagugcccuguucucaucaauaauauguuaaaaauauucuagcaugccccuuuccugcuucccauuuacacucuguguaucuggcauuuguacaugcugcaaacauuaacaauggugauuguuaccccaguggcucaggguuggucucccucuauugccuacggcacuuuguggccuggccucucuggaugggggucaagagcccaucacaucuuucuccagggguguguguguguguguauguguguuugggggggcggguucaugaaauuuagcauugccucacaaugucagcuuucagcuccucaaaaaacuacaugaacgaguuggccauaccugcguacuucccccuggacuuagcuugauucacuucaaaggacaaauccaucucugagcaauucucaaggcaaagacacucagccagacaaaaaggagggugagcccuccuaccucuuucggcugacacucaggggagcuugccaucaucugacuggcugccaacaggccgguggacaggggcugggguuagacaugugggaaggaaacagucaccuuguuuuccugccuuggauggaauuggcagaauuccaguuauucccuaccggggcucuagcucacagccccagauaaaaugccuaaucacggagcuguaucucuugcccagcaaaugagaauccuaagacucaucacaguaacuguccacuuggaaguguccagcacccuccaucaguugauucucuucaauaaaacgugcacacuggguacuucccugagaaguuuuggggcaccaagaguggcaaggcuuccuggaaaagcccuacagcaucugauucagauucgucaaauaaauuucaccaggguaauccugaguaguugaguucucucucccuccuccuccuccucccccgucguauuuccacaaguuauaaccuggccugccuccuuuccaaagccagaaauaugacaaauauucagauaagccgauggaauuugaaagugcauguucauugcuuugcuggugaggacugcagggcacacuuuagcaugugaggugugccucucucaaaagugcauacaguucaaauucugcaucuaguaacacaccaagaacucaggaaaugcuuaauaacuauuugcagaaugaauuaauaaauccuauuuuaauguauuaugacaauuucauucuuaaaagaacauuauggggagcauuuaauguaaaggaauucucguaucuuuagaaaauuuuguuucuacguuuaagaggcuuaaagugagguuaaccuuuaauuucaaguucaaccucuuuacuuuguuuuuauauauauuuuugagacggagucucgcucuguugccaggcuggagugcuguggugugaucuugguucacugcaacugccgccucacgaguucaagcgauucuuccgccucagccuccaaguaacuaggacuacaggcgcgcaccaccaugcccaacuaauuuuuguauuuuuaguagagacgggguuucaccauauuggccaggcuggucucgaacuccugacuucaugauccgcccgccucggccccucacaggcgugagccaccaugcccagccucuuuuuuuuuuuuuuuuuuuuaauggcagaguaguguaguaaaaagaucuucagguuugaaguuagacauauuuuucaaacccaguucugguauauuccgagauaagaguauguaauuuacagguauuaugaugauugaaagaaguagcuagcaauauuccuagcacauggcaggcgaugggaaugagaggaugguuguguccuuuggccugacccuccacugucuugccaaggcuugagguccuuauaauucuacaguguagagucacucgcgugcugcucauuuuacagaagccaaagaaaggaaggaguuuagucccuuuggccacguccagacuuagccuucucaugcccggacacauuuuuuaaauugugcuuuucuauauucaaugcuauuuuggaucuuauacaccagugcaaugcagaggccucccucacaaagccucuaacagaccugaucuuuauuaagugccuucagugcaacaaaaacucuuaacaacucaugaggauuucagggccuccaaacuggcaagcguuucggggaaaucacagggaaauuuguuggccgcaugauuaauccuggguggauuggucccggaaaagcacauguggguuagcagcgagcagcagcuugcagaaucucacaaaauaaacucucuaaugaaguggcccccaaaacgugccuuccugaugaaaguucagcaugaggguggcgccugacaauggaaaaaaaugccagauguguggacaacagaccuccuuugaauccacuaacacccaaagggaugacacaugggaccagauuauaaaacugaaccagauuauaacccuggaggagggaaacccaguagggcguaggaucuuaugaaaaggaucauaaaauucaucaccauaauuaccccccagcccagcuccccaacaaaagcccacaauagcuucgcucaaugauguuauucauccauauucaagucgccucgcucauuauucucagacaaaaacccugcugggccucugcuccucuggcagccaggcaacucagcacccacccucacucagccagccccgcauaccacuucuuucuuuaguaguggaguuuccagcaccaacgaugguuuuucgguuuuaacgccaucuuuuaggaguaccuuugacauucaggagccggcugaagggaaucacagcuaaagcuucccugggcaaaaacaaaggauguuacccagcagcuuuuucuuuagcagggcugagaugcugaagugagggcgcucccuugcuuugcccuggugagcacaaaacggugucauuugcacauuguc

SEQ ID NO: 191430 - RNA, 10260 nt, Homo sapiens
aggaacuagugcggagguccggggagcggccgcgcguucgggagcuucggcccugcguaggaggcgggugcaggugugggugcugagccgcccgccgccuggagggggagacagcuucaggacacgcaggccgcagcgagggcccgggcccuggggaucccagguucgucuucccgcggcgaggguuaggggccgggccgagagggacggcagcgggguccggggcggggguggggaccgagcgcagcgcgugacgcggcggcggggcccagcgacaacgaagccgaggccguaggcucgggccgaccuggagcuccgccgcugcgcccaggucgcguccccggggggacgggcggcgggcgaguggggagccggggucuccggcgccugggcguucacggagccugcgggcgcugguccgggcggccagggguggggggcgcgggcggcugggcccggacuucgacugggggccuggccccggggccacccaggcggaggcucugcggccgccuccaccccggccacaucccgaggccggcgccggguucggagaacugucaagggaccuccaggcccccacacgccugcgagauccggcgcuugccuugccccagccacaguuucuguuuccgagaaaccggugaaguaacaaugccacuagagcuugcugggagggugggugcggagaaggcgagcacgagacgccgggccgggcaguuggggaccccgaucggugugagagggcuuccuagggcuggcauggacuuccccaccacaaaaugcccagggccgggggggggaaggggcgcaagaaaaugcggacugggccagagaccagacuucggucaccacggugggaagcuauuggugccuagaugccucuagcuuggagcccagugacuuuuauuucgucuagagucuagacagugccuuuagaagcugccagcauuuauuuauuuauuuauuuauggcagagucuugcucugucacccaggcuggagugcaguggcaugaucacggcucacugcagccucgacuuccugggcucaagcguuccuccugccucagccuccugcauagcugggacuacaggcacgggccaccaggccuagcuaauuucuuuuuuuuuuuuuuuuuuuuuuuuuuugagacggagugucgcucugucgcccaggcuggagugcaguggcgcgaucucagcucacugcaagcuccgccucccggguucaggccguccuccugccucagccucccgaguagcugggacuacaggcaccugcuucucgaguagcugggacuacaggcaccugcaaccaagcccggcuaauuuuuuguauuuuuaguagagauggaguuucacuguguuagccaggacggucucgaucuccuaaccucgugauccgcccaccucggccucccaaagugcugggauuacaggcgugagccaccgcgcccggccuuuuuuuuuuuuuuuuuuuuuuuugagacagauucucacucuguugcccaggcuggagugcaguggcacgaucucggcucacugcaaccuccgcuucccggguucaggugauucuccugccucacccucccgaguagcugggacuacaggcguccgccaccacgcccagcuaauuuuuguauuuuuaguagagacgggguuucgccauauuggccaggcuggucucgaacuccugaucuugugauccgcccgccucggccuaccgaagugcugggaauacaggccugagucugugcacccgaccuaauuucuuuuuuucuagagacagagucucacuauguugccuagacuacaagcauuuuuaauugacaacuuuuacauuuuuuuucaaaugcuuacaguugcuucucagaacuuagaagacuuggccacauuggguuuuuuuguuauuuuuuuuuuccaucaaagcauuuuucuuuucucuuuuuuuuuuuuuuuuuuuuugagacaguuuugcucuguugcccaggcuggagugccauggagcaaucauggcucacucugcuccagcaggcuccuucuuucccuagagugugaccucggcaggccucauggacuguaagguagaaaaaucugaggggcuggguucgguggcucacaccugugagcuacugcagccuugaccuccugggcucagaagauccugacgccauaaccucccaaguagcuaggaccauaggcacucgccacuaugcccggcgaauuuuuucacuauuuauagagacggggccucccuguguugccaagguugcaaagccuuuuuucuuuucuuuuuuuuuuuuuuugagacggugccuuguacugucacccaggcuggagugcaguggugcaaucucggcucaccacaaccuccgccucccagguucacacgauucuccugccucagccuccugaguagcugagauuacaggugcacaccaccacgccuggcuaauuuuuuuguauuuuuaguagagaugggguuucacuguguuggccaggcuggucucgaacuucugaccuugugauccgcaccccucggccucccaaagggcugggguuacaggcuugagccaccgcacccggccugcaaagcauuuuucacgaggcacaaguaccucaccuguuuucucugccauguaaaguguuccucccugggcagaagugagcaugcacccacccuccuguuuucugagaugggagccuucagaagaccaugaacugcugcuuuggccaagccucuauggaaaaucagaagaggccacagcaaaaggcuggguacaguggcucacaccuguaaucccagacuucaggaggcugaggcggguggaucaccugaggucaggaguucaaaaccagccuggccaacauggugaaacccugucucuacuaaaaauacaaaaauuagcugggugugguggcgggcaccuguaaucacaguuacuugagaggcugaggcuggagaauugcuugaacccaggagguggagauugcagugagccgagaucacgccauugcacuccagccugggcaacaagagugaaacugucucggggugggggggaagaaaaaaaaaaagaggccagcaagguucuguuucccugcuuguagguggagaacauucucuccucauguguaagcagaugaggcccaccugagugacagugcagagcccuggcugccggccaacccccaccuaccuggggcaaguaccugggauccccuuaagaggacuaaccaggugcccccagguaacagauucaggccagggcuguggcacugcuugaaguuuuccagaacccgugcgcagugcagagguacaaggaggacaguguugagagccgguuugugcugacagcaaugcugacugaagcucugugcuucacuugguccuccuggcccuuccagggucgggacaguuacccccuccuuuucacagcuucccaacuggucacugcagaccaggauucaaacccaggcagucuucucagccacccuccaucugauuuuuuuuuuccggccaucuccaaguggauucuggccugacaccaaagacagcucagccgggugccgugggggauucccaugggguuguuuuaucacaugugacuuccaggccaaaguaagcuucuggagauaggaaggugguuucucagcgcuagcucaccacuaaaugaacauuaaugagucugggauguaaaacugauuuuauauucuggccggguacgguggcucacgccuguaaucccagcacuuugggaggccgaggugggcggaucauggggucaggagauugagaccauccuggcuaacacgaugaaaccccgucucuacuaaaaauacagaaaauuagcuggguaugguggcaugcgccuauagucccaacuacucgggaggcugaggcaggagaaucgcuugaacccaggaggcggagguugcagugagccgagauugcaccacugcacuccagccugggugacagagcaagacucugucucaaaaaaaaaaaaaaaaagauuuuauauucuaacagugaauccagagcauuaaaauaacaaucaccaaaacccucacagaacuuugcagacaaguguggccuccacaaaaucuuacaguccacacaacccacuggcuuuaaaauuaagcaauuuuuuuuaaauuggggaggggccuuuuaaaaaaugugucucuaaagacuuuacuauuuguauugcacucuucugaaugugugucccaugacuacucuuuccacugaggggcuacuguuuacuggaaggacccucagccucagaaaugcucuuuuguggguuuuuuuuuuuuuuuagccagagucuugcuugguugcccgggcaggggugcaguggcgcgaucauaggucacuguagccuugaauucccaggcucaagggauccucugccucagccucccaaguaccugggacuccaggcaugugccaccacaccuggcuaaugcaggguuggagaggagucccuggccugguucccuggggaccugagggcccaccucccuggucaggcucauaacugcuguugcccccacaggccauggaugcuccccacuccaaagcagcccuggacagcauuaacgagcugcccgagaacauccugcuggagcuguucacgcacgugcccgcccgccagcugcugcugaacugccgccuggucugcagccucuggcgggaccucaucgaccucaugacccucuggaaacgcaagugccugcgagagggcuucaucaccaaggacugggaccagcccguggccgacuggaaaaucuucuacuuccuacggagccugcauaggaaccuccugcgcaacccgugugcugaagguggcaugggggcaggguggaggcugccaccaggcucguuccuucucauccuugggccuuggcacuugcaauucccacacuaccuggaauauucucuaacccuaaacacccaccucacuuccuugguuccuucucauucuucaggucucaguucagagaccugcccugugcucccaaucuaaaaacagcccucuccaccucuagcauagcacccccauuucaugcccuguaacacuuuucacaaggcgcgguggcucacgccuguaaucccggcacuuugggaggccgagaugggcggaucaccugagcucaggaguuagagaccagccuggucaaaauggcaaagcccugucucuacuaaaaacacacaaaguugggcaugcuggcccacgccuacaauucccagcuacuugggaggcugaggcaggagaaucacuugaaccugggaggcagagguugcggugagccgagauggcuccauugcacuccagccugggugacaagagugaaacuuuuagucucaaaaaaaaaaaaaaaauuuuuuuuucagaauuuccuuauuuuuuucugcuacaaacuucaagcuccaggggccaaauggaccuuguuugccacacuauagcauccacagugacaccuucacauauacacacacacacauauguauacauauacguauauacacauguauacauauauacacguguauacauauacacauguauauauguacacauauauacguauauauacauauguauacauauauguguauacauauauacauauacauacacacacacacacacacacacacaaguaguugggauuacaggcgcccaccaccaugcccagcuaauuuuuguacuuuuaguagagaugagguuuugccauguuggccaggcuggucucgaauuccugaccucaggugaucugccugccucggccucccaaagugcugggauuacaggcgugagccaccacaccgccgggggcgguggcucacgccuguaaucccaacacuuugggaggcugaggcgggcggaugacgaggucaggagaucgagaccauccuggccaacaaggugaaaccccaucucuacuaaaaauguaaaaaaauuagcugggcgugguggcaggcaccuguagucccagcuacuugggaggcugaggcaggagaauagcgugaaccugggaggcggagcuugcagugagccaagauugcgccacugcacuccagccugggcaacagagcaagacuccgucucaaaaaaaaaaaaaaaagugcccuggugauugccugggcagcgccaguagagaagcgccauugucuucuaagguccucuaaguucagugugaagagggugauugcuccccugcacccaccaggcccaccuaauggaggcccacccaugaauguuaccacagcgcccagcccaaaggguaccuguucuuccacuuggcacucuugcccugggcagaggccaucugagcccuaugggaaucuugguucccaugacccaccgacaaacccacaaacccauccucuagggccuccaaccuggguuauguaguuaaccaagggccucucccuccuggacaucugggaugccaucugggucaaguaagcagucuguguugggaugaacacguuagccuuuuuuaaaaaauuauuuuacuuauuaaaaaaaaaagggggggggggugucgcuauguuccccaggcuggucuugaacuccuggguucaagcaauccaccugccuuggccucccaaagugcugggauuacaggcgcaagccaccgugcccggcuucacauuagucuuugaggacaguacucucacaggccucucguaauuuuuugagaacugauacuuggguauuucccagaguuccaccgcaacauggaagugaggaagggguugguuuagaauuucugguaacacgcauucuuuucuccagcugcguguuaggagugaggccaguuugggacugagugggagggacagagucagaucagagcugauauggugaggacaguugggaauguguuggaggggugcuuuguaggggugcuccaaggugcaguugggguacacuugggcuggugggguaccuuggccacacaaugcccuugagaaggaacaagcugguuaacccuuugguguccacagccgcagagaccugagcaugagcaaguccugccucccaagaaggucacuaacgccaaccacccucccucccgcccuccugggacuaaguggggagggcuggacuuuggauuuacacagggggucucaccuuggcuucuguucuuccuagaggauauguuugcauggcaaauugauuucaaugguggggaccgcuggaagguggagagccucccuggagcccacgggacagauuuuccugaccccaaagucaagaaguauuuugucacauccuacgaguaaggcaaacugaaccuaccaggcuugcguggaggggacagagggucaggacaccuuugccaagucucaggcaaagucuuccuaagggaaguccucucugcgaagcucgagggagguggccccaaaacuugcccagagucacugcuuccugaaaucacucagugcuguguuaauggacaguggggguggggaucacugaagcaggccaggaguccauugggcaguuaagauaagccagggcuaucuacaggcaucuguccguaagcuaggaacuugaguuuacaaaagugcccuggaacaaugggccuuuggacugggaucaaaugccgcccaggcacaagugggucaaacucccuccugcacuggaggaaaagccagagucagccccagccagugccugucccgcagcggccaagggguacccuagguccccaaaccaccucccugggcucacaggggcugccaaggccugggugagggggggggccaugcagagcacacccagguaugcaagcccccaacucugcuccccagaaugugccucaagucccagcugguggaccuuguagccgagggcuacugggaggagcuacuagacacauuccggccggacaucgugguuaaggacuggugaguaggguccauggccuguguccccacacucuacaugcuccucuuacugcgcugcauguacgugagacaacccauagcaagugcccacucugcacagcagugcccuggagccagguagccccggccuccgccccugcucugcacccacacccugcggcaccuccuggccuccccaccacccugugacguagucaacaggacacaguagccccagugugcaggugaggaggcugaggcccccaggugcacugucauggacaggcacuuuuuuuuuuuuugagacggagucucgcucugucacccaggcuggagugcaguggcgugaucuuggcucacugcaaccuccgccucccauguucaagcgauucuccugccucagcauccugaguagcugggauuacaggugcccaccacuacacccggcuauuuuuuuuuauauuuuuaauacagacagcgucuuaccaugcuggucaggcugguuucaaacuccugaccucaagugauccacccaccucggccucccaaagugcugggauuacaggugugagccacugugcccagccacugugcacugacaggcacuugggcaacagaggaccucagcccucucuggacugggugggaacccccagguccccugaccuaccugccuccccugccccuuucccuauucaucccaugacucuuuuuggagcuccuacucugugcacagaacugugccaggcucuggcuuggccgguggcagaagcaggaccccaguucuaggcaggccccagggcugccacucugaggauaaagcggugaggauggagggguaugcagagcugcaggggggagagguggcugggcugagcagagggugagcuuugugccagccccauuacacaggccacccccuugacucucccacugaauccacagccugguccauuguaaguacaggugacauggcuuggacagaccaggccucucuggaggggucuuuugauuuuugaggucauaucuuuaguaggaugcccaaaagggucccucuucucagaugggguaacagaggccagcauggacagacagcuuauccccgggccacaguggggcauagggagcgcugaagccagcugggccuugcaggcagagcagugucagcugaugggagaugaagcuccgagcuccaauguauaggucccaccugcccccaccccuggggccagcccucgguggcuuggacacagggcucucaaccccuccaccagguuugcugccagagccgacuguggcugcaccuaccaacucaaagugcagcuggccucggcugacuacuucguguuggccuccuucgagcccccaccugugaccauccaacaguggaacaaugccacauggacagaggugaggccucacccacuugcucucucuacccacuccucccagggccaggauggcaggaagcaaagggcagccucagggcccagggugccccugcuggccuggagcuguugccuuccagccugggcagcucucuuagaggaccuggcuccugccuuccccucccccgucccgguggucacuuccucucccuuccucccaacaggucuccuacaccuucucagacuacccccgggguguccgcuacauccucuuccagcaugggggcagggacacccaguacugggcaggcugguaugggccccgagucaccaacagcagcauugucgucagccccaagaugaccaggaaccaggccuccuccgaggcucagccugggcagaagcauggacaggaggaggcugcccaaucgcccuaccgagcuguuguccagauuuucugacagcuguccauccugugucugggucagccagagguuccuccaggcaggagcugagcauggggugggcagugaggucccuguaccagcgacuccugccccgguucaacccuaccagcuugugguaacuuacugucacauagcucugacguuuuguuguaauaaauguuuucaggccgggcacuguggcucacgccuguaaucccagcacuuugggagaccgaggcagguggaucacgaggucaggagauagagaccauccuggccaacacggugaaacccugucucuacuaaaaauacaaaaaauuagccgggcgugguggcgggcgccuguagucccagcuacucgggaggcugaugcagaagaauggcgugaacccggaaggcagagcuugcagugagccgagaucacgccacugcacuccagccugggugacagagcgagacucuggcucauaaaauaauaauaauaauaaauaaauaaaaaauaaauguuuucaguaa

SEQ ID NO: 191431 - RNA, 21117 nt, Homo sapiens
ggccgcaguuucuggagggagccgcugcgggucuuucccucacucguccuccgcgcgucgccgcucuucgguucugcucuguccgccgccauggcccagugagugacucgccaggggcagcccggcucggccucagcgggcggggaacucuuugggggucgagaucucccucguucucuccgacgccucccacccugggggucgccugagcucacuuggggcucugugacccuggcccuacggcgucucgggcccagagcuccuucccugcgggcccggcccccugcccucucggccgcgcaggcauggggcggggcgggucccuucgagggccagggaggaggcgcggccaggccucgccgagucugcagggacaccugcgggacgcgugccagcgggagccgggcgcgagggcggggcugggggccgccugcccggccgaggcucugcagcgugcgcgcccggcuucugggggcccgcgggaggcgcggaggaaagugcagacucccagucacggccaaauguggaaggaccggaccccuggguugcagcgcgucgagcggugcugacucuuuccuuuguucuguuucugccucucuagagcugacaucgcgcugaucggauuggccgucaugggccagaacuuaauucugaacaugaaugaccacggcuuugugguaagcggcgugggcgcguugucuucucucugguucccgggcgcuuuagccgaggccggcgauagguuugggagcuuacgggucuccuggccgugcuuugcuaaugugcucuguugcugcucguggcauuuuuguauggaaaggagaagcacccuguaggcgugggcgggccgaucccgaacuuaguccugcggagugugccuguggguccgugagguucacagcccgaaugaacgaauuagugucuuaaguagagaagaagggugcgggaggagaacccuugcuggcuguguagagcucuaacuugauugccugaugagaucuggggagagugaaaauguuucuucuaaauguuaaaguggcuuagacgccaggaugaucaauaacaacagauagagccuguugaaccggccaguuccuggauuugauuuugaguccuaacacguuggguguggauucuaccugacacaccggggguaguuggccuucgccucgguuguccgccguuuucauccuacugaggugacauaacuuuacagugagccucccacagcugggggaagaaaaggcaaaggcaggucugaccuccccagaacuuggguugaauggaaaggucauuguuacuuuggccacagucugaaagucuuguguguccuggaucuccuacucaggacuuuuguccuucuaggucugugcuuuuaauaggacugucuccaaaguugaugauuucuuggccaaugaggcaaagggaaccaaaguggugggugcccagucccugaaagagauggucuccaagcugaagaagccccggcggaucauccuccuggugaaggcugggcaagcuguggaugauuucaucgagaaauuggugaggccagcugugcucucagcugcuaccacgauagcagcuguuuuugguuucuuccuuuaguucuccuucuuuuaacucuagagauuuuuuuuuuucaauuucugcuaagcucugaccaaaugauugcuuaacuguugcaguguugguuaacuugauaagcgcuuaugaaguaacuuuguccuuuggugguaguaauucugagaauacuaacagacauuucaauaaacauuaaggcggggcacaguggcucaggccuguaaucccagcacuuuuugggaggcugguucagauggaucguuugagcccaggaguucgagaccagccugggcaacauggcgaaacccugucucuacauaaaauuaaaaaauuagcuggguauggugguguaagcuuauggucccagcuacaagcuuauggucccagguucgagaccagccuggccaacauggugaaaccccgucucuacuaaaaauauaaaaauuagcugggcuuuguggcucaugccuguaaucccaguuacucgggaggcugaggaaugagaaucacuugaaccugggagguggagguuacagugaccugagauugugccacuccaguuuggcgacagagcgagacuccgucucaaaaaaaaaaugaaaauaaaaucaagaucuccuuagggaauccuagggaacuggaugcuuauuuuuguaccaaacaauuuguuggcuuuagcagguauaucuuuuuuggaagaaaaaaguaggggaaccaguggaaauaauguguuuagauacccaaaauaauucuauaguaacaacucugaaaaaacccaggcacucccauuuagaagaaauguuuugcuguaagcagugcagugauagcucaggggaggcugagcauuccuuucuagaggagucgugucaacagugggguuguuuccacagggagaaggauuuguaaccaguaugccacuguuuuucaaucaaaugaccuagaaaggaagaacacugaguuuaaaaaaaggacauacuaaauuuuuuguguggcaagcugccuguaaucaguuucagacagagaaaacugaaaaaugguggauuauucuucaguauaggaaaauacuaaguaauguuaacuggagccuuguagggggaagauugaauaauauaaugaagcccaggcugggcgcgguggcucacgccuguaaucccagcacuuugggaggcagagguggguggaucaugaggucaggagaucgagaccauccuagcuaacacggugaaaccccaucucuacuaaaaauacaaaaaauuagccaggcgugguggugggugccuguagucccagcuacuugggaggcugaggcaggagaguggcgugaacccgggaggcagagcuugcagugagccgagaucacaccacugcauugcagccugggugacagugcgagacuccgucucaaauaaauaaauaaauuaauuaauuaauuaauaaaguaauaauaauaauaaagcccagccugguuggugugcuguagguagauauucauguucaaggcucugucucuuccugaccuccgaacuguugucauaaaaucauucauucauacacuaaaccauuugauauguauuuacugaauccccacucucuucuagacacauuauagucaguguuuaaucuguauacuuacuuaaaaauagaaauggggucuugcuaugcuguccaugcuggucucaaauuccugggcucaagcgauccuccugccucaaccucccaaaguguugggauuacaggugugagccacugagccuggucagcccuaaacuuuuaaauagugugcagcucuggccacagagaggauuauugaagauuaaguaggcugggugcguuggccuccugccaagccaggaggcuuuuagcccaggaguuugagaccagccugggcgacauggugagacuccaucucaaaaaaaauuuuuuuuuuuugagacggggucucacucugucccccaggcuggagugcaguguugcgaucucagcucacugcaagcuccaccucccggguucacgccauucuccugccucagccucccgaguagcugggacuacaaggcgccugccacaacgcccggcuaauuuuucguauuuuuaguagagacgagguuucaccauguuagccaggauggucuugaucuccugaccuuaugauccacccaccucggccucccaaagugcugggauaacaggcgugagccaccgcgccuggccuacaaaaaaaauuuuaaaacuagcugggcauugugguucaaggaguucaaaguugcagugagucauguucacaccacugcaggaguucaggguuucagugagccauguucgcacuccugcauuccaagcugggcaacagaacgagacucuuuuuagacuauguuuauuuggaauaaauucuuguuuguuuuaauuugccaagguauguuucauuuuugguccaucuuaaugcuggugucugguuacagguaccauuguuggauacuggugacaucaucauugacggaggaaauucugaauauagggacaccacaguaaguguucuucaguccagauucuuccagguuccgagaacauucuagaaaaaagugucagcaucgcauaugugacaguagggugaacugcccugugguacugauuuuuuugagauuacuacugauacaauaguucucagccuuuuuuucuguuaagacacacuuaacagaagggccgggugugguggcucacaccuguaaucccagcacuuugggagacggaggcagguggaccaagaggucaagagaucaagaccauccuggcuaacauggcgaaaacccgucucuacuaaaaauacaaaaaauuagccuggcaugguggcaugcgccuguagucccagcuacuugggaggcugaggcaggagaauuguuugaaccugggaggcagaaguugcagugagccgagaucaugccacugcacuccagccugggcgacagagugaaacuccaucugaaaaaaaaaaaaaaaaaaaagacacuuggugggugagauucucagucacacauacaacucaaaggaugacuaacucagauacagcaggcugagaauuacguuuuaacuccuccccuuccccuuccaaguaauccaugauaugucagucuauaacugguuuagaaccacuccucuaaugguaucaaaugcugagggaauuccugugugcucugaagugcugaauggcauuaaguuguauuacaccuacucuucguugagucuuauucaaggucuuuuccaguaaaaugccaauguguguuuggcuuaauuauuuuacuuuggggaugagguagguaucgugaauguccauaguuguauuguuuuguuuuuuaacuccuacacauaggggauuaacuuuccugagucaucaguuauuccuagauccuugggucauuuccuguaaauguaggcucuccauuccuaucuuauacuuccucucauuuauaagggaaacauuuuuggguagcauaaugaaacauggaagcauaaugaaacauggaagcauaaugaaauuauuuuucuguccuucagagacggugccgagaccucaaggccaagggaauuuuauuuguggggagcggagucagugguggagaggaaggggcccgguauggcccaucgcucaugccaggagggaacaaagaagcguggugagugccaucagcacugugcccaucucuguacaagggagcuggacuuugagaacgaauaagccaggagcaguucugccacccugaucucuguggugcccugagugugacagcugggagaugcuggcaauuucuuuuaucuagacauuuuguugcuuugauauaguauaugugcacaauccucuuuugccuuuuuucuucuguuauuucuaucaagacugauaccugacguucuaaauaggcuuuuuuuuuuuuucccgcccaggcaggagugcaguggugagaucuuagcucacugcaccccccgucuccugggcucaagcaauucuugugcgucagccuccugaguagcugggacuacaggcacaugccaccaugccuggcuaauuuuuugccuuuuaguagagacaggguuucaccauguuaccuuggguggucucgaacuccugaccuuaggcgaucugcccgccuuggccucccaaagugcagggauuacaggcaugaaccaccacacuuggccucuaaauaggcuuuaaggaagcaguuuagguaauguucugugcaaugucuggauguaggaauaaggucugccucuuuuagcugauauauaacccaaaaguaacuuaaugugauaaucguggguaacaggcugggcauaguggcccaugccuguaaucacugcccagcacuuugggaagcugcggugaaugaucauuugagcccaggaguugaagacuagccuggacaacauagcgagauccuguuucuacaaaaaaguaaaacaaacauuuuuuuaauuaaaaaauauaaauuggccgggcgugguggcucacgccuguaaucccagcacuucgggaggcugaggcaggcagaucaccaggucaggagaucuagacgauccuggccaacaugguaaauuccugucucuacuaaaaauacaaaaauuagccgggcaugguggcgugcgccuguagucccagcuacuugggaggcugagacaggagaauugcuugaaccuaggaggcagagguuagugagccgagaucgcgccacugcacuucacccuggcgacagagugagaguuuguuucaaaaacaaaacaaaacaaaacaaacaaaaaauacacacacacacacacacacacacauauauauaaauaauugugggcaauccgauauauauauaaauaauugugggcaauccgcuugcccuggccucccaaaguacugggauuacaggcgugagccaccgugccuggucugaaauaugauucuuuaaggcugggcaugguggcucacgccuguaaucccagcacuuugggagacugagaugggaggaucacuugaggucaggaguucaagaccagccuggccaacauggugaaacucucuacuaauaauacaaaaauuagccgggcaugguggagggcaccucuaaucccagcuacaugggaggcugaggcacaagaaucacuugaaccugggaggcagagguugcaaugagccgagaucucaccacugcacuccaucaugggugacagagcgagacucggucucaguaaaaaagaaaaaaugauucuuuuuuugagacggagucuugcucuguugcccagguuggagugcagagugcaguggcgcgaucucugcucacugcaagccccaccugccagguucacgccauucucucgccucagccucccaaguggcuggaacuacaggcacccacgaccacgcccagcuaauuuuuuguauuuuuaguagagacgggguuucaccguguuagccaggauggucuugauccccugaucucgugaucugccugccucagccucccaaagugcugggauuacaggugugagccacugcgcccagccaaaaauaauuuuuuuaauuaccuuucuggugaaugagucuggggauucucuucaguguguuauuaauaaaacacagaaguagagaggccuuucugcuucucagaaguuuaaacagcugugugugcaguggcuugcaccuguagugccagcuauucaggagacugaggugagagaacugcuugagcccagguguucaaggccagccuggacaacauagcaagacccuguuucuuaagaaaaaaaaaaaagguuugaaaauacuuaucucgaagcaccugcacagugagcaguuagaaaggcaaccagcagacaaugcacguaaaaguauuugacauauggagugcuccaguuguuuccaucaguucucuuuccucauacugugguggcagaaguacaaauggcaccuuuaccagaaggacacuguaaaaguucagugaagcucugcgguuuccgguguggcugucuucaucccuaauccuaaauguuaacuuugcaacccuguaagauuucaugucuguaccagaaacuuuuugugaggaagccuugacuggccauuagggagcagaacagugagggaaagucucaagaguaauauauccgcgugcugagcuguggaaggaaugaacagcggccuuucucugaaugguaauguagcucucaaaaacgcugccugguucuuaauccaaauguccagaaccauucugugccuggcagcacacauccagacaaaugaaagagggucucuucacuugcuaaaagccauuauaaggagaaauaaagaaaagggaaaaaauuaaaagaggaucucuaaaggaacuuucguauugccugcuguuugcaaucauacugucugcugcugcugcaguagaaauuucugagccgggugcgauggcuuaugccuguaauuucagugacucaagaggcugaggugggaggagugcuugauccgaggaguucaagaccagccacaucaacauagggagaccccaucucugcaccaccaacaaaaaauuagccaggcaugguggcucacgccuauggucccagcacuuugggaagcugaggugugaggauugcuugaggccaggagcucaacaccagccugggcaacauagcaagauccugucccuacaaaaaaaaguuuuuaauuagcugggugugauggcacacaccuguagccccaccuacuugggaggcugaggcaggaggaucaccuaaguccaggaguuugaggcugcagggagccgugauugugccacugcacuccagccugggcaacagagugagacccugucucuaagaagacauuucuucuggugcuuuggugaugcuucugcucagccuuucugucuguagucucaguccgauaguccagucugcuuugagggcccaccaggaccuggaggaggggccaguuucagucaagggucugcaguugaccuugagaacuuagcacauucauuaucuuuuugugggcacuuccaccucccauuagaaagaaaaagaugggcccagugcggugguggcuuaugccuguaaucccagcacauuggguauccacgguggguggaucacuugagcucaggaguucgagaccaaucugggcaacauggcaaaaccccaucucuacaaaauccaaaaaaaugagcuggguguggugucacauaccuguagucuuagccacuuagggggccgaggcaggaagauuacuugaaccugggagguugaggaggcugcagugagcugagaucacaccacugcauuccagccugggugacaacgugagacccugucucaaaaaaaaaaaaaaagaaaggaaaagauagggguuggugucuauggguauguuggugucuauggguaugggcucucagcccgucucuucucauuaacugaaccacacuguuucuuuacacaggccccacaucaagaccaucuuccaaggcauugcugcaaaagugggaacuggagaacccugcugugacugggcaaguucugggcuacucuuuaaagccaauuggcaacaugggcgugucuaagugaugaagugcguggagaaaggccaccguggucucccagggguuagcuuggugacauaaacgucucgaucuuugauugcuagaauagccaacgccuagaaugcaugccugcuguucacaucuuuguaucuuagcugacuguucauagccuugagguugauauuaaaagcagccuucuauaauucaucuaaaagaugaauucuuuaaaaaggaauaggaugaagugaaauaagauuuuuucgagccauauuauuucauggccaaaggaaagaaugucagaaucaaaaguggcguuugcuugcaugggugaaagguggaagauugaagguacuguugcugugucaacauuccaugaacguggaaaauuccccauccuguagugugggauucaggcauucugugcuugaacaaaguaaccuguggacuugcacccucacugaauaugaaggaggccuaaccuaguucauaguacaguggugcgaucuuggcucaccgcaaccuccaccucccaggcucaagcaauccuccugccucagccuccugaguagcugggacugcaggugcaugccaccacgccuagcuaauauuuguauuuuuuguagagacgggguuucaccaugucacccaggcuggucucaaacuccuggacucucaagucaucugccugccuuggccucacaaagugcugagguuacaggcaugcgccaccaugcccggccucguguugcuguuaaaguaaacuuuaucucauauuguaguucagccaugcuguggauggaaaaaagcauuaggcucaggagaccugaguggcaguucuggcuuuccauaaacuuaacugugacaucaggcaagccacgucccuucauggacuucaguuuccuuaucuguaagauaugggguuggauuacaugaucuccaagcucucuucagcuccugauucccuuuaauuuuauaucagcaauuuuaaugugaauuuuauuauucaauuuuauuuuauaugaaaucaaugcugagguugaaauaaggacucaggccuuugaggaauccgggaagcccucccuccuaggccugccagugcuugguggcuuuggccacagcagcucacuuguccuuaccuuuucaccagugguuggccauugagcucagucagaaucugcuuaggguagaaagaggcuggugcugggacugacguaaagagcugaguaaucuucucauuagugugaaggauuggaaagggaccucuguucccugacaguagauuacugcgguaaaaggccggguguaguggcucgugcuuauaauccaguauuuugggaggaucccuugagcccacgaguucaaggcugcagugagcagugaucauacuacugcacucuggccuggguaacagagagagacccugucucuuaaacagaaaaaaacaaaaagaucacugcaauaaaagugagugguagcaacuuuuuuuuuuuuuuuuuuuuuuuuuugagacagucuugcuuuaucguccaggcuggagugcaguggcauaaucucagcucacugcaacuuccgccuccuggguucaagcgauucucaugccucagccuccauuguagcugggauuacaggcaugugccaccaugccuggcuaauuuuuguauuuuugguagagaugggguuucaccauguugcccaagcuggucuuaaacuccugacuucaaguaaucggcccaccuuggccucccaaaguguugggauuauaggcgugagccaccgcacccagccugcaacuuuuuuuuagauacacacacuuaggacaaagucaugaagagaagcacaguccuugccccuacguguguugaucaagcaggcccuccuuaguucauggcugaaguggcaggaaggguaaggugaaguaagauguuagcagccauguuacucuguggccagagugucaaaaucagaagucagcaggggcagcaauagaaacauggacaaggccaggcgugguggcucaugccuggaaucccagcacugugagaggcugaggugaguggaucaccugaggucaggaguuugagaccagccuggccaacauggugaaacuccaugucuacaaaaauuagcugaguguggcggugugcuccuguaaucccagcucaucaggaggcugaggcguuagaauugcuugaacccaggaggcagguguugugcugagccaagaucacaccgcugcacuccagccugggcgacagagcgagacuccguuucaaaaaaaaaaaagaaacacggacaauggaguccugaugugagcgucaguuauacaacugacgguccagguggugacagccaggagagagacugcccaggucauccaaacaccuggccuccugggcaggugugucccugucauggagcuggguguagaugacugagaguuugaugccaugaacuguuuggcucucgucacucccuuuguuccaguucuugacaacuaaauaauuuucggauaaucuggcuucccaguugcuugucuauagggccagaauguguugaccggacuaacauuuguaaccacgaagauccauaguuaagguuuucauccuacauucauuaacggguauucugauuuuauacaucuugccagcuuauaaauaaagaucuggucuuuauuuauaaauauaaauauaaauauaaauauaaugauggggccuuggagggacuccuuucugggcuuacaagguugagaccuuggaucuagggucauuuuacuuuucaguagccauuaggaacaacuacaauacauuuauauuuugaaaaaaaacaagugauuuaauuggccaauauauuuuaaccucuaguugcuagaaaagugguaacuuugggaaaaagaggacuuuuuuucuugugggugggggcugggaagguggggaguugcuuugaaugaugagaaagaguagaaaauacaggcuagagagccauaaguauugaaagugaauucagggacuuugagaaaccuugagaagaaugagucuagaauuaguguuaaauaauauuguacuggacugaagcuugcuuugaauugcuauaugauucuuguaucaaaaaugcuguacucauuuuauacuuguuauuuuuuguguggagagguagccuugccagggauguuggcaugaaagcugauguggacuucucugaugugucgccuguuucucugaaggccucuuggugcuuguuguccugacaggugggagaugagggagcaggccacuucgugaagauggugcacaacgggauagaguauggggacaugcagcugaucugugaggcauaccaccugaugaaagacgugcugggcauggcgcaggacgagauggcccaggugaggccccggcacugccucuguguccguucugcagggagugcucacuuugccacagacaccgaaucuuuucuucauuccuauccccuuggccauucggguggccugcauggacucagccuaauuugagggaaacuguuaguaauaggccuauacacuaugcuagucagucacuaagcagaaaguccccacagagucugggugguuaucaucaccaccauuuagcguagcuuaccuggugucaggcacugugucacuccacauaccugucccauuuacucccacaguugucccacauggcagaugcagcagaagcuuucuuuccugaucaaguugggauuggcuuuuugauaguuaaucugaaaagucaguccaaguagggaagcugaagcauuucccccaacauuuuauuaugacaauauucaaccaugcagcacagaaguuugagaguuuuacagugaacaccuggauacacaccuccuccuuucucccauccacagguuccuguacuugcuuuagcaaugucuguccaucccccaccaauuucaucuuauuuuuuggauacauucaaaguaaacugcagguauccauacuuuuguuuucccuaaauacuuuagaugaauguaucuuuaucaugagguaaacauagauuuuaacugaaaacauaggaaaggacuuucauucacccgccauuuuuuggagggccaaggccuucucguuaaguaugguuugcugaugcgcuuucuagucgugucuuaccaucuagaauuucuaguuucaguuauuuccaaugggaugugauuuacagacucuagcaaggcauacaguauagcuuuccagauuuuuuguuguuuuccuccuaguuuuuuauucaugucauccucacuuacuuugacuauuguuuguuucacuggauugcuguuaauuguucuuucuaaaacauuaccuuaguuuucuuucacagaaacagugcuauucuuuuuguguucauuuuuuauugguauauauaauacuuaacguguucacucagcaaacacacgagugcuuuacuauaugccaagcaugauucuaaaugcuggggauauacuagugaagaaagcaaagugccugcccucccggagcugggaagacagacagaaauaaauauacaauaucaaacuaguuagcgaugacugugagaacgaagaguaaacugggacaagauccggugauugcagaaggcuucugaggaggcgacacugcacagagaccuaagugaagugaggagcccuugccucugaggagacaacacuucugguggccagaaauucaguauaaccagguucagaacaaacacaacugacucuggguuagcauaaaacucaaccagcaggagcagaaguccccaggcagacgcgagcagagccugcuggcaaccgugagcauuggucagcguggacauuggacaaggggcuuccuugcucagcccucauuccucuaacaugguucucuccuguguucugcauguaggccuuugaggauuggaauaagacagagcuagacucauuccugauugaaaucacagccaauauucucaaguuccaagacaccgauggcaaacaccugcugccaaagaucagggacagcgcggggcagaagggcacagggaaguggaccgccaucuccgcccuggaauacggcguacccgucacccucauugguaauguuaugcuuuucacaugggcccuuucguccacuauucugaucuugaugucuggaggacagauacagacuggucuuuagagaaucucuucagcccucuuuagcuuucagagugccuuuugcucuuucuugcguugaagaaacugacagugugagagaggcugacgcugcuuuugauucucuuccuuguaguucuuaucucauucguacaaacugugagguaaauucagaagugacuguccuuccuauccaguuuuaucuuuggaauauuuuagcauuagugauguaauuguagucagugaucuaagauuuuauuuaugaggcagguaacuugaguaaaauuuuucauagaaaaguucaugaauaacagggccgggcacagugguucacgccuguaaugccagcacuuugggaggccgaggcggguggaucaugaggucaggagauugagaccauccuggcuaacaugaugaaacccuguuucuacuaaaaauacaaaaaauuagccaggugugguggcacgugccuguagucccagccacucaggaggcugaggcaggagaauugcuugaaccugggaggcagaguuugcagugagcugagauggcaccacugcacuccagccugggugacagagcgagacuucgucucaaaaaaaaaaaaaaauuagcaggugccuguaaucccagcuacucaggagguugagccaugagaaucgcuugaacccaggaggcagagguugcagugagccaagaucaugccacugcacuccagccugggcaacagaaugagacuccauccccuccaaaaaaaguuugcgaauaacauaugcuuguguacucagaaauuauuaaaaauuuacuuuuuuccccuagauauuaaaaagauaaaaauuaccuauccauuugaguccucguuguuuugcuaaguuccuucuccuuccucuuuuagaagaaagccacuauccugaaguugguguguauccugcccacuuguuuuauaucuuacauuagugagcuaagcaucaaacucagaaagauaaggaaauaauauaaagaaauaaacauaaaacgagaggggauuaacaauaucaaaaucuuggccgggggggugguuuucaguguguuuguuuguuuuuugagacgguguugugcucugucacccaggcuggaguucaguggcaugaucucgggucacugcaaccuccaccucccggguucaagugauucuccugccucagccucccgaguagcugggauuacaggcaugcgcuaccaugccuggcuaauuuuuguguguuauuaguggagacgggguuuuaccauauuggucaggcuggucucgaacuccuaaccucaggggaucugcccgccucggcuuccaaaagugcugggauugcaggcgugagccaccaugcccagcaaaggugguucuaagaguaaaauacauagacuucuggcaggaaugaaaaaggagaacgaaggaugccucucgugguuaaugagaggcugaucuuugcuucuggcagauuguucucacuauauuaaaacagaauugggccaggcgcgguggcucacgccuguaaucccagcacuuugggugaccgaggugggcggaucacgaggucaggaguuugaguccagccugaccaacauggcgaaaccccaucucuacuaaaaauacgaaaguuagccaggcauagugacccgugccuguaaucccagcuacucaggaggcugaggcaggagaaucacuugaaccugggaggcggaauuugcagugggcugagaucgcaccacugcacuccaggcugggcgaccgagcaagacuccgccuaaaaaaaaaaaaagaagcaucucaaaaauaauaaaacagaauuuuuccuguuugcuccucuggauacagguugccuuucucucccuugacucuucuccccuuuugaccucccuguucauugugccucgcccuauugaacugugugguguaaggcagaguaaggaggaaagucggugguuucuacaguuccgugcuguauagaaggaaguuggcugcuuuuagccgaucugagccauaacauaggugaggagggaggggccaauagcuaggagcaauuuauucaucacggacucaaguauauguguaaguauuaggaucucagaauccuacucuccuccuguggauccauauaccucuucccccaggguggcugggcccacccccugcugggagccaucauuauuugugaacuaacagggaagucuuccagcugcccucucccccucuaacaggaaggguuugccucauagccuguugcaccagucaucuuacaaagcuuccuucuagaaaugcuaagucauccugugugugcauuugggccaggagagagguagcugcuuuuguguguuuggaguaggguuagcagucucaagccauagcugcuccucuuuccucagaaauaaaguccucuguuaguucccugagauuuuacuucauuuugucuaugggggaaaaagugguuaaagagucauuuauucuaacuauaaguugucaguugagcaagucuuuuauaaggaauacuuucugaaaauacuaaaugucuuaauauuaaaauacuacauugacuuuuuaauucaaaugaaguaaagugguuaaacuugaaugauuacggcuauacugaaaaccguaaaauauaaaaaccuaacauuuuuuugagaggugaguccguaaaugugacuuaucaauguaaaaucuucaaaaaaaaaaauuaagguccucuaaauugaauuugaaauuuuacucauggaccaacacugaguauucuacauaacagugguuuuuauuuuauuuuacugguuuuagagacagggucucacuguguugcccaggcuggagagcaguggugugaucauggcucacuguagccuugaacuccugggcucaagugauccucccaccucagccugccaaagugcugggauuacagguguuagccaccuugcccagccauaacagugguuucuaucucuucauuuucccucaaaacucccuuuugaauuucauguuaaucuuugugauugaauacucauguuuguauuggaagauugucuuaagaguuuuaguuaucaaauuaacuguuuagagcuucuuauaaaaguuccuuccgauccaugucaacuuuuguggccuaagguugaaacuuucagcucuuuguauaaacagacuuuccugcuccaccuuucuucugguugcugugcgaacuuugguaauuuucaugcgcauccgugugaaaagaccaccaaacaggcuuugugugagcaauaaagcuuuuuaaucaccugggugcaggcagguugaguccgaagagucagcgaagggagauagggguggggccauuuuauaggauuugggcagguaguggaaaauuacagucaaaggggguuuuucucuuacgggcagggccgaggggucacaaggugcucaguuggggagguucugagccaggagaaggaaugucacaagguuaaucgcucaguuaagguggggcaggaacaaaucacaaugguggaaugucaucaguaaaggcaggaaccagccauuuucacuucuuuugugauucuucacuugcuucaggccaucuggauguauacaugcaggucacaggggauaugauaguuuagcuugggcucagaggccugacaguaaucuguuuccucuucccgaucuccccauguaggagaagcugucuuugcucggugcuuaucaucucugaaggaugagagaauucaagcuagcaaaaagcugaaggguccccagaaguuccaguuugauggugauaagaaaucauuccuggaggacauucggaaggugggacacagucccuggcaguggucuuuguugguccugcggaaggcaguggggguggggguuguggugggagaacacucgaggccacaggauggcagguggaaugaaguucagccuugacuuggaucuugacuuacaauguuuuccuagaauauuggcccuucugggaucuccacugcugaugagaauaagacugguagacauaaggcggucacucuccuaauggcaauccuaguaggucucugugucacucuuuaggcacucuacgcuuccaagaucaucucuuacgcucaaggcuuuaugcugcuaaggcaggcagccaccgaguuuggcuggacucucaauuaugguggcaucgcccugauguggagagggggcugcaucauuagaagguaagugagaggcagcccaggguccgacgggaaggacucacacggcugugcagaagugcgaucuuaggacacuuagcuugagcaguuuccagggaugggcacuuagccccaucacuggacacuggcacaagauaggcuuagauuaugugguucccuucuucacuguaccucaguugcuguaacuagauuguccacacuacaccuuuuuuuuucuuuugagaccaaguuucgcucuuauugcccaaacuggagugccaugaugcgaucuugacucacugcaaccucugccucccggguucaagugauucuccugccucagcguccuaaguaacugggauuacaagggcacgccaccauguccggcuaauucuuuuguauuuguaguggaaacaggguuucaccauguuagccaggcuggucucgaacuccuugccuugggugaucugcccgccucagccucccaaagugcugggauuacaggcgugagccacugcgcccggcuccgcauuacaccuacuacacuacaccuuuuaaaguacuucugugaacuaucgugcccucuggccuugccucuugggaauuuugcucuguauuuucauugaaaaugccaaaucauagaaaacguagcauuucuacacaugacguuacaucguucucauguuggcugaagauucauuugaugaaucugauuuuucugaaguagaugauucuggugauucagaugauucuaauauuaguucucuuuagaaauaacgccaagaauaguuuuuauauuuuauuuucauauugaaaaucgucagauuuucuucagccucaaaaagcguguuuauguaaaauuaaaugagcgcuggcagcgagcugcacuuuuuuucuaaacaggaaaaggguuaacagcuugaagaaaugagaaauguaacuuuguuucacuaggguauacaucggcuuccagcuuacuucccuguuagaguuaagauucauugcauuuggccgggcgcgguggcucacaccuguaaucccagcguuuugggaggccgaggcaggcggaucacgaggucaggagauccagaccauccuggcuaacacggugaaacccugucucuacuaaaaauacaaaaauuagccgguuguaguggugcgugccuguaaucccagcuacuggcgaggcugaggcaggagaaucgcuugaaccugggagguggagguugcugugagcugagaucgugccacuccacuccagccuggugacaaagcgggacuccgucucaaaaaaaaaaaaaaaaagacucauugcuuuuuuccccccuugauuauuucaguguauuccuaggaaagauaaaggaugcauuugaucgaaacccggaacuucagaaccuccuacuggacgacuucuuuaagucagcuguugaaaacugccagguauguagccuagggcuggugccaugguuacucuaccucccuggggccaucaguugugauguuugguuuuuuguuuuuuuuuuuugguuuuuuguuuuuuugagacagagucucgcucugucacccaggcuggaguacaguggcaugaucuuggcucacugcaaccuccgccuccuggguucaagcgauucuccugccccagccuuccuaaguagcugggacuacaggugugccaacauaccuggcuaauuuuuuuuuuuuuuuuguauuuuuaguagagaugggguuucaccauguuggcuagacuggucuugaacuccugaccucgugauccgcccaccucagccuuccaaagugcugggaugacaggcgugagccaccgcgccuggccuaaccaucaguuuuucauuuacccacauugauaugaaugaaaaucuauccgcgucaccaggggcagaucacuaaucucuggccgugcguuuugugcucaggacuccuggcggcgggcagucagcacugggguccaggcuggcauucccaugcccuguuuuaccacugcccucuccuucuaugacggguacagacaugagaugcuuccagccagccucauccagguaagccuguggagcagggauuaaccuggcuggccccucgggggcgugcgccauggacuguccugaccaaccuacucucucguuuccuaggcucagcgggauuacuucggggcucacaccuaugaacucuuggccaaaccagggcaguuuauccacaccaacuggacaggccaugguggcaccgugucauccucgucauacaaugccugaucaugcugcuccugucacccuccacgauuccacagaccaggacauuccaugugccucauggcacugccaccuggcccuuugcccuauuuucuguucaguuuuuuaaaaguguuguaagagacuccugaggaagacacacaguuuauuuguaaaguagcucugugagagccaccaugcccucugcccuugccucuugggacugaccaggagcugcucaugugcgugagagugggaaccaucuccuugcggcaguggcuuccgcgugccccgugugcuggugcgguucccaucacgcagacaggaaggguguuugcgcacucugaucaacuggaaccucuguaucaugcggcugaauucccuuuuuccuuuacucaauaaaagcuacaucagacuga

SEQ ID NO: 191432 - RNA, 148256 nt, Homo sapiens
guuuugaugaauaauacuugguggggcgagggggaaagaguagggguggagggguaggaggauuuacucuuccagcgagagcuacgcgcaucccauccucccccuccccccuacccgggcuccggcguggaggcggggcguggccggccugcuuugggaggggaggggcuucccuuacagugcugggcucugccaggacggcuguggggucgccuuaccucgggguauccacucugcagucgaccaguucccgccaggagcaaaggguaggaaggagagcaggaucugcuguaggaacgcagcuaccgcgccacuaucacgaagaaacagcaggcucggggcacgagacgaacuggagaccgcgcugccuagcuggguaaccugggaagcagaggguaauaaguggcgccuuaagacaacccuguagcagcagcaguggcggccaaaggaggcugcucagggaacaagcggcuguaguagucuguggggcgacuggagugaccgaagccaaggcaguuuagugccucucguguucuuauuuuuuaaccucugacuaugcaauucugaaaccucccccauucgggggaccagacagccugauagacaccuuccacucuccuuccucccgccguggucucgagaacagaaggaucucuccuuaacgccuuucaccauuaagaggaaagcgauggaggagcugagcgcugaugaggugaggagguugggggacaccuugagggauuaguuggcaacucguuagcgcuuuggacagggaugguauugcgccagugcugucuggccuuugggcuuggagaaggaacggagaugauauuuuccaagaauaacgugacuccccgauagggucucugguuuuguucuccuuuauucuguugccuucuuucuucauucugaacuccauuugcuucuuuccgaguguucuuuuaggguaugaacaagaggagagagcaucuugagguguuuauucuuuucuucaggguaugcgaacaagaagggcgagauuuacaugaaguuaaagugugugugugucugugucuucaggaauuuaaagaacaauuuuggauggaaugagaauguauggugggugaauauuuuuaaagaaagcauuugaaauuccagauaugugugguuauugcacuguauaagcuugauuaaacauauauuuuugcuugaggggugguuuacagacagauucuuugauauuuaacaaaauauguaucuucuccacaguuuagagaauuccaguuauauucugguacuuaauagaccacuaaugacuucuggcauucuucuguuacauucuaucuuuuccuacuucuugaaucuuucaaacuuguguuuugcuguagcagagacugaacgggaagcaaguggaagcaaaugacuuucuaaacucucuccuguucucauuucuuaaaggaguuauacagaucuacuucuugauguuuuaaagauuguuuaauaaauuagguuguuguaaaaaaaaaaacaaccaaaaagcaguggcaauuaggguacaaggaauuuccuaugauucuacugccuuuucucuuccuuuuugcaaauuaggagcuucccuuucaggaccccuacuggccauacccucuuuagccuaccuccacauuucuucacugguucaucauguaaacuucccuacaguauuaggaaagcagucauccaucaaguugauuguacuacaagacuuccaugcuccaguuuuagcuacagaguacuuaguguguuuacuuagggacugaaauucuccugggauaggacacgcagugguguguuaagggucagguaggaaaggaagcaaaugauuuuguugauugugauacuuggauacuugguuuggaaaaucaggacugcccauucggcguuacuuuguuuuuuucgaauacagcagaaauguaaucuuaagugaagagaauauuacacaguuucuuucauucgguaggaaaucuccuuagaaucgcuuuauuuuauguggguuuuuuuuuguuuguuuguuuuuuugagacggagucuugcucugucgcccaggcugcagugcaguggcgcgaucucgucucacugcaagcuccgccucccggguucacaccauucuccugccucagcccccugaguagcugggacuacaggcgcccgcuaccacgcccggcuauuuuuuguauuuuuaguagagaugggguuucaccauguuggccaggauggucuccaucucuugaccucgugaugcacccgccucagccucccaaagugcugggauuacaggcgugagccaccgcgccuggccuguuuuaugugguuuuuuaaaaguuucucuaccucccccguuuuucauuaauguuaauucuagugaguaauuucucuuaaggcagagauacuguuuuuuuuuuuuuuuuuuuuuuuuugaggcggagucucgcucugucgcccaggcuggagugcaguggcgcuaucucagcucacugcaagcucugccucccggguucacgccauucuccugccucagacuccggaguagcugggacuacaagcgcccgccaccacucccggcuaguuuuuuguauuuuuuuguguuuuuaguagagacgggguuucacuguguuagccaggauggucucgauuuccugaccuugugaucugcccgccucggccucccaaagugcugggauuacaggcgugagccaccgugaccggccagagauaguuuuuuuauuuuuuuuuauuuuuuauuuauuuuauuuuauuuuuuuugagacggagccucgcucuguugcccaggcuagagugcaguggcgcgaucucagcucacugcaaagcuccgcuucccggguucacgccauucuccugccucagccucccgaguagcugggacuacaggcgcccgccaccacgcccggcuaauuuuuuguguuuuuaguagagacgggguuucaccguguuagcccaggauggucucaaucuccugaccucgugauccgcccgccucggccuuccaaagugcugggauuacaggugugagccaccgcgcccggccgagguaguuuuuuaguaguccuuuacuccuauaaauuacuuuuuuuuuuuuuuuuugaugaucuguuaauaguccuugguuuagaggcuuuugcauacuugaguuuucaccaaaaaauucuuuucaaaccagugaggcauuacagaccagugaagauauuguauaaucuaaaaugugucucuucacuuucaucaguccuugaggaagguguaacuuuuuuuugugaccauaugaggaacacauguaaccuuuguggaagaaauagaauaaacuuuuuucaaggucaacagaauauuaaaauaaaugaaaaaaauuaaauucacuaauacaggaucaauguaaaauuaucuucaacaaauuaguuguccagaacacaaagggcugguucaauaacuguuaauuuuacucucagcagaaccuagaacaaauaauauucguuuguuuuuaauuuaaaaaaucuuuuuuuuuuuuguagagacgggggucuugccauguuucccaggauggucucaaacuccugaccucaagcgauccucccacuucagccucccaaagugggagccagacaaauaguuauuuugggaaaaauaucuuugaaguuuuucuuuuuaauucaauuaaaaauuuuugagguuagguaagcaguucucaugagacauuuccaaagcuuuugccuuuguauuguuacucuguaguugaaaacuugugucagauaugguaggugacauugauuugauuacaaaauaauacacuuauauuauugaaacuucaagcuuauauuucaggguuaaaacaggcaaggcggugaucuuuuaaucuaauuuaggaaauuagguaaggcagaguuucauauuuuaacaaaaugaaaauguaugauuauacaguccgugaaaaaggcugguauaaccagacugguagcuuuaggaacuuuuaaauuaugugcacuuuuuggucccugucauagaucaccuagaauucuugugcuuuuuaaauuuuuuugugagacagaguuucgcucuuguugcccaggcuggagugcaauggcgcgaucuuggcucauugcaaccucugccucccggguucaagcgauuuuccugcgucagccucccaaguagcuggaauuacaggcaugcgccaccauacccggcuaauuuuguauuuuuaguagcgacgggguuucuccauguuggucaggcuggucuugaacuccugaccucaggugaucugccugccucggccucccaaagugcugggauuacaggcaugagccacugugcccgguagucuugugcuuuuaaguagaguacuuuaacuucacuguuguuuguuauuuauauaguguauuacagugaguucauugcccuauaguucacugccuauagguucauugcagaaccaugacuaaguucauucucuucaggaaccuacauuccaaggcaucauuauuuacauuauauuaauucuauaaucuacucauguguuguuuuucguaucucaagguggugcugugaguaggugguguguuuauuuuugagauagggucuggcucuaucgcccagucuggaaugcaauggcaugaucuuggcucacugcaaccucugccuccugggcucaagugauccucccaccucagccucccaagcugagacuacaggcucaugccaccacaccuggccaauuuuuguauuuuuuucuagagacaggguuucaccauguugcccaggcuggucucaaacuccugggcucaagugauccacccgccuuggccucccaaagugcugagauuacaggcaugagccaccaugcccagccaaguagguguuuuaaacuguuuuucgacaaugguaaugagauugcauaagugauuuuucucuccuaacucuucuuuaugaccuaguucaucugcaagaugguuggcugggauuccggguguggucaagauuuuagaaaguguuggccgggcgcaguggcccacgccuguaaucccagcgcuuugggaggccgagguggguggaucaccugaguucgggaguucaagaccagccuguccaacauggagaaaccccaucucuacuaaaaauacaaaauuagcugggcgugguggcacaugccugugauccgagguacucaggaggcugaggcaggagaauugcuugaacccgggaggcggagguugcagugggccgagaucacaccacuacacuccagccugggcaacaagagugaaacuccaucucaaaaaaaaaaaaaaaagauuuagaaaguguuuuaaguauuccuuuccaaaugcagaauaugugaccuuggacuuuuuagcaagguucuguaaguggaagaaaauugacauuaaacaacagccuuaggagccucuucugugccaggcacuugauagcuguuucucauuagagaaaacauuauaaucaagcagguacuguuuuccuaauuuuacaagucaggaaacugggauucagguuaaguaacuuguccauagcgaccuggcuuagaagugaugggguuggaauucaaacccagugcucuggacucgaaaguccucuuuauucuacugcucaacaacugacauaaauucaccacagcuuuuguaucaacauccuacguaacacugacccacucuguuuugauauacauaguuuuucuguagaagugcuguuuugcaugaaugcauucaugaugugaucagggcuuuugguacugguccucccacucccaauuuuuuuuuuaaaugccugucgcguuaaaaauuugggaguuggggccgggcgcgguggcucacgccuguaaucccagcacuucgggaggucgaggcaggcggaucacgugaaaccccgucucuacuaaaaauacaaaaauuugcugggugugaugguacgcaccuguaaucccagcuacucaggaggcugaaguaggagaauugcuuaaacucaggagacagagguugcagugagccgagauugcgccacuguacucuagccugggaggcagagcaagacuccaucaaaaaaacaaacaaacaaaaaaacacacacacagaaaaacaaacaaaaaagcaauuauaauuaaauuugaguagaggagauagauaggaauccaacaguuauagaauagugccaggugcuaugguggagguaugcacaacucacuuaagaaacaugagaagggaccccgggagaggcagggucuuagugaagacuuucaagaaaaagugauacuuaacgcugaguagcaguugcccugggaacuggcucgaaauuggggagcucaagaaacagcagcaaguagugugacuggagagguggguuuuaccucggguguguggcagguaccugaucuuggagggcugucagaaacguuuaggaguuugaacuuucuuuuuguuguuguuuuuugggacagaaucucucucuguugcccaggcuggagugaaguggcaugaucucggcucacugcagccucugguucccggguucaagugauucuccugccucagccucccaaguagcugggauuacaggugcaugccaccaugcccugcugauuuuuuuuuuuuuuuguauuuuuaguaaagaugggguuuuaccauguugacuaggcugguuucaaacuccugaccucaaguggcccaccugccucugccugccaaagugcugggauuacaggcgugagccacugcacguggcugaguuugaacuuucucuguaaaaugccuuuuagggauuuuaagagauuagaaagauggguggcaagggaguaaaggguaguuugggagaagguggcugcagacugcaagacauauuaggaggcuguuguugcuguauaggagcgaggcaguggaguccaagggaacuaaggcauugccugugggaauggaggggagcagacagacaccaaaaauaccaaggacugugauuaacccaguuuugaugaucaguuagcugugaaggaggggaggggaggagagauggagaaaugacaccuugguuucuagcuauggagaaggauagauaaggguugaauaaggaauuccagagaagcagcagauuuuggagaaagcacauguuucuuuuuuuuuuuuucgucuuuugagacagggucucccucugucgcccaggcuggagugcaguggcgcaaccucagcucacugcaaccucugcccccuggguucaagugauucuccugccucagccuuccaaguagcugccagccaugcccagcuaauuuuuuaauuuuuaguagagacgguguuucaccauauuggccaggcuggucuugaacuccagaccuuggugauccgccugccauggccucccaaagugcugggauuacaggugucagcuaccacgccaggccuccggcuaauuuuuguauauuuuguagagacagggucuugccauguugcccaggcuggucucaaacuccugggcucaagugaucugcccaccucagccucccagagugcugagauugcaaguuuaauuuuggaccaccaaaaagaugaguccacauguagacccccacucuggccuuggugcucuaacaucuccauuucuuucuucuuuuuucuuuuuuuuuuuuugagauggaguuucgcucuuguugcccaggcuggagugcaauggcgcgaucucagcucgcugcaaccucugccucccagguucaagcgauucuccugccucagccucccgaguagcugggauuacaagcauguaccaccaugccuggcuaauuuuuuuguauuuuuauuagagacgggauuucuccauguuggcuuggcgggucucaaacucuugaccuuaggugaucugccugccucagccucccaaagugcugggauuaccggcgugagccaccgcacccagccuaacauccccaccucuuugaccauuucuucccuuguaacaggccugaggaccugaggucccuuuuuuccucagaagauaguugcuaccauucacuuuauaaccaggacucuuucuuaagccugggaggacagugggauguauccugccaggcccuuuccucuccuuuuguucauuguagacaagagacagagaaugauaauaaggauauaaacuugcuucacaagguuggcauccuuauccccuguuuuacagauaagaaaauggaggcuaauagaaauuaauuuauugaaaggcacacaacuaguaagugguagaaccuggacucuaauccagguucugacuccagaguuuucuaucgcuuuacuaccucuaaaacaagacuuaaccucagccaacuguaaccuuuuuggcauucuuuuuuuuuuuuuuuuuugauggaguuucgcucucgucacucaggcuugagugcaauggccugaucucggcucacugcaaccucugccuccuggguucaagcaauucuccugccuaagccucccaaguagcuuugauuacaggcucccgccagcaugcccagcuaauuuuuguauuuuuaguagagaugggguuucuccaaguuggccaggcuggucucgaacuucugaccucaggcgauccccccgccucggccuuccaaagugcugggauuacaagcgugaacgacugugcccggccacauuuauagcauucuuacggucccuucugagauaggaaguggaagccccaguggacuuuuuguuuguuuguuuguuuuuuaagacagagccucgcuguguccccaugcuggagugcaguggcacgaucucugcucacugcaaccuccgccucccgaguucaagugauucuccugccucagccucccgaguagcugggguuacaggcacaugccacuacugcccggcuaauuuuuguauuuuuaguagagggguuucaccauguuggccaggcuggucucaaacuccugaccucaaaugauccacccaccucagccucccaaaguugugggauuacaggcaugaugcuggagugcaguggugcuaucuuggcucacuacaaccucugacuccugaauucaagcgauucuccugggucagccccucgaguaucugggauuacaggcgcccgccgccaggcccagcccuccaguggacuuucauucccguuuguuauugcugagaguggagcucaucaaguagccccaagcucuuguagggaaagaaggcagaaagacuucucugugcaaagugcauuuucucacacggcacuuguaguaucuaguggaaaugucuuccuguaaacgguucauucaacagcgcuuacaguugacuagcugcaucccugauaacagacaaacguugcuguauggagcuucguccuagugggaggagagggauaaaaaacaagcauggccgggcgugguggcucacgccuguaaucccagcacuuugggaugcugaggcggguggaucacgaggucaggaguucgagaccagccugaccaacauggugaaacccugucucuacuaaaaauacaaaaauuagccgggcgugguggugcacgccuguaauccuagcaacucaggaggcugaggcaggagaauagcuugaacccgggaggcagggguuacagugagcugagauugcaccacugcacucuagccugggcgacagagugagacugugucucaaaagcaaagaaacaaacaaacaaacauguucacauaaggugucauuugaugagaagugcugugaagagaaauacuuagggauggaguauuguuacagaguauuucuguggccuacagguacagagaacaaucagauauguguaacgugugcacuuugaggagguggucuugaaaagaauuucagggauggcugggagcuugcucggggaagaauguucccagguaaagggaacagcagguucagaaggccuugagguaaacucauucuugagcuguuccaggaauagcaaggaugccaagcaugguuagagccuucugugcaaggggcacaguggcaggagguaaagucauucauucuuuuuuuuuuuuuuuaauuuuuugagacagaguuuuacucugucacucaggcuggacugcaguggcucaaugucagcucacugcaaccuccgccucggggguucaagcaauucuccugucucagcuucccaaguagcugggauuacaggcaugcaccaccaugcccggcuaauuuuguauucuuagcacaguuggaguuuuaccauguugaccaggcuggucuugaacuccugaccucaggugaucugccggccucagccucccaaagugccgggauuacaggugugagccaccgcacccggccaacuuucaguaaaaacuuacugagaucucaacuguuuuucaaucauuucugagauguacucuccucccccuuguuuucaucacauuuuaauaucuuugaaauugagaugcugcuuuuuuuuuuuuuuuuuuuuuugagauggagucucacucuugucacccaggcuggagugcaguggcgcgaucucggcucacugcaagcuccgccaccuggguucacaccauuuuccugccucagccucccaaguagcugggacuacaggcgcccaccaccaagccugacuaauuuuuuuuguauuuuuaguagagacgggguuucaccguguuagccaggauggucucgagcuccugaccucgugauccacccgccucagccucccaaagugcugggauuacaggcgugauccaacgcgcugggccgggaugcuucuuauaaauagaugguguaaucaccguuggccagguggcaguugugacauaguugucauuuccuguuuaggugugaaccugguuauaccuguucauguaaucaccccuucaguugagugcuacaguguuaaaauuaguugccauuuuaaaugccuuccaaacaauuacacuuagauucagcaaugaaagcaaguguuacuuuguauacagagaggaauggaaacaggaggugggguguccauuugcuguuucuaaagaaaauguuuguuguugggggagugaccacaauuccacguuucuuuucuuuucuuuuuuuuuuggagacagagucuugcucuguuacucacgcuggagugcaguggcaggaucucagcucacugcaaccuccaccugccaggugccagguucaagcgauucucgugucucagccucccgaguagcugggauuauagguguauaggugcgugccaccaugcccggcuaauuuuuguauuuuuagcggagacgggguuuuacucuuguuguccaggcugaucuugaacuccugaccucaaaugaucggcuugccucggccucccaaagugcuaggauuacaggugggagccaccgcgccuggcccaguuccauauuuaauugccaaacaccaccaagugaauuagggcagugguccccaaccuuuuuggcaccagggacugguuucguagaagacacuuuuuccauggguggugguggugggaggggaagggaugguuuugagaugauucaagcauauuacauuuguugugcuccuuccuuccuuacccuuccuuccuuacucuuccuuccuuccuuccuucccucccucucuccuucccuccuuccaccgcccgccugucucgcuuugucacccaggcuagaguacaguggcaugaucucagcucacuguaacuccaccgcuugggcucaagcgauccucccaccucagccuccugaguacuugggaccauaggcgcacgccaucaugcccggcuaauuuuuuguauuuuugauagagauagaguuuuacuauguuggccaggcuguucuugaacuccugagcucaagcaguccacccaccucagccucucaaagugcugggauuacaggcaugagccaccgcgccuggccugugcccuuuauuucuauuauuauuauauuguaauauagaaugaaauaauuuuacaacccaccauaauguagaaucagugggagcccugaccuuguuuuucuguaaguagacgguccaucuaggggugaugggagaaagugacagaucaucaggcauuggauucuccuaaggagggugcaauguagaucccucgcgugcagaacucaauguaggguucaugcucccauucgaaucuaaugccacugcugaucuugcaggaggcggagcucagguaguaaugcgagugauggggaguggcugcaaauacagauggagcuucacucccucacucgcgugcuugcuugguacuggucuguggcccagggguuggggacccccgcauuagggagcuucagagaggccgaaauccauaagugugugaagccaugucacauuuuguaacugaacauacaguuaggaggauugcauuucacacucaggcaaugcaaccuuaggucagagacacuccacauuccucagaaagaaauuucagggcuaugagagccugguguaacugaugacaacucuguccuugucuguuguucaggcauuuuguugugguuuaaugugccauauuuuguuucucuugguggugaaaaauaaugguacagucuacagucugacauauuugaugaaauauggucuauguccagcauuguucuagaccaugaggguacaccuguggacaaaacagaaaucucugcccuccugggcauucuggcugcugugaagagaauagauaaggaggaaagagcaaaagcagagagaaaggcggccaucgaaggagucccagggagagaugaugugggggccaccaacugggguuagugguugagagggggagaaagggucaaacacuagauggucagauacauuuuguggguagagccaauaggauuggguagugaguugcauguggaguaugaaagaguggaguccaaggugcagggaugaguuagguuaucaucgaguugauuguuguaacagagagacaugaaguggcagcugcuuaagccagauagauguuuauuucucucuaaauagaagucuggguaggaggccggggcugguauggcagcucugcgcucauuaggagcccaggugccuucugucuuguaccuacuuuccuaccauauggcuuccaucuuuuggcccuuguaugucugcauucuggccagagaggggaggggaggucaugugccucuucauggcacagcuugaaaguugcacagaucacuccuguuuaccucucacuggcuggaacccaagucacauggccacagcuacuugcugggaaggcugagaaauaguuuuucuugggcagccauguguucagcuauacguucucucacaucagaaagggagagcagucuaugccuuucuuuccaaacccuucucccgagggagacaaccccggaucaacuucagaguccagaaucccugggugauguacauuccaggaaucuuuaguuuaaaacaaaguuaucaggggcucugcugucccccauacagugguggagagguuaggauaauggaaguagaaaguccuguuuggaaaagggaagaauggggaguaauacucugcgcugguccauagccauugucagcuccugccaggcugagcugugagcgcuuccuccccuggcaguacugugagguucugaccucgccuuucuggcaaccuugauucuggucucuugaaggagcucccuugugccuggcccucuguagccucugacuuuauuuucuggagaguuuuucuguguuucuuuuccucuggggucagaucugaaguggacauuggaggcuauccuuuuuguagggcuaaacaguuucuccagcuugcuucuuguggauauugaaggaguaggcuuuuucaacccuacuuagccccaaauuaccagacucugaaaacuuugauuguagaccgcggacauuccucaggcagacuguauucccuuucaucuuugcaugcgaauuggcaagcuuuggcuugagucugcuucauguuugcaggacuucuuagccaguaagcaccaaauuuuguauuguucgaccaguuccccuagaauuacaggccauguuggcaugcaggcuguuuucuaagauaucacggguuuugccaaauguuuuauugugaucucugaggguugccauucuuccauccuacaguaucugugcccaugcugaccccuaagccaaugcugcauauuuguauuguuaagguugauuacuuccagcuuccagauucuguguauuaguuaggauauugauuugacugcuguggcagaggucggaaauaauaauggcuugaacaagauguugauuuuuuucuauuucaagugaaaaucuggguagguggcugagagcuggcuuaguaacuccaugccugcuagggggccagacucaugcuguuuugugcacugucauccucuagcuuauaggccaggagggcugcuccagcuucuuugaggaaaucugcaucccaguccuuaggaagggacucaagugggaggagagggcauguucuaucccauaagagcauggccagaaagcuucauauaucuuuuuuuuuuuuuuuuuuuuuuugagauggagucucacucuuugcccaggcuggaguguaguggcgugaucucggcucaccgcaagcuccgccucccagguucacgccauucuccugccucagccucccgaguagcugggacugcaggugcccgccaccacaccuggcuaauuuuuucuauuuuuaguagagaugggguuucaccacguuagcuaggauggucucgaucuccugaccucaugacccacccgccucggccucccagagugcugggauuacaggcuugagccaccgcccuuggcccauaugucauuacuuacaucuccuuggcuagagcuuagucuccuggccacacucaaaugcaaacaugguugaaugcauuuuauuuauuuuacuuuuuuagagacaagguauuuuuugucacccaggcuagaguacagugcagccucuaacuccuggguucaagugauccuucugccuuagucuccugaguaacugggaggugugugccacugugcccagcuaauuuuuaaauuuuuauuagagacgagggucucccuguguugccuaggcuggucuugaacuccugacuucaaacaauccuccuuccuuggcuucccaaggcccugggauuauaagcaugagccacugcauccguccugaaugcguuuugggaggcaacuagcuuuucuaccacagggauaccaggaauuuuggcuuaagcagcucaaaaaauggaauugucauuuacugagauggggaaaauugaaagagaagauugggagggagacguuaucaucugguuugaacauauuaugaauaugcugccuguucuuuguccauauggagaugugaaauagguuguauaggaguuugcaguucuugggggagguugggguuagggauacuaaucuggaaguugucauuguauuuaaaaucaugagaauggacagauuuuaccuagagagugagcauaaaugcggaagacaagaggacugagccuccauccauuccagcaauuaaagguugggagaucaggaggacucagaaaaggagacugauaaggaacagccacugagguuggaggacagucuagagagcauggaaucugguguccaggggaagaaaguauuucaugaugugggggaaugcucaacugugucuaauguugauaaaauuagaggaggaccaagacgugacuaugggauuuggcgacauggaggcccuugguuaccuugacaagacugauuucauugcugacuggagcaaguucaagagagaaugggaggagaggggagggagcucaggagugaggcguaggcuccaggggugcacugggaagccaucuguaguuggcagaagccauggguuuuagaggugacaggaaaauguggugagcuuaucuuuuucuguuuuaacuuuucccauucucugcuauaaucacuacuuucuuuauucauucaacacucuguuucucucucuuuccccaagggaggaaguaaagagguagagauauauuuguauaucauuccuagcaugagguuuugggccugaagaguuccaaauaauaaauuuugagacauaauauggggaacauuggaucauauuauaguuuuuagagcuuaaaaaaauaguugaguggcaaauauuucagaguaggagacuugaauauuauuuaauuuguuugcuuaauuucaacaaauauuuuugggcuuugugccagguacugagggcugacuauguggagaugcugcucgaauaugacgaagaccuggucuuuaccuucagugaccucaggcugcagcuggggacacaggaacgcaaccagcuagacuucaagugcuaaauagacauuucaguaaaggggguacgguugauggggcaguuaauucugauggggaauguagggaggggacugggaagauuugaauuagucuuuaaagaugacuaggauuuugacaauuagaacacuguagccagacgcaaugaugcaugccugcaaucccugcuacuugggaggccaaggcaggaggaucacuugagcccaggaguuugagggcagccugggcaauaucauaagaccuuuucucuaaaaaaaaaaaaaauuuuuuuaaauuaggaaacaauguuggcugggcauagugucucaugccuguaaccccagcaauuugggaggccaaggugggcagaucacuugaguccaggaguuugagaccaacuuggacaacauagggagaccccauauguccaaaauggcugggugugguggcaugcaccuguggucccagcuacucgggaggcugagaugggagaaucacuugagcccggcagguccagggugcagugagccaugauccaugucacugcccucuagucugggcgagagagcaaaagacccugucucaaaaaaaaaaaaaaaaaguuagaaaaauaagucuguggugaagagaaauguuucauuuacuucuuacucugggcaaauucuguuacauucauucuuuugaaauugaugauagaaauaugagaacauuggagaaaaacugaagauggcaaauaugggauauugguagcugcuugcugaucugaaaggcugguuuuuuuugagacagagucuugcucuugucacccaggcuggagugcaguggcgcucuuggcucacugcaaccuccacuucugggguucaagcaauucuccugccucagccucccgaguagcugggauuacaggcaugcaccaccacacuuggcuaauuuucguauguuuaguagagaccagguuuugccauguuggucaggcuggucuugaacuccugaccucaggugauccgccugccuuggccucccaaaguguugggauuacaggugugagccagugugccuggccugaucugaaagguuuugagauauaucaggcauagccaaaugugugaccccaagcucuccaaaaccacuaagggucugcagcagcugaaggaguaggugauagggagaaguuggaggaacgggaaagggguuucauuaaaaucacuucucuccuaacauuaaccacacugcauugaauuauuuauucacuugguguagcuccuacugggauaugaacuccuggcuauucuuguuuacugcuuuuuauccaaguucuggcacagggcuuggcacagaguggcucagaacaaauacuuguucaaugcaugaaugaaugcagugauacaacaugucuuuucaggacuccuauucuuuuuuuuuuuuuuuuuauagagguggaguuucacuauguugccauguugcccaggcugguuuccaacuccuggccucaagccaucuucccuccucggccucccaaaguguugagauuauaggcgugagccaccacaaccggccugccucccaauucuaguauugcaauaguuuauuuguuugcugcauuaaguuguguuaauuagguuaagguaggcacuugaugaaaaaagccucauuaucagaguucuaauucagagucagacauacuugcaggcuuuuuugguuguuugcuuuuuguuuugagacaggacuugcucuauggcccaggcuggagugcaguggcauuaucauagcucacugcagccucaaacuccugggcucagaugauuuucccgccucagccuccugaauagcugggacuacaggcaugccacuguuccuggcucuuaccuggauuuuauuuggagcaacaaauuggaugauucuggggaaaguacuuaaucuuucugagccucaguuuccucacuuauaaaauggggguauggaauaccaucucguagcacuguucuucagauuaauuggagugaugugaagugugcaugguguagugaccuggccgaguggauucuugggacaaguuaguucucaaaguaagauugaauuguguauaauuggaguuuuaguugguguccauauaacaucuaacaaaucuuuugcauauaauaaugccaacagcauaaauagugguaucuuacuaguuaagguagcaaauagaccguggcuuaugugaaagguuggguuggaauccucucccccgacccauuaguuccaaaaaucucuucucacccaggggccaucuuuuguauugagccacacugcuaccacuuuuucuaaaacguggagugauugguggccugaauguacuaagagggugaagguggaguguagagcuuugaaagggaaagaagagugugcagaaaggggacucgaggagucccaggagaaauguucugcauaucaggacuaaagaauacagccugaggugacacacuuuacucccaucagaugacuuauuuuugucuucugaaagaauuguaccccucccagcagggggagaaaaucucugaauuggaugucauuguauuaacuacucaacagcugcuaaaucuuuggcaucuuguccaguucuuuggcagcagugucaagacugggaaaagagguaucuuuuggguccuagauugagaagugacuuuaccuuucuaauuaaacaugacacauucaaugcauauugcuucuuuguucccugucagugcuugguauaaauucuagaugucuaauagugucauuuuuuuuuuuuuuugagacggggucuugcucugucacccaggcuggaguguaguggugccaucuuggcucacugcaaccuccgccuccuggguucaagcaauccuuccaccucagccucccgaguagcugggacuauaggugcaugccaccauaccuggcugauuuuuuaauuuuuuuuuuuguagagacagggucucacuauguugcccaggcuggucuugaacuccugggcucaaaugauccuccggccuuagccucccaaaaugcugggauuauaggcaugagccacugggccuggucaguggugauuuaauuaguuagauuuucugacuagaugagguagcacacugcuuuaauggacguuuuugggaauugaacuucuaagauguccggguagaucauauugagcacccaucgugccaggcacuccucaggaaucaugucugugaucauggucuuuuguuagaccugugucuauacuugucaccagggccagcuucacaggcaugugacugcaggcagaggugccccacgcuugguuuaaugcucugcuguugcugucuugaaauucuuaauacauuugaacaagguagccugcauauucauuugucauggggcccugaacauucuguagcuggucuugguugucauugacuuuuucuguguggguggauauaugccuggguagaugucguaguucauuuggacuauuauaacaaaaugccauaaaguggguggcuuguacacagcagcaauuuguuauucaccguucugcauucuggaggcugagaaguuccaagaucaaggugcuaagagauuuaguuucuugagagccaacuucuugguucauagauaccuguuuucucacuguguccucacuuggaggaaggagcaaaggagcccccugggcuuucuuuuauaagggcauuaauccgcaggucaucagggguuccgcccucaggaccucaucacaucccaaaggccccaucuccuaauuucaucagcgacccucccaccucagccucccgaguaacugggaccacagguguuuacaaccgugcauggcuuuuauuuauuuauuuauuuauuuauuuugagucggagucucucucuguugcccaggcuggagugcaguggcgcgaucucggcucgcugcaagcuccaccucccagguucacgccauucuccugccucagccucccaaguagcugggacuacaggcaugcaccaccaugcccggcuaauuuuuuuguauuuuuaguagagacgggguuucacugugguagccaggguagucucgaucuccugaccucgugauccacccgccucagccucccaaaguccugggauuacaggcgugagccacugcgccuggccuauuuauuuuuuauuuaauuuuuuugagauggaauuuugcucgucgcccaggcuggagugcaguggcacaaucaaguucugggguauaugggcuggauguguaaguuuguuacauagguaagcguguaccguggugguuugcugcaccuaucaacccaucacuuaguaacugaguccagcaugcauuagcuauuuuucuuaaugcucucccuacccgcugcauggcugauuuugaaaacuuuuuuuuuuugagacaaggucuugcuaugucacccaggcuagagugcaggagugcaguggcgugaucacggcucacuugcagccucgaccuuucgggcucaagugauccucccaccucagccuucuaaguaucugugaccacagguguugccaccaugccuggcuaauucuuuuauuauuuguagacaaggccucgcuauguugcccaggcuggucuugaauuccuggguucaagugauccuccugccuuggccucccaaagugcugggauuacaggugugaaccaccauguccaucugauauugaaucuuuagauaacucauuuuccuucaucaaaucuuuuuuuguuguugggguaguaauuagaaauauuagauuuuuuuuaaaaaaaaagacaggauuuuugacacauaaacauuuauuuccauauucuuuuuuuaauuuuuauuuuuguaagcuauuuuauuucuuccaugaugauuuagagggacuaucuucaaaccaauacaaauauuuuguaaguaauaucuggcuguuuucuaaccaauugaguaauuuguugcacaguaagccaccucacaucuuucagcaagaaauacauuaaauuugaauaguaaagacauggcauaaugaauuaggacacaauuaaaauuugcuuuaaauaguucuuugggcgaggggacaccacacuucuacucaaugaagagaaacauuuugacaguucagaggucuuuuauuuuuuucacaccucuuaugccaugaauucauagguaauagguuccagcagcucaggcuucuucccauugguucucacacagugugcuucucugguaccuuucucuuuggcuuucuucuuuuucugaucauuuuccuucaugaguuuuaggaaaugaugcuggccuuuagagcgcuuaaugugcucaauaugcauauuaauucucuuggcaagacuguugccauuguucauuuacuacaaugccagcagcaugcuggguaacauuguagacucuuccagucuagccaugguaacacuugcggggcauuuuuuuuggaacaguacccauucccuuggugucuguaauauuaucuuucuccuuuuuuuuuuuuuuuuuuugagauggaguuuugcucuuguugcccaggcuggagugcagugguguaaucuuggcucacugcaagcuccaccucccggguucaagcgauucuccugccucagccucccgaguagcugggauuacaggcaugcaccaccaugcccagcuaauuuuuguauuuuuaauagagaugggguuucuccauguuggucaggcugggcuugaacuccggaccucaggggauccaccugccucggccucccaaagugcugagauuacaggugugagccaccgcacccggcguguuuuuacuuugaacagauguccuugugccaaaagguuuggugauuucuaguuuagggaaacaugaauaaagcaucuuuuggcuugaaauguuaugauuagaauggguugugagugggagaauuuuaaugaaugccaauuggaacaaaugcuugugaaaaugucucguaggccaccuuuucaucauuuuuucuuuucuuuucuuuucuuuucuuuccuucuuuuucuuuucuuuccuuucuuuauucugagacaagaucucacuguuucccaggcuggagugcacuggcagcaucauagcucacuguagccuugaacuccugggcuccggugauccuccugucuuagccuccugaguagcuaggacuacaggcgugugcugccacacccagcuaauuuaaaaaauuuuuuuuguagcgauggggucucguuauguugcccaagcugguuuccaacuccuggcuucaagccuuccuccaccacacccagccaacauggggcaaaaguuaccagaaucaguuuuauggaauaguguuagaaguagugaaugcuggccaggcgcaguggcucaugccuguaaucccagcacuuugggaggccaaggugggcagaucacuugagaugaggaguuugagaccagccuggucaacauggugaaacccugucuuuacuaaaaauacaaaaauuagcugggugugguagcacgugcccguagucccagcuacuugggaggcugaggcaggagaaucacuugaagcuggggauggagguugcagugagcugagauugcaucacugcauuccagccuggaugacagaguaagacucugucucaaaaaaacaaaacaaaacaaaacaaaaccagaaguagaaguaguagaugcuuagucaucuacguuaaucuugucuguugaaccaaguaggaucaaagaugagaauggagaccauaccauccacuucuauccccugggauguuuuugguuauaaagggcauaaaguuucugcagcaggaaaccuucuuuaaauaacagaaugcaguuaaaauuauucuacacucagcauguuucucugccauguaauguuuggcaguuuuaggcucuugaucuuuuugguuucucuugcuccuaauuucacaauuagaugacacgugagaugcuuuuuagugcuuuuguacacacucguauuauuuagauaaagcagaacccuacacaaaggggaaacugagccuaagaggaagauuaaaagagcaaagggauggagaaaacugcuaggcugaaauuauuuuuuuaaaaaagacuauuuacugugugucaaguaaacacuuuucauuuguucagcaaauauuuaccgagugcucucugggaguuagguacugucauaguugcugggaauacagcggugaauaaacuagaccaaaucccugcucucuuggagcuuguauuguacuggguggggauaaacuauaagcugauaaauacauacuaauucuaguuguuuguuauauuaccuuuauuucugaugacuauuuuauaagauaagaaauauuuugucacuuucuuauaaauggggaaaucgaggcucagagagauaacccagcuggaaacaggugcagcugggauccuggccagcgcuagcuacgcgauugcucauuguguagagggcuugagaagauggggccugggguagcacuucacucacccauugcacauggucuggucucuguuucacuuucagguggacugcuucauucauuuauucaugagacaaggccucacucugccacccaggcuggagugcaguggcacauucauggcucacugcagccucagccuccccagcccaccucagccuccugaguagcugggacuacaggcaugugccaccacaccuggcucauuuuuguauuuuuuuuuuucuguagagaugggguuuugccacacugaucuugaauuccugggcucuggugauuggcccgccucagccuuccaaaaugcugggauuacaggugugagccaccacaccuggccccuuauuauucuaauuugaaguaauaauauuaauauuuuaaguauuaugggugacuuaagaaaacacuuuaauuaggcaguuuuaugccuuugguccuuaguucucaccagcuggcagaaugggguuaggcguguuuaacguucuucauguuaucaauuagaugcaaaaaacacaauuaacaauuuuuguuacaguuuauaaaauuccuuguauuuuaaaaaagauauaauuacugccuggcuuuggagaauuaaagggucgcaaccuuuuuuuucucccugagaaaauaccauuuacagucuuuucucuuuuuuuuuuuuuuuuuugagacagagugucuguugcccaggcuggagugcaguggcgugaucaugacucacugcagccccaaacuacugcacucaagcgcuucuccugccugagccuccugaguaggcacacaccaccaugccaggcuaauuuuuugauuuuuuuuuagagauggagucuugcuguguuccccaggcugguuucuaacugcugagcucaagcaguccuccccagggagguugaggcugcagugaguugaaaucguguuacuguacuccaaccuggcugacagaacaagacccugucucacagaaaaaaaaaaaaaagaaagaaaaaagaaaaauguauuuugcuaguaauugcuagaaguuggccuuuguaaguauuuugugcuuuauuuuugagauauuuacucaccugggaaaguucucaaggaggaggaaggugacuugccuugccugcauuccgguggcagggaagcaagcaugggaggcaguggaggguauguagguaaagagaggagaaggaacagcuggacugucggauguggggugaccuucucaggucauguccacacaaggacucuugugagaguaaaagggucucuguuacaauuaaagugggagugccaggaguacccugggcugaggccaggagccgacauggaugauccccuucuagaggugacguguuugagcuguagcggagugcuuggguaaaagcacuagauacuuuaggguuuugauuugggaguaaguccuggacauagucaugauauucuuuggagaagaaaugugguuaaucaaucaagcuuuuuguaacuguugaguaaacauuuuuugaguuggauaaguaaccuggaaagugaagcagaaaaugauuggaaaaaugagauugcagggugaccgugccauucuacccccgucuguuuccacucugucauauucauccuguaacauuucucuauugcuuggaagccuugguacuuuacuuguuagugcagacuuagggaagcuggccucacugagcuguuagguuuauauguguuaaaacuugugcuggagaaagugcacaggagccaggcagugaggcauggggugcuggguggugggccaggggcacuagaagcugggcaugggguacagagcugggggaguggugugcacugggagccaggcaguggggacucuggaaucacagugaccacagucagugcugcauccugagcccaccagcugccgccugcaggugggcaagggugccuggcaccuggagaagcacuucagcggcuggugugacacugaccugagccuucugggaggcacugagaaaugcuggcugugauuuugacaucugugucaccucagggcggaagacagcaaugccgacccccuggacaguauuggaugccacugaccagauguggcucccaguagugaugacuuggugcaccuccuggaguggcacuauaagggucugacuggccucaacaaagcagaagcuguugucaagaaccaugagggccagauaaagaucugcaugccggcugggcgcgguagcuugugccuguaaucccagcacuuugggaggccggggcgggcggaucacggaucaccuggccaacauggugaaacccccucucuacuaaaaugcaaaaaguuagccagguguggcggugggcgccuguagucccagcuacuugggaggcugaggcaggagaauggcgugaacaugggagguggagcuuguggugagccaagauugcgccauugcauuccagcccugggggacagagcgagacuccgucuuaaaaacaacagcaacaacaaaaagaucuugaugccucugauggagcugaacauuuauuauacagcaacagcagcaaggauugcuggugggcagacuacacuguagggcaccugcucuucuguaagagucugaaggacacuauugucagagcucugcccuuuuggaaugaagaaauaauuccccagauccaggaggggaaacagguguugguugaggcuccuggcagcagcuuuucuggcacagucgagccuugggaggcucucccggaaggggccaucauggagcugagccugcccacugguauucccauugucuaugaauugaacaggaggagcuugaagcccauugagcucaugcaguucccaggagacgaagaggcugugcauaaagccauggaagcguggcugcuuagggcaaggccgaggcgugaagggcggcagccgaucccuauccugacaacacccucccagucugccccauuccucuaugccucucaccuccacgugucacagugaccacagcuguaggcauccgaaguuguugagcguaucuggaggcucccauuuuaauuuuaggcauuuuuuuuuccacuccuuucacacaaucagaauggcaccucuggggcauaggucuucagcccaagccaagggaaggcuucuucuacccaggagagcugagggguggcaacucuggggucuuugcuagugcuuuguuuacuuguuuacuaagacccugcuugaguaggggauguggaggaaccaugcuaaggcaugaccaaugaggagaagcaagagagccuguuuguauuccugggagccaguccuguucuauucagucgucaggucccuguguguguguggaggggguugggaaagguuggggguagaugaauguaaccuacauggugauuuaaaacaagcaacuacagucaugcaucacuuaaugacagggauacguucugagaaacgcaucauuaugugaacacuauaggguauaguuacacaaacuuagauggcauagccuauuccacacguaggcucuauaguauaacuccuuggauacuuacgguauggccuagguauugcuccugggcuacaaaccuguacugcauguaacuauacugaauccugugggcaguuguacaauaacagugaguuuuuguguaucuaaacauagaaaaggaacaguaaaaauaugguauuauaaucuuaccggaccaccaguaagaucuggugaucugacauugacugaaaugucguuaugcagcccaugacuguauuuccucucugacuuccccaggagagcugguuccagaagguucggaugaguccugaauguuuauguauggcauuuuccuuuaccaaaacaaaacaaaagaaaauaaaaaccuuucugggguucuaguagccauugaaguacuccuaaguguggucaucagaaaauaagccauucuuuaacaccuugacuucuaacgguagagguucauuuugcuguguauuuuagaaucccuagugagcuagugagauucuggacaauuuuuuuuuuuuuggagccagucucacucuguugccuaggcuagagugcaguggugcaauuguagcucacuaggcucaagugauccuccugccucagccuccugaguaguuacgacuacaggcacgugccaccaugcccagcuaauuuuuaaaauuuuuuuguagagaagucaucuuacuaugcugcucaggccggucuugagcuccuggccucaaaugauccucccaccuuggcuucccaaaaugcuaggauuacagguguaagccaccgcaagaguuuguuuccaccuucuguuuucuguuuuuuuuuuuaucucaaaagacaacaagauauaaaugagaugcauuaaugcagcauacugcaaaccuacggcauacuuacuuguagaauuuguaguacuggaauccacccuuuaauaacgagguguaaaagggagcuaucagaagagaggaacagacaacuggccacauuucuguaauugugcaaaacaaguuuguuuguuuuuuugugagacagagucccugucacccaggcuggagugcaaguggcaugauuuuggcccacuacaaccuccguuuccuggguuuaagcaauucuccugccucagccuaccaaguagcugggauuacaggcaugcaccaccacgcccagcuaaucuuuuauauuuuuuauuagagacgggguuucaccaucuugaccagacuagucuggaacuccuggccucagguaauccgccugcuucccaaagugcugguauuacaggggugagccaccgcacuuggcccugagcaaguuuuuauggaggauugagugaagggcauugccugggagagucaucuuuuaagauuuuuugggguaagggaucuccuugaaaaucuugagggaauugaagguccuccuggccuucaugggucccaggauuuggaccccugccccagguauucucaacucuacccagaaaucaagccgcaccagcaaagcugaugcuuggaucucuucauuugggcuacucucaaacuuuuuccuuugaaucuuguuuugccauuaagcaucugcugauguugaggaguguugucaguuacuuacuguguugcuauacguguguagugugugcugaucucacuccuggcuuuaucuucuuuuuucuuuuuuuuuuuuuuuugagacgaggucucgcucuguugccaggcuggagugcaguggcgcgaucuuggcucacugcaaccuccgccuccuggguuaaagcuuuucuucugccucagcuuccugaguaucugggauuacaggcgggcaccaccacacccagcuaauuuuuguauuuuuaguagagacgguguuucaccauguuggccaggauggucucgauuucuugaccucgugauccacccaccucggccucccaaaguguugggauuacaggccugagccaccacacccggcccuauuuuuucuaccaucauuuugcuuguguccuaauuuccuuaucucuuugaauuaaacuuguuaauuuaauuaaguuaaauuaaaaauacauucgauguguguuuuuuuguuuguuucuuuugagguggagucucgcucugucgcccaggcuggagugccauggcacgauccuggcucacugcaaccuucaccuccuggguuuaagggauuuuucuuccucagccucccgaguagcugggauuauaggcaugagccaccauacccagcuaauuuuuguauuuuuaguagagacgagguuuugccauuuuggcgaggcuggucucgaacuccugaccucaggaggucugcccaccuuggcucccaaaguguuggggcugcaggcguaagccgcuguaccggccgccuuaaugcauuuuuuguuaaucacuuuaaaucuuuccuagaacaagaaaauaaugauagugaggccaggugcgguggcucacgccuguaaucccagcauuuugggugagugaggcaaguggaucaccugaggucaggaguucaagaccagccugaccaacauggccaaaccccaucuuuacuaaaaauacaaaauuagccgggugugguggcacaugccuguaaucccagcgacucgggaggcugaggcaggagaauggcuuguaccugggaggcggagguugcagugauccgagauugcaccauugcacuccagccugggaaacaagagugaaacuccgucucaaaaaaaaaaaaaaagaaaaagaaaauagugauggcgaauaaaacagauguuggggcugggcauacuuugggaggccaaggcagggggaucaccugaggucaggaauucgaaaccagccuggccaacauggugaaaccccgucucuaauaaaaauacaaaaauuagcugggugugguggcgcaugccuguagucccagccacuggggaggcugaggcaggaggaucgcuugaacccaggaggcagagguugcagugagcugaaaccgugccucugcacucccgccugggugauagagagugagacccuaucucaaaaaaacaaaaacaaaacagaugucggcaaccuguaggacauuuuugguuggguauucuuccagguaccucacacucaguaaucuaaucauaacccaucuucuuaaaaucuccuucuguauuuucaauuuuaggguauuuuaccauucauuuagguauccaggccugaaaucuagauuauucuucuuccucacuuuuuacuuccaaauaacagccaaguucuguugggaacacagaucaaguaucuccagagcugucccuuuccuaugcccauugcgcaggcuugcuuguggccugccuccauucguucuccacacaguagcuagagugauuuguuuuaaaagguacaucugggccgggugagguggcuaaugccuguaauuccaacacuuugggaggccaagucaggcggaucacuugaggucgucaggaguuugagaccagccuggccaacauggugaaaccccgucucuacuaaaaauacaaaaauuagcugggugugguggcgggugccuguaaucccagccacucaggaggcugaggcaggagaaucgcuugaaccagggaggcagagguugcaaugagccgagaccaugccauugcacuucagccugggcaacaaaaaugaaacugucucaaugaaaaaaaaaaaaaagaaaaguacaucuuaccugguuauuccccugcuuaaauccuucaaaagaugucuuucuugccuucacgaacaaguucagugucuuaggaugguauucacagcucgucaugagcuuguugcagcuugucuuucuugucugugccucaccauguccauacacacucauucuuaccaacuacucagcguucccuaaacagugugugugcucacaaagccucccaaucucugccggcgcuccuuuguuccucgucugccuaaccccuaccuguccugaaaaagaaacuuaagucaaguaguaagcacauagcauuuguaugugguucgauuuucaaaauugcucucugggaugauucaguuauuacaugaauauacaguuaguguaaaugaauuugaauccugaaaaccuaauauaagauggugaaaaaaaggugauacucuaugcacaagcaaacugcugaucgcaucuccgaggaauuguaguauuucuaugcauacgugcaguaaguaauagaacaucuuauugagcuuaagccaaaaaugggauuuauuuuaaggauacaggagucuucuuucugaaccuagggauagaaagauagcugggucacaggaagagacuggaaucaagaauccaggugcugccagggcuuccugugucugcaucauuaucauuacccuucaguuccacucucuaucaccucgucucuuugucacuuccuuuuccucucucaacagcccuggcuaguccaucucugugccuacuguguacugcuguacauggcuagagaaaaaaacaaaagccaugcuggugggucuaacuuuucccucaacuuucuauucuggacuuuuuuuuuuuuuuuuagauagagucucacuguguugcccaggcuggagugcaauggugcaaucucugcucacugcagccuccaccucccggguucaagcaauucuccugccucagccuccugaguagcugggguuacaggugcccgcugccaugcccagcuaauuuuuguauuuuugauagaggugagguuucaccauguugaccagacuggucuugaacuccugaccucaagugauccacccgccuggccucccaaagugcugggauuaaaggugugagccaccgcgccuggcccuaaaaauuuuuaaaucugcagaaaauuugaaugacucaccuagauucaucaguuuauuuuuuguuacauucacuuugucuguauauaaauguguguauauacaucuauacacccacacauacuuguugguuuuggcugaacuauuugaaaguauggagaaccacuaaagcagaugggaacuaggaggaaggaagggaaggcuucauugagaagguaacauuugagcaaagauccaggucagggagcaggauauagagcaguuauggggcaaguggcgggaggagcaugcgggggaggaaggcacagcuccacaauaagcaaccaccagugcccagcuguguguugaaggaagaggagaccgcuguacuucacuguauuguuguccacauauucaccaccccugucuggggaagguucuauuuccccacgcugcagggguaguuucggcccugugacuguuuuggccaguuaaaugugaacacaauugaaugugucaccgcugggccaguguggaguuugcucugccucuugcccuuugccugggcgauugcuaguguucccauuagaggcugcucuuucacccugggucuuggagugaagacguuauggagcagggcuacacuuucaucugaauguuuucccacgguagauguagugggaaauaauaaugguuuucauucuuuucaucagaaauucugugaaagaagaaagaugaggaaaaauggaaauuuacugugucauugccauuugcauuuauguauaauuugcacuaauaauaauguucauuauaauguaaaucuacauccuuuuaaaaaauaaauggaaucauuauguguacccuuuugcaaccggcuuuuucaauucaauuuuuuaaaaaauggaaaauacacauaacauaaaaauaugccucauuuuaaaagcaguagauaucgaagugaauauaacauauaucauuguuccccucccucccucccccccuccuucccucccccacuccuucccucucucccucucuaccuucguaccucccucccuuuguaccucccucccucucucccuuccuaccuuccuucccuuuuguuucuauuuagaggcagggucucacucugacaccccggcuggagugcagugguauaaucauagcucgcuucagccuugaccuccugccucagucucccuaguagcuggcacuacacaucgugugugccaccaugcccagcuaauuuuuuauuuuuugugggauuggggggggagggggucuugccauguuccccaggcugguuuugaacuugugggcucaagugaucccccugccucagccucccagagugcugagauuacaggugugagccaccacaucugaccaugaauuuuuuuuuuaaggaaacugaugaauuuuagaucacagagcugugauguuuggauguaaaugcauuuuuuggagaaacauuguugggcuuagauuaggccuacugugaaauugucauagcauuuaauaaguuucaaacauggccagcugugaaaaaagaaaauaaaaccaauaauaauacuaggaguuauuggccaggcagguggcucacgcuuguaaucccagcacuuugggaggcugaggcagguagauaaccugaggucaggaguuugagaccagccugaccaacaaggugaaaccucgacucuacuaaaaauacaaaaauuagccaggcauuuuggcaggcgccuguagucccagcuacucgggaggcugagacaggagaauggcaugaacccgggaggcagagguugcagugagccaagaucacgcuaccgcacuccaaccugggugacagagcaagacuccgucucaaaaaaaaaccaaaacagaacuaggaguuauugucaucuuuccaaggagacuaccccaaagagaaaguauuuccaauuauuuuucuuuauauuggaauucacuuuuuuuuaaaguagaaaaguaagacacuuuuguagaaugacuguuuauuaaacuuauaacaguguuuuguggguguuuuuccccacaaacugcuaaaaauaagaggaacaguuuggcccauccugucuuagcuucugccugcaaucacaauggccuucacuguuuugaaucuauuuuuaguucaucaggaacgugagggugggaagugcugcgucauauaacagauuaggagaaagcccuauuuuaaugucguuugugaaauaagaacugaaacagacaagaaaaacucuaggaaugagauuucaugauuaguauguguggcuuugaguugugguuuaggacacaaauugaggaauuggaaguucuuuauacuuuuuuuuuucucugugagauaggggaaaacaaaauucucuuaaaaaaggacuuuuguuuaacuuaaaggagauuaugccaguccuuuggguuaauguuaaaaaagucaaguaaacaaugagaaaaauguuuaaucauauuuugguguguugugacuauuuuuugguguguaucucauauguucuguuugugauaaaaagugagguugcaucucuuaguagucaaauuaauuagauacacuuuuuuuuuuuuuugagacccggcucucaccggguugcacagacuggauuuuauggcucucugcagccuugaccuucccagacucaggugauccucccaucucaguauuuguuguuguuguuguugagauggagucucacucuauggcccaggcuggagugcaauggcgugaucucagcucacugcaagcuccgccuccuggguucacgccauucuccugccucagcuucccgaguagcuuggacuacagguggccaccaccaugccuggcuaauuuuuuuguauuuuuaguagagacaggguuucaccguguuaaccaggauggucucgaucuccugaccuugugauccgcccaccucagccucccaaagugcugggauuacaggggugagccaucaugccuggccaguuuuuuuuuuuuuuuuuaagauggagucuugcucuguugcccagguuggagugcaguggcacaaucuuggcucacugcaaccuccgccuccuggguucaagugauucuccugccucagccucccaaguaccugggauuacaggugccuaccaccacaccuggcuaauuuuuguauuuuuaguagagaugagguuucaguaugcuggccaggccggucucaaacuccugacaugaagugaucccaccuaccuuggccucccaaaaugcugggauuacgagcaugagccacugcaccuggcacaguuuucuuuucuuuuuucuuuuucuuuuuuuuuuuugagcaggagucucgcucuguugcccaggcuggagugcaguggugcgaucucagcucacugugaccuccuccucccggguugaagugauucuccugccgcggccuccucaguagcugggauuaugggcgcgugccaccauaccuggcuaauuuuugguauuuuuaguagagaugggguuuccccguguuagucgggcuggucucgaacuccugaccucgggccaucugccugccuuggccucccaaagugcugggauuacaggcaugagccacugugcccggccaguuuuuguauuuuuaguagagccgguguuucuccauguugcccaggcuggagguaaaccuuuauaccugugauugcacaaagccauucucuugugaguccccuauccagauauucccagggccucagguugcuaaaccaguucaaaguuaacaccaguguagaaggcauucagaccacccaagggcauuauccucuacugagagcccugcugugggcagcccagaacgcugcccccugcauggcucuuccuaaauuuuccagcggaucuuuaagauggggcaaaauguauucucccaaucuucuccuacuccuucugucauguauggaccugccucugucucuuaacucuuucuuccugcuuaauagucugcaacaugcuucacaaagucuugauucuucaaccuuuuuugaaaccuuagaauccuuucuuucuucaaccgcauauuauagugagucagaacauuuauucucuguuuauaucacugaguagaacaucugaauuuaacaucuugggcugaacuuggcauugagguuuaaggugacuucauauuuuuuccaacaauaguggguaugcucuuccaaugauaaugauaacgucaacuaauaaauuagucaauuuuauguucagugcauuuuucuaguauuucucauuuauucagcagauauuuagagaguaccuaccaugugucagacacuguucuaggcacuggugcaacggaaguucuugcuuuuaagaaacuucaauuagggggaugguaacuaagcaauacacaaauaaauauaucacacaugucauagggcagaucagagccacggagaaaaaauaaguagggaaagggacaggguggugguuuucucacaacccuguaaggaagauacugguuuuuuucuuauuuuuuugagacggagucucacuucaucgcccaggcuggagugcagcggugcgauauuggcucacugcaaccuccgccucccagguucaagcgauucuccugccucagccucccaaguagcugggauugcagguguguggcaccaugccuggcugaucuuuguauuuuuaguagagacaggguuuugccguguuggccaggcuggucucgaacuccagaccucaaaugauccaccgccucggacuccccucggccgaugauuucauccccauuguacagaugugcaguguacggauguccauugugcagaaacugaagcagagagcuguuaagugacuuaucuggauaggcuccagauaaguaaaguagucaguaauaaagguugaauuugaauuagaaaucaagcaugaacuccuaaauuuagcugucuguaagauaaugaaacuuggcccggcaugguggcucacacuuguaaucccagcacuuuggggggccgagguggaaggauuguuugagcccaggaauuugagaccagccugggcaacauggugagaugccaugucuacaaaaaauuaaaaauuaggugggugugguggugcaugccuguagucccagcuacuugggaggcugagacaggagaaucgcaugaaccugggagggggagguugcagugagccgagauggugccauuguacuccagccugggugacaagagcgaaacuccgucucagaaaaaaaaaaaaauuacaugcuacacagaagacuauauuuaacauauaaacuaugaagaagaauaagaugaauacccaugaacugauuacucauaguuguaaguauacaacccagugaguuuucauaaaguggacauagcugugacauuaguauccaguuaaaauuaaaaaaaaaaaaaaaaaaccauuaccagaucccuagaaucucacuccugccucucccgagcugcuuccugccccuuucccaccaaggauaaccauuauccaaacuaaugguauaguuuaguuuuucuuauuuucaaauuuuauagaaauggaaucauccacucuguuuuuuuuacaucuggcuucuuuugcucaggggacauggguaaaucuguuaggaagcuuuuggagaugcccugcuguuaguaggaguucaacaaacacauuuugaaugaauggauuaauuuuucucuuucaauaagauguugcucuuuaauuauauguuaaaaggaagaaguggcagauuguauuuuuauugaaucaaguaaaaaaagaaaaucugaucauuuugcuccuacaagugaugguuaaauuugugucuuaguguaacuuuuguuucucauuguuuuagugaauuaaauuggcuauuuauucauuaauuuauuuuggagguggagucucccucuguugcccaggcuagagugcaguggugccaucucagcucacugcaauugcccuccaccucccgaguucaagugauucuccugccucaguagcugggauuacaggcacgcaucaccacaccuggcuaauuuuuguauuuuuaguagagacaggauuucaccauguuggucaggcuguucucgaacuccugaccucgugauccuccugccucagccucccagagugcugggauuacaggcgugagccaccacaccuggccaauuggcuauuuauuuuuaaaucuuaccuauuugaaaugaccaaguuaggucauuuuauuaaaauaacaacaagcuuuaguguguuacaagcauaggcugggcauggugcuucaugcccauaauccuaguacucugggaggccaaggugggaggaucacuuggggccaggagguugagaccagccugggcaacauagugagaccucgucucugucaaaaauuaaaaaaaauuaauuagcuggacauggugguuugcaccuguaguguuagauacuuaggaggccgaggugggaagauuacuugagcccaggaguucaaggcugcagugagcuaugauugaaauacugcacuccagcuugggugacagagagacucucucuaaaaugaaguguaauaugcuuaccguaaauucgccaugucagccaaggaggugugauaaacagagaugguaagggaacuaacauacaguauauacguauuuauguauguauuuauguauguaugaauuagagguggguugucacugcuuugcucaggcuggucuugaacuccuaggcucaagcgauuacccccaccucacccucccaaguagcugagacuauaggcaggcaccgcugaaccuggccaaaauacaguuguuaaaaacucaagugauagagcuuguaggaauacugguagagcgaguuauucucucagaagaguacuuuugcugaaggcauauugaguuguuaaacucugguuugguuaugaauaaugucauucucuggcagaauuguguuucugcugauuaguuauagaaugcccuuuuccccucauguuguagauucgacggaggcgccuugcacgacuugcugguggacagaccucucagccaaccaccccacucaccucuccccagagggagaacccuccggggccucccauagcggcaucagccccaggacccucucagagucuuggucucaauguccacaacaugaccccagcuaccuccccaauaggugcaucagguaagcccaagcuucauaccugggacucuuuuguaauucuucuuagcuuuuuguuaagcugaugguugugauguuuccagaacagauuaaaaugaagcagacaucagcucuuuaaaauccuccaagcaguaguuuaaauaucauugcaauguguuguguuaucgcuuuuuuuuuuauugcaaucuguuaaaccaauugcuuuucuuuccauaacuuccaucuuuuuuuuuuucaaacagguuuagguauuaucucugaugacaagaugauuaagacugaauuugguucugcugauuuuaugaauuugguugaugguuuuaagauaaaauaaucugaaaaugcaagauuaaaauaauggucaaaaugaacaccucuaauugcagauuuccucgucuucauucugcauuggcacagaacuuuuucuuuaacuuuucagaggauaaaacuaccugauaggauguuuagaacuaucucauuaaaaaguaaaaguuuauuucuuuauaauaaaugagcugaugcuugauauccaggacugucuuuguugggaaaugauauuucucauacuguguauuugaaaauaucucucuuuugucugugaacuuuucuaucaaauauaguauuauugucauauaauaauaauuacuauuuuauaauuaggauucuaguugcguaaagggggugcuaagagaacugcauugaucauaauaucaucuaauaauuugauagccuucugaaucaucugucuucuugaucuagaaucgugucaauuaaaaguauuugcagaguuuuuguugcuguacuucucguuagguaucaguguagacuauagauauauauaaauguuuauaccuaaugugguucaaccaaaacaucuguuaguaauaaagaagauccuugccuauaauguuuccucuguaugucucugagaagcucugauggucuucugguaggauugauggguucaggauuccaaaugugauuuuccuuggacacaguacugacaacagugcucuuugccucacccuggucaggccauaccuggaaugcuggaaucuguccuggagagaaccucucucacuuugucuuacuugcuuauuuaaaccaggaucuugguuaaaucccauuccccaccuacacuggaauaaggcuauagaaaaacucagaaccauuugaacuaauugaaaacuuuugaaaugucugucucauuucgaauucaugauuacauggcugggugugguugcucaugccuguaaucccagcacuuugggaagccaagguggguggaucaguugaggucaggaguuugagaucagccuagccaacauggugaaagcccgucucacaaaaaaaauacaaaaagccggguguggugcuaccugccuguaauuccaacuacaagagaggcugaggcaugagaauugcuuaaacccgggagguggagguugcaaugagccaagauugcgcuacugcacuccaaccuggugauggcgugagauucugucucaaaaacaacaacaacaacaacaacaacaucaaauucaugaucacaaacucggguagacccuugauacuggcaggcuguugcaccaugcuucccaguucacucacucugcugaucuguuucauaccuucucgagugugcaguaccucauucuccaugcucacucucucagcuaguggccuggcuucccauuucuuucuuucuauuuuuuuuuuuuuuuuuuuuuuuuggagaugaggucucacuggguugcccaggcuggagcaugguggcuguucauaggcgugauccuagugcacuacagcuuaaaacucccaggcucagaugauccgucugcuucagucucucauguagcugggacuauaggcaugugccaccacaccuaacucuggccucauauuucauugagaaaacagaugcaggcagaaccuaggcagggaaccuccaucagccucagucaucacauccaucugccuaccuguaugugcgccugguucuuguuaugcacaaauugucccugcugcuguugaagcuuggacccuagaucccaucucccuucaguuacucagccuucacuccagcaguuccuuucucucucuugcuucaucagauuuuccaucucauauggccuuuuuuuuuuuaacagccuauauaaugccauuacuuuucccaucaugggaaugaacaaaaggaacucucuugaucuaauucccccugccagcuucucccccacaucucugcaccaaaaccuuugcagcagaacuuccggaaugaguugccuguccucuccauccccuucugcccuugcacucuuugcugaaucaacugcagucaggcgaggguucccgugguugcucugugguugcucugagucacugucuggucugacccaucagccucauuagacauggcuuucacccacuucuccuggaaacacguuuuucuuuuggcuuccagaacagcacauucuccugguuuucaugcauucucuguaucuguuccuucuucacucuuugccugguuccuuuucauuucccugacuucuaaauguuaggauucaagggcucaauauuuaaccucuuguccuuuccauccagcuuuauucucuuacuguugucauccaguguccuggcuuuaauuacccucauuugaugauuccuaagcuuuuaucuccaacguggaccugcuccuugaaccucagauugacacauccagcgcuuuaccugacaucucugcuuggaugucuaacaggcaugucacagcuagcaugccccaaaucaagcuuugcuguugccucacauuuuaucuucucccagguuuccaucucaauaaaugacaauucauguuuucuagaccuggauuggcaaacucuuucuguuaagggccagauaguaaauauuuuuggcuuuggaggcugugagguuagaacuguuuaucucugcuucuguagcacaaaagcagccauagaacauauguaaaugagcaaguguaacuguguuccaguaaaacuucacuuacaaaaacaggcaguagcccagauuuggccuguggacuagagcuugcuuggcccugcucuagaccugucagaaaacuagaagcagaccagauucucaccaccuguuucuucucaucaccuccaccgcuauuacccagguccaaggcaccagcaucucuugccuggauuucuggaacagccuccuaacuggucaucucaugcccacccuugcuucacuugagucuguucucaguguagagccagaggggccccacuaaagcauaagugcaacacuguguaacagcccauaugcuguuaucacaaacuaacagaaaggcuugggcauucccuaaacgguuaguucuugcccggguaccucuaugcuaaguaguccugauuauguuucucacauagucaucauuauucauaaucacaaacaguuggauauuauuagccauacuuugguggguugaauaaacagauuuucaugauuuccuaaauaagugaaaaaacaaacagaaaaucucucuuaagacagguuacaucuauucucuguucaggccaggugcaguggcucaugccuguaaucauaauacuuugggaagccaaggugggaggaucccuugagccuaggaguucgagaccagccugggcgacauagcaaaaccccgucucuacaaaaaauuagcggggcgugauggugcacacauguagucccaguuacucgggaggcugaggugggacgauugcuugagcccaggagguggagguugccgugagcugugaucacaccacugcauuccagccugggcaacagagcaagacccugucucaaaaaagagaaaaagaaauuucaagaaaauaugauagcuguccguuaaagaguuuaaaaagcuggcaugaggaaggugauggcuuguguuuauuuucugugguccuggaaguuagacauaggucuaauggguagauuuauuauccaccgaaugugauugagagauuuuuguuccagacucaaaaagugcuucuuucuuucuuucuuuuuuuuuuuuuuuuugagacagucucacucuguugccuaggcuggagugcaaugacgugaucuuggcucacuguaaccuuugucuccugguuuuaagcaacucuccugccucagccuccuaaguagcuggauuacaggugcccaccaccaugccuagcuaauuuuuguauuuuuaguagagaugggguuucgccauguuggccaggcuggucucgaacuccugaccucaggugauccaccugccucggccucccaaaaugcugagauuacacacgugagcuaccacgccuggccaagaagugcuaacagagacaaacacuggguggggugccacccaugguaaaaaguccuucauccaggagugcuuggcagcagucauuugguggcccucuuaguugggcuguuuucaguugcaaguaacuaaagcaaggauugagaagcuguaggggguccuuccacuuccaguugcuucucccaucugcagucccagccuuuuuuuuuuuuuuuuuuuuuugagauggaguuucgcucuugucacccaggcuggagugcaauggcaugaucucgacucucuguaaccuccaccuucugguuucaagcuauucuccuaccucagccucccgauuagcugggauuacaggcgccugccaccacgccuggcuaauuuuuguauuuuuaguauagacuggguuucaccacguuggccaggcuggucucgaacuccugaccucaugauccucccgccucagccucccaaaguguugggauuacaggugugagcugccacacccagccuagucccagcuucuugcagugccaucugcuucuguaguuuccuagggcugcuguaacaaccuaucaaaaacuuuugaaggcuuacagcagcaguauuauuuucucacaguucuagaggcuagaaguccaaagccaagguguugguagggcgaugccucccaauaaggggagaauccuuucuucugccuuccgauaguugcuggcaguccuuggcauuucuuggcuuguggcaacauaacuccagucuucacguccgucuucacauggccaucuucguucugugugugucuguguccaaauuucccucuuaugacagccacuggauuagggaccaccguaauugaguaugagcuuauuuuaacuugcuuacgucugcuaagacccuccuugcaaacaggaguauuauuucuuuguuuuugaucugcaucuccucuucccuuugaauguaagguuaggcaggagccuugccaguguugcucauccccuuacccccagcaccgugcuuagcacauggcaagcagucuggaaaugccaaguguuauguggcuaaaugaaugaaagaaauauuucuuguuggaaauguuagaagcgaaguaagauuugaguucuuuugaaaaacagcuggcugacauuguuccucucaccacaaccagcuggauugucuguuuuuccugaugugcugagugcugagcagaauuuuaaaaauccucagucuauucauuuucuucuaaaauuagaaaaaaaguuauuauauaaaauauuucaaauguacaugauaacauaacuagugccuauggaaccaaguccacaggucauugcuguuccagacuugccauuccagauauuucuucauguuuuacugcauuguuauguggcacugcucuuggcucucuuagaacuuuauauauaugggugaugcuuuuccuacagaugaaugccacuuuuuuauaguuaacacugauuaugcuaguuuuuuuuuuuuugagacggagucucucucugucacccaaucuggaaugcaguggcacgaucuuggcucacugcaaccuccgucacccggguucaagugauucucccaccucagccuccgaguagcugggguuacaggugcgugccaccacaccuggcuaauuuuuguauuuuuaguagagacaggguuucaccauguuggccaggcuggucucaaacuccugaccucaggugauccaccugucucagccucccaaagugcugggauuacagaugugagccaccgugccuggcugauuaugcuacuuuuauauuuaaaauguagggcuuacugcaggucagacacaguacuuggucaugggaaugcaaagaugagugagacucaguuucuuuccuuaaagagcuuuuagccuaguuggggaggaaauguucuuucauuuccuguuuaauaucuguguuuauuaaauucuuuggaggacagucuaguuuucuuaguuucuuccccuaucuuuagaugauuugugauugcuuaaucuucagaacuucuuaacugucucggguuauuuuauuuuacagccuuguuuuggaauuaugcuugucuucucuuugauguuugccuaucaaacaucuugaguauauccaacgaaggccuuaaccuuccucgcuguugugaccucugaagaggaggucaugauugcucaagagucccccaacagauccuuuaucaaccauuuucaucuugacaggauuauuaggucuaguggaauaggucuuccaguggaauaggucugccuguauacucucuagagcuggcagguuucauuuuuguuuuucuaagacaaagucaggcuggaguacaguggugcgaccauagcucauugcggccacaaacuccugagcuuaagugguccuccugcuucagccucagaaguagcugagacuacaggugcgcgccaccaugccuggcuaauuuuuuaauuuuuuuuguagagaugaaguuuuacuguguugccuaggcugguuuugaacuccuggccucaagcgaucuuccugccucaaucucucaaaguauugggauuacaggcauggaguucuccauuguuuucauuccaugguucccuuuggcaaacuggggaagccuuugauuggcuucucaaaauauacuuuuauuauuauuuuuugagauggagucccgcucugucgcccaggcuggagggcagugacguagucugccucccgggcucaagugauuuuccugccucaaccuccugaguagcugggauuacaggcaugcgccaccacgcccggcuaauuuuuuguauuuuuaguagagacggaguuucaccauguugaccaggcuggucuugaacuucugaccucaagugauccuccuccauuggccucccaaagugcugggauuacaggugugagccaccgcacccgaccucaaaauuuacuuuuaaauguguauaauaaaauaggauuacacaauuauauaggaauauaauuaucaacauauuuuuaaagauuguaauacaguuauuuauaugcuucuuuauuaaugauuuaaaugaaagacuuagcaacuagucaaacugcuucagccccuugacaucuguuuccaucuguggaccacagguaaagauccucugcucugggagcagaaaugaacaguggggccucuuuggaacuagugagaagccagaugauauauuuggccucugggcuaguucuggggucuggaucagaaacagaauuuguuucuuuucuuuggcugcuaguuuuuaaccuacuuaaugauuauuuaacuuaaaauuauucuuuaacauguugacucaaauggucuucauccugcuuccauucaugcacuugaauaguuaauaaauggcuucugucuguugggcacuguauugagagcuagggaugcaggauggauaagucucaggggccuccaggggcucacuguuuagcaugagggcaugaacuugugaagaggugcagaugcugguguccuguacuugacagagaacagccacaaauagucacuuucucaggcucccggcuaugcauuguagauuuuuuuggagcauuuucacacaggcauuuaucugauugaaaauucuacuggcugggugugguggcucacgccuguaaucccagcacuuugggaggccgagauggagggaucaugaggucaggagauugagaccagccuggccaacauggugaaacccugucucuacuaaaaauacaaaaauuagcugggcaugguggcgggugccuguaauccuagcuacucuggaagcugaggcaggagaaucgcuugaacccaggaggcagagguugcagugagccaagaucccaccacugcacuccaguguggugagagugagaauccaucucaaaaaaaaaaaaagaaagaaagaaagaaagaaaauucuauguuggugagaguguaaauuuauauagccauuuuacaaaacaauauggaggucccucagaaaacuaaaaacagagcuaccauaugaucuggcagucccacugaguauauauccaaagaaauuaagauucauaugcugaagagauaccucuacucauguucauugcagcauuauuccaaauagccaagauauggaagcaaccuaaauaauccaucuucagaugaaugggaaaagaaacugugguauguauccacaauggaauauuauucagccuucaaaaagaaagaaauucugucauuuguggcaacauggaugaacuuggaagacaccaugcuaagugaaauaagccaggcacagaaaggcaaauauugcauguuuucacucauacgugggagcuuaaaaaguugaacucauacaaauagacaguagauggugguuaccagaggcuggggaauggggguggaugaagaaggagauguugaucgaaggguacaaaauuucaguuagaucagaggaaaaagcuuuagugaucuauuguacaggauguugacugucauaaauaauaacguuuuauauauuuuuuaaaauucuacuuuuuaaaaacaacaauauuauuauuauuauugagacgaaguuucgcucuuguugcccaggcuggcauacaauggcacgaucuuggcucaccgcaaccucuaccuccuggguucaaacgauucuccugccucagccuccugaguagcugggauuacaggccugugccaccaugccuggcuaauuuuauuuuugguagagacaggcuuucucuauguuggucaggcuggucuccaacucccgaugucagaugaucugcccaccucggucucccaaagugcugggauuacaggugugagccaccaugccuggcaaaacaacaguauuauuacuuuauauaauauagggaacaacauccuuccauauccuauuauaauugguuuuuuuauguuuuauuuugagauggucccacucugucacccaggcuggagugcagcaauggaaucucgaaucacugcugccucaaccucccaggcucaagugauccuuuuaccucagccucccaaguagcugggacuccuggcacgugccaccaugccuggcuaauuuuuuuuuuguuugaguuggaguuucgcucuugucaccuaggcuggaguguaauggcguaaucuuggcucgcugcaaccuccgccuccuggauucaagcaauucuccugccucagccucccaaguagcugggauuacaggcacuggccaccacgcccaauuaauuuuuguauuuuuaguagagacgagguuucaccauguuggccaggcuggucucgaacuccugaccucaggugggcugcccgcuucggccucccaaagugcugggauugccaccaugcccauccuaauuuuuaaauuauuugugcagacaaguucucacuauguuacccaguuugguuuugaacuccugggcucaagugaucuucccaccuuggccucccaauguguugggacuacaggcgugagccacuguuccuggccuauucuuaucccuccaaauuugcuugauauguuuuaucuauuuuauauguuuguuuauguugguuguuacauugauuuauugaaugcucuaaauucacguaggcuucacuuaauacauauuuauuuaaaucucccuaugcaguagguucuguuguaggcuauguggcuuauauuuuagugagagaaaacaauuuaaauacccagcugggcaugguggcucaugcccgucauccuagugcuuugggaggucuaggugggaggaucgcuugaacccagggguuuaagacuagccuggacaacauagcgagacguuaccucuacaaaaaaaauacacaaauuagccaggcaugguagugcgcaccuguaggcccagcuacuggggaggcugaggcaugagaaucacuugaaccugggaaguagagguagcagugagccgaaauugugccaugcacuccagccuggacaacagagugagacucugucucaaaaaacaaaaacaaacaaaaccacaaaaucuuucagaugaugguaauuauagaggaaaagagagcaguauguuggcauaaguaccacuggggguguguacauaaucacuguagguccuauuaagaaggcgacuuuuuuuuuuuuuuuuuuuuuuuuuacuuuaaguucugggauacaugugcagaacgugcagguuuguuacauagguacacaugugccauggugguuugcugcaccuaucaacucaucaucuagauuuuaagccucucaugcauuagguauuuguccuaaugcucucccuccccuugaccccacccucccccuauuaggccccaguguguugcuccccucccugugucccuguguucucauuguucaacucccauuuaugagugagaaugugcaguguuugguuuucuguuucuguguuaguuuacugaggaugguggcuuccaccuucauccaugucccugcaaaggacaugaucucauucuuuuuuacggcugcauaguauugcaugguguauauguaccacacuuuuuuuaaucuaucaucgaugggcauuuggguugguuccaugucuuugcuauuguaaauagugcuaucguguacaugugucuuuaugguagaaugauuuauauuccuuuggguguauauacccaguaaugagauugcugggucaaaugguauuucugguucuagaagaaugugacauuuuuagcagaggccugaaugaagugaguaagcaaaccaaguggauaucuguggggcaaucuuugcagacagaaggaaaacagaugcaaagguccuggggcaagaauggacuugccagugauugaugcaaggcagggcuagagcagucaucuucaauuuccccucauuuuccuucuccaauuuugagucuuuaaugaacauuaugauugcuuauuaguacaucuguaggaaugucaacaagaucaaagccauucuuuuaugguaaguugucuuuggcuaagaaugcuauccacaaugacaaugaaauucuaacuuugguccuaucauugauugcuauauuaaaauccuuuuuucuuuuuuuccucuucuacuugguccagagcuugggagaaagaauucgagggugguuaagcagcuggcuagaggcagaggcucagacagaagccccaaggccugagggcugcagcaggaacccuaaaaggcuacugaguucaggaggcuccuagaagagguugaaauccuuugcuuuuugcuuauucauuuuaauuaugaguuggaacagguguguccuaugcuggcauggguacuuccucgaauuggacuggccuucgggcccccaaagggguauguuuuauuaguucugggcuuuaucuuacagcauuauuccuagggucauacuaauuacuuugugaaucugguuaaagugcucaugauaucuuguucuugagacgugugcagugcugggaaucaauacacuuccuguuuugacuugggguugauucuugcacuuuucccuauccgcagcccccacccccugccccauuuuugcuaaccugguccugcaaccucugcugugcuuguaguuuuaccaacugccugcuucugacuccaaacugcccaguagcacucuccccacacagugggaugugaacugugccacgguacugcauggccuuugucaugugcccaagccuagcaaaggcacaggggcaaauacugugugugagagugauuucuauaccauguguuccugucccuuaaggaucuuauggcuuaguaggagagauaauacaugucacucaccugcuugaaagccuuccucgucuccuuauuuccaauuauaaucuaauccgagggcuugcaaggugcuguaucaucauguuccacccucuucauguaauucacuaucuugauuuucagagcauguucccuguugcugucccagucaacauauucaccccaaaaggccuauaaccaguagagaucgugccacacaaaccacucuuaguuuugggugcauuugucuggucuuccaaacuagauugaaagcucugaaaaaaaaaacuaucuuguguuucuaucuguugagcucauaguagguauccaggaaguaguaggguugacugcauugauuugggacuacacugggaguuuucuucgccaucucccuuuaguuuuccuuuuuuucuuucuuucuuuucuuuuuuuucuuuuuuuuuuugagaugucgucuugcucagucccccaggcuggagugcaguggugcgaucuuggcucacuguagccuccaccucccagguucaagcaauucuacugccuuagccucccgaguagcugggauuacaagcacccgccaccauuccuggcuaauuuuuuuuuuuguauuuuuaguugagacaggguuucaccauguuggugaugcuggucucagacuccuggggccuagcgaucccccugccucagccucccagaguguuaggauuacaggcaugagccacuguacccggccucucuccaguuuccaguuggaauccaagggaaguaaguuuaagauaaaguuacgauuuugaaaucuuuggauucagaagaauuugucaccuuuaacaccuagaguugaacguucauaccuggagagccuuaacauuaagcccuagccagccuccagcaaguggacauuggucagguuuggcaggauucguccccugaaguggacugagagccacacccuggccugucaccauacccauccccuauccuuagugaagcaaaacuccuuuguucccuucuccuucuccuagugacaggaaauauugugauccuaaagaaugaaaauagcuugucaccucguggccucaggccucuugacuucaggcgguucuguuuaaucaagugacaucuucccgaggcucccugaauguggcagaugaaagagacuaguucaacccugaccugaggggaaagccuuugugaagggucaggagauguucaccagccaagguugugugguucaguuucucuuuuguugauaagauuugucacuguuuugauaggggaugcauaauggaguauuuggauuuguuauuguaaacuaugcagcaugguuuucaaaaaacaacaacacaucuuuauaacuuuaaugcaacuguaaaggguuauagguuuuuuuuuaacaucaguucuaucauuuuacagagaaacugagguaguaagaacaaguacagaguucacuaacagcgugcauuugaugcagccaccauaaauucagaaaauauccucaaagcccuccuguauucagugacuuuuuuuuuucuuugagacagagucucgcccuguuccccaggcuggaguacaguggcgcgauuuugccucacugcaacgucugccuccuggauucaagcaauucuccugccucagccuccugaguagcugggauuacaggcacccaccaccacgcccagcuaauuuuuuuuauuuuuuauuuuuuauuucuuuuuugagacagagucucgcucugucucccaggcuggagugcaguggcacaaucuccgcuuacugcaagcuccaccucccugguucacgccauucuccugcuucagccucccgaguagcugggacuacaggcgcccgccaccacgccaggcuaauuuuuuguauuuuuaguagagaugggguuucaccguguuagccaggauggucucgaucuccugaccucgugaucuaucugccucggccucccaaagugcugggauuacaggcaugagccacugcgccuggccaauuuuuuguauuuuuuagcagagacaggguuucgccauguuggucaggcuuguguugaacuccugaccucaggugauccacccgccuuggccucccaaaguguucagugacuauuaaauaugcacugugaaauguauucuuaguuaucagggagggguugcaggggagaggaagugaccuuggauguagagauaaaugagguauggggggacucaaaaucccguuauaugcauauauccuuuuuagcuacaagaguuagguggauuauaauuuacauuuguuuguucauugugaguuguuuuuaacaaguaaugucaauauagaagcgucaguggauccauaggaauuacacuugugugauuauuugaaaugauagguugagagagaaaagucauucaacaguggugggauaagguucccucucucuuuucucuuuuuuuuuugagauguagucucacugucacccaggauggagugcaguggcaugaucucacugcagccucugccucccagguucaagcaauucucgugccucagccucccaaguagcugggacuauaggcaugugccaccacgcccggcuaauuuuuguaauuuuaguagacacaggguuucaccauguuggccaggcuggugucaaacuccugaucucggccucccaaagugcugggauuauaggcuugagccaccgcgccuggccuccccgucucuuuuuuaguacuuagguaugcuaaaaguggacaagaccagagcagauguugugguaacaaggcaaaucuguucuuuacaguggaguuugcccugauuucucauucuguucucgucugacgcauacagguguaucuauagaacuuguaaacacguucacauugguuuuuuucauuggcuccucaaaguagaacuaugaaguaggcugcacagaugccaguauuaccagagcauagguaaaaauauuaaguaagaagacuuaagaucacaaaacuagaaaugauggaacuggguuccaguccuaguuucuuuguaaaaugaacauuuauuuuggacuaacuuucaauguacagaaaaguuaugaagauaguauacaggauuccuguguacccuucauccagucuccccuaauguuaaugucugguucauuugucaaaacuaagggauuagccuggauaugauuuugacuaaacuaaacaugagucuccuuagucuccauuggucuacaacaguaucucaguucuguuuucaugaucuucacaguuuugaagaauacuagucauuacuuuguagaaugucccuuaauuuggcuuugucugguguuuugcucaugauaagacugggguuguggguuuuggggaagauuaugucacacaggugaagugcccuucccaucacaucguaucagggguauauaauauccacaugaugucccuggugcuguuaaacaucaucacaugcuugaguuagugcuggccguguuucuccacuuaaacuuaguauuuuucccuuuccauauucaguucuuugguaucgaguuccuaaguccaucccacacuuaaggggugggaauuaaacuucaccuacuggaguggggaaguacauauguaaucuggaauucuaugaggaaaacuugucccuucuccccugcuauguauuuaaucucuuagaucaguaugaacucacacacauuuauuuuauacuuuggguuaugauuucaguagcaacauuacuuauuuuacaggaauuauuccagcuuugaccaugggagcucuuucaaguuggauccuugguccauuugacaugccucuucuuuuauauuuuugagcacugucuuucuagcaccguaugaugcucuagacuuaucuuggauuuuuccugccccagcccuagaaaucagccaguucuccaaggagcaguccuggucuacugacuccagauguaugauucuaugcaugauucugccuuuugacacuaaggagaggaauauucugucuuguaaauaugaagaucaaagugauuuucuaauuccggcuguugguuuucuuaucccaguauuuaagauaccauuguuguucuucacagacuugaaaugucauuuuauuuuauuuguuuuuuaaauuuauuuuauuuuuuuuugagauggagucucacucuguugcccaggcuggcgugcaguggcgcaaucucacugcaacuuccgccucccggguucaagaaauucuccugccucagccuccugaguagcugggaucacaggugcccgccaccaugcccagcuaauuuuuguauuuuuaguagagacgggguuucaccauguuggccagguuggucuugaacuccucagcugauccaccugccuuguccucccaaaguguugggauuacaggugugagccaccacgccugaccguauuuuauuauuuuauuauuauuuuugagacagguucucccucugucacccaggcugggggacagugacgcaaucauggcucacugcaagcuugaccucugggcucaagugauccuccuaccucagccuccugaguagcugggacuacaggcuugcaccaccaugcccaacuaauuuuuuuauuauuuguagagauggggucucucuauuuugcccagguuggucuuaaccuccugggcucaagcgauccucccaccucaaccucucaaugugucgggauuacaggcgugagccaccacacccagcccacuuuauuuuuguuuagucacaagaacaaaauguuuucuuuuuuugagauaaagucucgcucuauggcccaggcuggagugcaguggcgcgaucucagcucacugcaaccucugccucccagguuccagugauucugcugccucagccucccuaguagcugaaacugcaggcaugugccacugcauccagcuaauuuuuguauuuuuaguagagacaggguuucaccauauuggccaggaugguuucgaucucuugaccucguaaucugcccaccuuagccucccaaagugcugggacuacaggcaugagccaccgugcucagccaagaacaaaauguuuuuaucaggaaauuagcugcuaagaaaaugucagucugcucuaugaaauagaauauguuuauuauaaucagcauugaggcagaagucugaagcaggaggaucauuugagcccaaguuccaggcugccuugaacuaucaucuugccacuguaccgcagcccagguaucacugagaacaugucucugaaaaaaaaaaaaaaguuuucaggggugagacuugguguuaaccaaauaaagugcaaguauacuuuguauuuuccgugaauauuaacgcuuuagcuuaauucauugucaagagcuauauaaauaagcuuuaggauuuugauuaauagaauuaaugacuccuuuuauaaaccuaauuauuuuuaaguuuuacuuuuguaauuuuuuuuuuuuuuuugagacggagucucacucugucuuccauccuggagggcaguggcucaaucucggcucacugcaaccucugccugcaagguucaagcaauucuccugccucagccuccugaguagcugggauuacaggcgugcaccagcaugucuggcuaauuuuuuuuuguauuuuuaguagagacaggguuucaccaugguggccaggcuggucucgaacuccuugauccgcccaccucggccucccaaagugcugggauuacaggcaugagccaccaugccugguugcuuuuguaauuuuugaguguauaaaauagguaacuuuguuuuaaaauauuugauccaaaggacuguucagcagucugggguaaaggaauuacagcauuauguuaggaaucaggcagccuguguguguguguguuuuuuuuuuuaggcaugguuucacuuuguugcccaggccgaagugcagaggugccauuguggcucacugcagccucagccuccugggcucaggugacccaccccccucagcuuccugaguaggugggacuacaggcgcauaccaucacgcuuggcucauuuuuguauuuuucauagagacggggucucccugugucacgcaggcuggucuugaauuccuggacugaagcgaucuacuccaccuuggccuccaaaaguucuggaauuauaggcgugagccaccaugccuggcugagaccuguguuuuacucuuugcucuguuucuaacaggcgaggagguccuaagggaaguuuuuagacucuguagaccuagauauucuuaucuguaaaagaggagggaagaugguuggccauuaccuuuaagaccaaugcccccaacaaaacagauuuauugaggcguuuugguuuuuuaaaaaauauguuguagagaugaugucucacuauguuguuuaagcuggucuugaucaagcgauccucuugccucgaccgcccaaucuguuggaagaacagguaugagccaccacacuugaccuuuuauugagguuucaaggacgcuuuugacaauucugugcucuuuuuacgguggaauuuagaagccuaugcauuuguguguguguguguguguguguguguguguguguguguaauacuggaacaggccuaauguuacaaguuaaagguagauauuuggucuaguuuguacuugaaagggaacaucauucaggaaauauuacaauacuaggagaaagucuuacagacaugaaauuuuuauguccuuugauguucugaucuucccacauagaaugcauaauuuccuuuagcaaacucuucucaguuauagaaguuggauacugccgccuagaagguugcuaauuccuguuuccugaagcagacauagcuuucuccauucuguguuacacaccucacuuguggaagguuuguucuauaguugauauguggggaguuuauucaucuucuaaaagaggguuacagcagauuauguucauuuuuuaauucuuuaauaucuggcuuugugaagaugaaggaagaaaaaaccuguauuccuugagacuuggcuuccugaccaugauuccucaaguuuggggugggagagggcaugaagacaagggagugugugagguuugaaaacagugauauuuuguacuauugauuugauguguuuuuagucgcaauauuuaauucacauugauuucuaaauaaaaucaaagacaccaucagguuuuuguguguguccuuuuuuuuuugacacagggucuuaaaaaagacccaucuguugcccaugcuggagugcagugguaugauuauagcccacugcagcuucuaauuccugggcucaagcaauccuuccaccucacccucucaaguagcuaagauuacaggugcaugccaccaugccuaauuuuuauuuuuuuuuuaagauggaguauugcugugucacccaggccgcagugcaguggugcgaucuuggcccacugcaacuuccaccaccuggguucaaacgauucuucugacucagccucccuaguagcugggauuacaggcucccgccucugcgccaggcuaauuuuuguauuuuaguagaaacaggguuucacuauguuggucaggcuggucucuaacuccugaccucaagugauccacccgucuuggccucucaaaagugcugagauuacaggugugagccacugcgcccggacuaccugacuaauuuuuuaaguauuuuguagagacagggucucuguguugcccaggcuggucucaaacuccuggccucaagugauccucucuccuugacuccccaaaagugcugggauuacagaugugaggcacgacugaccaucaguauuuuaaauuuaagaaaggagagaaauggguuaugguggcauauguucuuuguuucagcuacucagaagcugaggcaggaggaucccuugagcccagaagguugaggcuacagugcccuaggaucacaccccugcacuccagcccuggccaacauagugagacccaucucuuuuguuuuguuuuguuuuugagacagaaucuugcucugucacccaggccggagugccguggcacgaucuuggcucacugcaaccuccgccucccagguuaaagcgauucuucugccucagauucccgaguagcugggacuacaggugcaugccgccacgcccagcuaauguuuguauuuuuaguagagacagaguuucaccauauuggccaggcuggucucgaacuccugaccucaugauccgcccgccucagcucccaaagugcugggauuacaggcgugagccacugugccuggcugagacccauuucuuaaaauaaggaggccaggcaccguggcuuaugccuguaauccuaacacuuugggagacugaggcaggugaaucaccugaggucaggaguucaagaccagccugacaaacaugguuaaaccccaucucuacuaaaaguacaaaaauuagcugggcaugguggcgcaugccuguaauccuagcuacucgggaggcugaggcaagagaguugcuugaaccugggagauggagguugcuuugagccgagaucgugccauugcaccccagccugggcaauaagagugaaacucuaucucaaaaaaaaaaaagaagaaagaaaagaaaagaaggaauggaguccccugguguuuagagauugaggagcacuuguauacauaauaaauuguugcagaauugccccacuugauccgaaaugugaagaucauguggaagaugcaggaaaaaaugaauucagaugaucucuuugaugccuuauaaaaauauuacaaaugcaguauguuacacuaugugauauacacuggagcuauauugcuacaguauuauuguacacauacuauacuauacuacagauacaguuuuuaaaacaauuuguaauuauguguuuaauuuuauaacuuguuuuguaggguagaaauuuuaaagccugcuuauuuacuaccauaaugaucauugaaguuuauuauugauuaauuuuaacuaaaaaguuacuuggccuuuaauugugauagguaaaauaauauucuccuaagaaccuugugaugguguauuauuuauuccuucaauaaguauuuuuucagggcuuacuuuggguuauauuuccugaaauuaaugaaucaaaaguuuuacuguauucugugaacuuguuucagaauucucacuacgguagaugcuuuguguauuuuacuugaguccuaggaagagagaaaauuuaguuucuuauuuccuucauaaauccugcagaaguuuuaauaaauuaguacaugugaagaacugcuuucaggaauggauaaauguuuuauaauauucuucaaugaagagaaacauuaaaaaguggcaaguuuacugucauagaaugcuggaaggguuaaaauuguauuuauucagugauuguuuucacuacaacggguaacucaaguuucucuguuuucuuuuuucauacuuuuuuuuuucuuuuuuuuuugagacggagucuugcucugucacccaggcugcagggcaguggggcgaucuuggcucacugcaaccuccgccucccaaguuaaugcgauucuccugccugaaccucccaaguagcugggauuauaggagugggccaccacgcccagcuaauuuuuguauuuuaacuagaaacaggguuucaccacauuggccaugcuggucucgaacuccugaccucaaaugaucugccuuccucggccccucaaagugcugagauuacaggcgugagccaucgugcccagccaaugguuuuuuuaaacaugugucauuuuccuuuucagcaccauagguauauauauuuuaaaguauuugcaaaugccuggguaaacauucuucuuuuuucauaggaagauauucauagaguuaaaguaauuuuuaaaauuucaauguaaaacaugauuuuaaagacauugaugggaaauugcugugagaaaucaucugucccuguacuagugacuacaguuucacuguacugucagcucugugagggcaacaaagugucagguuuuuaauuuccacuaagguguucaaucaauaaauggaucgaucuauaucaaaggacauuguugaguccacuugaauuuuuuuuucaauauuuuacuauaaaaauuguaaacauacaguaaaguugagagaauuuugcagggaacacccguauacucaccaucuagauucuaucauuaacuuuuuuuuuuuuuuuuuagacggagucuugcucuguugcccaggcuggagugcaauggcgcaaucuuggcucacugcaaccuccgccucccggguucaagcaauucuccugccucagccuccugaguagcugggacuacaggcgcccgccaccacgcccagcuaauuuuuuuguauuuuuaguagagacgggguuucaccauguuagccaggauggucucaaucuccugaccuugugauucacccgccucgaccucccaaaauggugggauuacaggugugagccaccacacccagccucauuaacauuuuauuauacucgcuuuaucacauauuuuucuauagguuuauuaauauauccuuuuauuguuuuugagauggagucucgcucugucaccuaggcuggagugcgguggugugaucuuggcucacugcaacgucuuccucccagauucaaaggauucuccugccucagcuuccugaguagcugggauuacaggugcccagcuaauuuuuguauuuuuaauagacaugagguuucaccauguuggccaggcuaaucuugaacuccaaaccucaggugguccaccugccuuggccucccaaagugcugggauuccaggcaugagccacugcaucggccugguuuauuaauauaucuucuuuugggcgcauuucaaggauuuuucuggacuaucauggaaguuaauuuguauuucuaauuuguauuugugggccauaguuugaauuggugcaagagaggugaugaggggugaguuuuaggcauuagauguagcucuguuacugaccucauaugaaguauauugauaacuuaugauuucuuaguaauguuccuaugauuuuauuauuguuuccagcuuuuuauauaaucuucugauagaaauuccucgguugcugcaaugucaugaugggugacugcagauugugcguguuuacugucgcuauuacaaauaacuugaacauuauuucacauggggcuucauccuuccuguguuuucuguuuaggaguagcccaucgaagccagagcagugaaggagucaguucucucagcagcucgcccucuaauagccuugaaacgcaaucucagucucucucacguucccagagcauggauaucgauggugucucaugugagaaaagguaaaaugaagccaguuuucuaauaugcucuuuuauuuagggaaagagaaagauccauucacuuuagccucuaguccauagucagaaaugccagcuagagacccaugccaguccuuagcaaauuagugucaaauguauuaaauuuaaagauuuuguauuauucagaaauauucuucauacuuuuguugcuguugagacagaguuucacucugucgcccaggcuggagugcaguggugcgaucauggcucacugcaauuuccgccucccagguucaagugauucuccugccucagccaccugaguagcugggauuacaggugugugccaccaugccuggcuaauuuuuguauuuuuaguagagacaggguuucagcuguuggccaggcuggucucaaacuccuggccucaagagaucuuccugccuuggccucccaaaggacugggauuacagguaugagccacugugcguggcccacuauacuugcauauuaaaugucuuuuaugaaauaaugguguagucaguuaaaaaaaaucuauuguucucauuuuguaaauauaaaguuggcaagcauaugccucucccuaaaacuuuuacuaauuagugaaauuuaaaaguuuggaauauuucauacagguaagccaaauaaauacccuauuugcuucguacggaucaaggugucuugaaagagcccuccuguguugcauaugugccaaaaaugggugguaagaguggcugagguauugacuccuuucaugguugagcaagucagacuccuuggaccuggcuccucuccccucaagcaguggccucgguuugugucagugggcuaaacagaugaagaggggaauuaaguccgggcucgauggcucaugccuguaauccuagcacuuugggaggccgaggcagguggaucacuugaggucagaaguucaagaccaaccuggaaacccuguugcuacuaaaaauacaaaaacuuagcugggccugguggcaggcgccuguaaucucagcuacuggggaggcugaggcaggagaaucacuugaacccaggagguggagguugcagugaaccaagauugugccacugcacuccagccuggccgauagagugagacuccaucucaaaaaaagaaaaaggagaauuaaaaauaugaauaaggggcugggcgugguggcucacgccuguaaucccagcacuuugggaaacagagacauggaucacuugaggccaggaguucaagaccaaccuguccaacaucgugaaacuccgucucuacuaaaaauacaaaaauuagcugggugugguguugcaugccuguaguaccagcuacuugggaggcuaaggcaggagaaucacuugaaccugggagguguaggcuacagugaacugagaucacaccacugcccuccagccugggugacagaguaagacucugcaucaaaaaaaaaaaaaaaauaauaauaauaauaauaaccaaauagaauaucuagaaaugaaaagguaauuuacauugagaacuugcuguaagaguuaaauagggguuagacauagcugaagaaagaauugacaaacugaaagagcugaggaaauuacccagaacguaccacaaagaacaaagcagaugaaaaauauaaaagauauuuagagauacagaggacagaguccuugguuucuccugaaauguaucuaggauugaaauuucuggguagaaaauuaaaauuguagugaaugcagauguucagcuuuaaaaaagaaaaaaaagacaacagggguccaggauauaucuaaacaucaaaaagggagaauagagaguuggagagauuuccuucugcucacucuuauuccacauuuuuuucucuacugguuugaaagauauuauuuuaaaaaaucaggccaggagcauuugaaagauauuauuuuaaaaaaucaggccaggagcaguggcuuacgccuguaaucccaucacuuugggaggccgacgcagguguucacuugaggucaggaguucgagaccagccuggccaacauguugaaaccccguaucuacuaaaaauacaaaaauuagcggggcaugguggcauguaccuguagucccagcuacuuuggaggcugaggcaggagagucgcuugaacuugggagguggagguugcugugaccugagaucgcaccgcugcacuccagcuugggcaacagagugagacuuugucucaaaaaaaguaauaaauaaauaaacacaucauggaaaauuggguguccauuuccucaagcauuuguccuuauuuuuuuuggagacggagucucacucugucucccauacuggaaugccguggcacaaucucggcucacugcaaccuccgccuccuggguucaagcaauucuccugccucagccucccgaguagcugggauuacagacaugggccaccacgcauggcuaauuuuugaauuuuuaguugagaugggguuucaccauauuggccaggcuggccuaaaacuccugacuucaagugauccacccgccucagccucgcaaagugcugggauuacaggcgucuuauauuucaauuaaguuugcuuuaaaauaauacaauauaauauaaauauaguauaucaugaucaauuuaggcuuacuuuaggaaugcaaggaugcauugauauuagaaaaucuauaaauaucaucuaccauauugcauguuaaaaagaaaauccuuauaauguugguagcugcaagaguuugauaaaauuccacauuaauucaugguaauaagaaaaugaggaacagaaaggaguaucuuuaaacucacaguguggcacagacaaaguucaccaaauauuccacaggcuccccagaauuucccauucucuuuuacaguuagauuggggccaaugacuaguucuguccuguagacuaugaacuagagugacgugucacuuuuagaugaaggcaguugagccaauguuccuccuccgucccucucuucucuugcuccagugaccuuggaggcuguguauugcagauggcauagauuaaagauggaguaaggaugcuucacucucaucagacuuuguguaagcaagaacuaaauccuuacaguguuaagccucuuaagauuucagaguguauguguuacuacaguauagccugucuuacucuaacuaauauaaagggcaucuaccaaaaaacuacagcaacucuccuauucaguggugagaaguuagcaucauuuucuguaaaaucagcaauaagaacaaggaugacugcuauuucuucuuguauuuagcagugcaguaaaacaaguaaggauuggaauggaagaaacaacaguaauaauuugcagauaaauuauuuacauguuggcugggcacaguggcucacaccuguaaucccagcacuuuugggaggccgaagcagacagaucacuugaggucaggaguucgagacaagccuagccaacaugguaaaacccuguuuccacuaaaaauacaaaaaaaauuagccgggcaugguggugcgugccuguaaucccaguuauuugggaggcugaggcaggagaauugcuugaaccugggaggcagggguugcagugagccaagauugcaccacugcacuacagccugggugacagagcaagacucugucuaaaaaagaaaaaauuauuuacauguaaacuuucuauguauaaauaaauaaguugcuuauaagaaguguauauuuaaaaucaguugcauuccugucugccagcaacaaaaaguuagaaaacguaauuuuuaaaaaggugccauucacaauuucauuaaaaaguauuaacauaugguaccuaggaauaaauuuagcaaaagaaguauaaaauuuuuauagagaaaauuacuaaagcuuauugauagaccuuaaagaagaucuuaauacuuggagaguaaugaaaacucaguaauauauuacuucuccccaaguugaucucuaagagugaaaaaaauuuuggucaaaaucccgggaggguuuuuaaggaauuccucaggcugauuccuaaguauguguagaagaggaaagagccaaggauagcaaaaccucuuaaaggagaagaauaaaguggagacauugaccuagcagauaucaagauuugugaaguuuuaguaauuaagacaaagugguauuggccagggacagacaaauugucuaacagaacaguaaugagucuccagaaauagacccacucguuaaugaaaauuggacacgugacauaggagcuuucauauuaauguaaaaaggaugaucuuuccaguaaauggugcuagggcaauuguucaaucggggauaaaugauauguacuuaaccaguuuuuauaauaagacuucaguugaguuuuuuauuuucuuaauuaaauuuuuuauuuuuauuuuuuauuuuuuugagauggagucucgcucugucgcccaggcuggagugcaguggcgcagucuuggcucacugcgagcucugccucccggguucaggccauucucccgccucggccuccugaguagcugggccuacaggugcccaccaccaugcccggcuaauuuuuuguauuuuuuaguagagacggguuucaccauguuagccaggauggucucgauuuccugaccuugugauccgcccaccucggccucccaaagugcugggauuacaggugugagccaucgugccuggccuauuuucucaauuaaauuuuuaaaaauguuuauuuaauuuuuuuuagagccagagucuugcuaugcugcccaggcugggauacagugguuauucacaggcacaguaauagugcauacagccucaaacuucugggcuaaagugauccuccagcuucagccuccuagguagcucggaccauaggcgcaugccaauauaccuggccugguugaauuuuaugucauuuuaaaauacuauauauagguaaccuacuuuaaugauauacuuuuauuuauuuauuuauuugagacggaguuucgcucuuguugcccaggcuggagugcaauggugcgaucucggcuuaccgcaaccucuguguccugaguucaagugauucugcugcaucagccugccgaguagcugggauuacaggcaugugccaccacgccugacuaauuuuauauuuuuaguagagaugggguuucuccauguuggucaggcugaucucgaacuccugaccucaggugauccaccugccuuggccucccaaagugcugggauuacaggcgugagccacugcacucggccaaugauauacuuuuaaaaaguaagcccaagaaaaugacaacuuaggaaaaauauuuccaacauguauaagagacaaauuguuuagauccuaauuuaugaagaacucuuaaaaauuaauaagaaaaaagauggaccauuaucauuuuccuuuccugauuaacugauauuuuaaaacauuuucucacccagcagcuacagugacauugugcggauuuauaaaagguaaaaggcuuguuugucuuuuguacuuuaagcaugucccagguggauguggauucaggaauugaaaacauggagguugaugaaaaugaucgaagagaaaagcggagccucagugauaagguugguaagcgaugaagcccuugguacagguaauagaaauaaacacauuucaugucuuguaucuguagagucuguuagauuggggccacccgaaaucaggaaguccuaggcaggugauuauuuuuauucuuuugaggaaaaaugaauaaccuagauuacccuuauucaugaaaguguaacucaguccuuugaucugauaauauccaucuguuuuugguucagggccaugauuuuaucaguaaauuuagguuguaauaggaacuaauuuagagcaaauuagaauucuuucuguuggucuuuugcuuuuuuuuuuuuuuuuuuuuuuuuuuuugagacagagucucgcucugucgcccaggcuggagugcaguggugcgaucucggcucacugcaagcuccgccucccagguucacaccauucuccugccucagcuucccaaguagcugggacuacaggcgcccgccaccacgcccagcuaauuuuuuguauuuuuaguagagauggguuuucaccguguuagccaggauggucuugaucuauugaccuuaugauccaccugccuuggcuucccaaagugugggauuacaggcgugagccacugcgccuggccuggucuuuugcuuuuaagcaaguagaucaucacaucuuuagcaguauucugaggaaaaugacugggaauugaagcaagaauauguagaaucuagucgcaaguagaagguuuuggaaaacaugaagccuuuauauuugaauaucaccugagcuuagugcucugcauuuaggguguguguguguguguguguguguguauuaauauagauaauuacaucacuuucuguuuaguaaauuauuaggaauccuuuagcaacacauguuaaugauuauuggaaguugcacuguaaacaaaaauaaagacaaacaaaggaaaaaauaagaaguugcacuguagccuccuaguggugcagugcuuuauuuuguauaguucuuuaauguuuacaaaauucuuuuuuauaugcuguuuuaucuguggugguauguaaugagaaauguuacaauuuugaaaaauuccuggaggaaaauuggucaugcaccuggaguguuaaccugguccuauggaauucagaaaaguaaauagauaggauauguacauccucugucacauauuuuuccuuggugacuuuugauaaugacuuugcucuuuuuuuuuuuuuuuuuuuuuuuuuuuuuuuuuuuuugagacagggccucacucuguugcccaggcuggagugcaauggcgugaucuugguucaccacaaccuccgccuccuggguucaagcgauucuccugccucagccucccaaguagcuccgaguagccaggcccgcaaccgcgccuggcuaauuuuuguauuuuuaguagagacaggguuucaccauguuggccaggcuggucuugagcuccugaccucaggugauccacuggccucggccuuccagaaugcugggauuacaggugugagccaccacgcccggccaucuuugcucuuuuaugcuccccauagauuguauuguaagcucaugagacuuagauguuguaacuuugauguuauaggaauaggcuuacuuuuccccuaaucagugggugaaugguuucaugcauuuuuaaaauaucaucacuaauaaugaauuaaaucagaauaacguauuccuauugaaacaccuaacucauaccucuuauuugaaauuaaccugcaaaucuucuucuucaccaggagccuuccucgggcccugaagugucugaagagcaggccuuacagcuggucuguaagaucuuccgugucucuuggaaggaccgggacagagaugucaucuuucuuucuucucuuucugcacaguuuaagcagaacccaaaagaagguaggaaucuagcucagcagucuuacugcagaguacucgacaagaaaauaagaugugagaucuuugcccucuguuauccacauucacuccaucuugcucuuggguuguauuuuugaugacagggauacuucuugaugaggacacaauuguuuagccacuuucuucccuuuccacugaucuuaucgauaacuuauuuuucauuuccaugauuucuauaauacuauguaaauagguuaauggucuccauuuucucaggguugaaguuuuucucuuuguaguaagaaggugcuuagagcauuaccuccucuuuauuuauuuauuuauuuauuuauuuauuuauuuauuuauuuauuuauuuugagauggaaucucacccuaucaccaggcuggagugcaguggcaugaucucagcugacugcaacuucugccucccgaguucaagugauucuucugccucggccacuggaguagcugggacuacaggcgugcaccaccacgcccagcuaauuuuuguaguuuuuuuuguuuguuuuguuuuuguuuuuuuuuuuuuuuuugagacagagucuugcucuggcaccaggcuggagugcaguggcgcagucuuggcucacugcaacucccaccuccuggguucaagcaauucuccagccucagccucccgaguugggauuacaggcaugcgccaccacacccagcuaauucuuguauuuuuaguagagacaggguuucaccauguuggccaggacggucucgaucuccugaucucgugauccgcccgccuuggccucccaaagugcugggauuacaggcaugagccaccgugccuggccucauuuuuguaguuuuaguagagacaggauuucaccauguuggccaggauggucucgaucucuugaccucgugaucugccugccucggccucccaaagugcugggauuacaggcuugagccaccgagccuggccuuaccuccucuuaugaaguauagauauaguggguggucuccagggauccugagagaaguguucuguaugagcuauaccugcuuuaagugccuaugaagccauguauagacgguggaauuggucuauuugguuaaauugcuuagcaagauagaacauaaugacauuuugcuguguuucugauauuccacuuuaagaggccaagcuuguaacaaaauaauaaaacucuuagcaagauaucagcaucauagggcacuauccuuuuucuuuacaguagucauuuggaacgcagaagagguaugggaggugugcuggagugguuuuuuuggccuaucacuggaauguaacuucccucaugguagggauuuuugucuguuuuacucauugauguaucccuagaaggauaucuugcacaaaauagucccucaauagauagauuuuaaauggaugcgugaauaucaaggagaucaccuuucucuuuucuaugcugccuaucuucugaggagggaaaaaaaaaguccuuuguauuucuggaggauagauaagacuauuucugauuuuacuuauuaacucugcuaauggagcagaccauguauuugaaacucugcuacuuguuauucuuauuauaaaucuuaagauucucugucuuacacauguaaguggcaaaucugucuuacacauguaaguggcaauuuuaaauaaccaaaucagauaaaauuuccaugaguuaaaacuuuuguuaaaacaagugucuuacacauguuaaguggcaacucugucuuacacauguaaguggcaauuuuaaauaaccaaaucagauaaaauuuccaugaguuaaaacuuuuguuuagugguauuuaaaauguaucuaaagaccaacaguaaaucaacugggagcugcaaagaauaagaaggaagcuagaauguagcauuugcuccugaaagccacauggugacuagauguuggacccuucauaaaaucuuuugaaccuuggacuuaauaguuuuauuacuaucuauaaaacauaucuagacuaagaaauauuaacccaguugcauuuguaguauaauaaaguaaccucuauaguugggaguagcuucuuuuuacaauuaauauacaucagcgguaacucucaaugacuguaccccaacuuucuuuuuaauaaacuuuuaauuuuggaauaguuucaguuagugcagggaguuccuauauauacuuuacccaguuuccccugacguuaauaucuuauauaaccaugguacauuugucaaaacuaagaaauuacuacuaacuaaacacaaggcuuuauuuagguuuuccacuaauauccuuuuaccauuccagaaucuaauccaggauacugcaucgaaccauuuggggucagcuggcuuauucaagggcuguguaaccuguguucgaacuguguguaaccuguucuuuguucugccuuuccaacaguauucuccgauuuuaaggacuugauuggccagauuuuaauggaagugcuaaugauguccacucagaccagagaugaaaacccauuugccagucugacagccacaucacagccaauugcugcagcagcacggucaccagacagaaaucucuugcuaaacacuggcuccaauccaggaacaagccccauguucugcagcguggcuuccuuuggugccagcucuuugucuaggucagugugguucucuuugcacaucuuacugguaguaaaauaacugugaacuacguaggagaagggaauguuuguugacaguguuaaucagugucauacaggguauggcauauaucauauuuggggagguggauuuagucauuggaaguggaauucucuuuucuagauuauuauuuuuuggcucucuaugguuaagauauugcuagaugaaauuuuagaagcaguuggcuguguauacuacaucauucuucgaauggggacuuuaucgucuuguaaguauagccucuagaucaauagggcaauuagauuauaauuauuuagauguuuaucugcuagauauacuugaacugaaaugauucuccuuuaaaagcuugauauuuucuguuuuaguuaguuaucucaaguuuuucuuugauuuuucucuucuuuccucccuuucucaacuaauuuagccucuaugaaaguaguccggcucccacucccaguuucuggagcucuguucccgugaugggcccgucucuugccucaccuucccgugcagccagccaguuggcugugccuuccacuccccucaguccucacagugcagccucuggaacugcugcgggaagccagccuucauccccgcgguaucgccccuacacugucacucacccaugggcguccucaggcgucuccauucugucgagcuccccaagucccccugcccucgccaguagcccccaagcagugcccgccagcaguuccagacagaggcccagcagcacggguccaccccuaccacccgccucacccagugccacgagcagacgccccuccucccugaggaucucuccuagguauuuaucccacaggagaguugcauguguguuugcggugcagggaaaggagauuaacacgguuuggaagaagugcugugugacacugacucuguuaaauuguuguuuuggguuauuaaccuguguggcuaacuaguuugguaggcacguacucugaguccaugcuucugccaggcucuaaucaugcuggaaaguuuggguugcucuauucuauugugaaucccuuucuucccuuugagaguuggggcacacaggaacccuuuuuggccuuuuguccuguugccagugguaguugaaaugcuaucagaccaagcaggugugggagcaaaucugggccugguguuuuuuacuucuggugaguggggugggucgguucauguccugacguguugaguuuuaguuauauguaaguucagucucuuagaaggaagcaguaucagaauuccacuaauccaguggccccuucucucaaauguaccuguauguguuucuauaauuuaggugaauuauguuucugcaugucaguggccaaaaguuuuaguguaugguuuauuuaaaaggacagcaguugcaaaagcuucuccccgucuuguuuuuucuuuguucucugauggccuuuuuugcuuuuguugugguaguauguacgacaauccuuucuccuuccucuuccucgcacuuucuggggacaguagugaugaagaagaugaagaagaagaugaugaugauggugauggugaugaugaaggugguggugguggugaugauuuuucuuguguccaguuuggguccagguaucagaggaauggagucuuaccccugcaugugcguagaugcuuaggaacuaacuucuauaagcucuaacaaggggcgugcuuugaauccaggcaggauagggucaaaugaggugggcuccagaguauauugauguguucagaccuucucaugggauaaaguagcacauaggagaauuuucuuuuuuucuuucuuucuuucuuuuuuuuuuuuuuuuuugaggcagaguucugcucuuguugcccaggccggagugcaauggcgcaaucucggcucacggcaacuuccuccuccuggguucaagugauucuccugccucagacucccaaguagcugggauuacaggcacccgccaccaugcccggcuaauuuuuguauuuuuaguagagacaggguuuugccagguuggccaggcuggucucgaacuccugaccucaagugaucugcccgucuuggccucccaaaauguugggauuacaggagugagucacugugucuggccccagaauuuucagaguugucgccuggcaaguuuggaggaaaacuuuauguauaaucauuuuucaaaagcaugaaaacagauuaaagaucagucaucaaguuuauccaccuuuagaucuaaaaugagggacccuucauuuaucuauugcgagaauguuauugugaacuaccagaugugacaacuuguacucucugaggcauguuuucuuaaguacaguugcaugaauugcugcuauuuaguaacgggagaggggcugggauuugggggaggugugugugugugugugugugcgugcgugcucccuucccacccccucccagccuccaccgccccccuguucacccccauugagcucagucugggcaauccaucgaagaacauaugaggucauaccaucugcauaacugugacuuugcuuucaugucuagccuuaaauuucucuuagcaccuccuggaccucagugaagccagaccccauuuguuuaaagagccuuugaaaugaccgcagaggcugaaacauaguuccggauguugcugaauguuuaccccuggaaaccgagugaaaagcacuacuuggguuguguaggugacuuugagcaagagaauauaauagcaccuucuuucuaauccucugacucauugucuuacaauuuugcucuuaaauugaaguuuccuguggacugaguugguguuugugcccagcacuguucaaaaauaacuccaggcuauaaauagagacugcaguaggaguuagguacacuucauucaauucgaugguguucagaagaaucauuagagaauacguaaagagacagaggaauguugaugcaagguugaauauugauucaggaagguugauauuuguauuacgcugaacauuuuaucaccauuucucaaguaaauuucccaaaggugaaagugucuuuuucacguagauaaaauccuauugcaugauuauaguaauaaagcaggcauccuuccuaggaaccaguuuccacaugguaaaagugcuguguuaccuguuuuacuguaaauuuucugugggagaaauucucucucccuggccuauuuaguugugacuuucucuaacaaccguaucagauugugugcugcuuuuacuaauaccucucuuucuggacuucuaacaccccagccuugccucagaucuaaauucucucccuacuaggaggaauaaaauguaccaaguguauaaaaauagcugcaaauacucauggagcauugugcgccagauguggugucagcucuguccauguaucagccccuuuacuccucgcuguagccugcugugaggaaguggcagggggaacgggggggccggggggacagacaagagggucaaaaucauagaaaugcauucagacuugagcauccugaauccagacucauguucaccaccgcaccgugcugccacccacuuuuccauuucugcccaaauaggucuuguuuguucuuguuccuuacuacuguuuuugcugccgagagucugugcaucuacucgguuccuuuggcagggaagugccagcauuucacuccuuaauuacaaaaugccaucccagucaguugauaugucccuuguuggccguuacagugaacugugaucauccagauuuuggcagcuuauagguucuuaguugauauaaaaaagaaugccaaagcauggguaaaaauacaugacauaacuauguaaacaaguagaagaacuuaggguucuucuaaguagggucagagccaagaugagcuagcaaaaaaccuuguuacuuuuuuuuuuuugagacggagucuugcuuugucacccaagcuggagugcaguggagcgaucucggcucacugcaaccuccaccuccuggguuuaagcaauucucgugccucagccucccaaguagcugggauuacaggugcaugccaccacaccuggcuaauuuuuguauuuuuagcagagacaggauuucaccauguuggccagaguggucucaaacuccacaccucaggugaucugcccaccucggccucccagagucucaaacuucugaccucaggugguccgcccaccucggccucccaaauugcugggauuacaggcgugagccacugcguccagccaaaaccuuguuacuuugagcagucagcaaagaaauaguacuuuauccuucccccuuucucauugaucuucccagaauuuuuuuacucugaaguaagcaauuuuaacacucacuucuugccugguaagacuaaugucauagaagaaagaaucaucagggguuggaucgcucucuccaucugcuggcccaguggauucgaugucuuauaaaucuuuuuggaaguaguugggacauacauuuauauguuaaguauuuauaggggugaugauaaggauuaauuuuaaaaagguaaaacauuccuucuguaauguuuugcagacuucugagaaaagaacuguuugagauauaaagaacugcuuuuugcgcgaguggcauaaaugagugaagugagaauuaccgugugugaaaagauaacuguuggguggugggcuuaaugcaugggugaugaaauaaucuguacagcaaaccuccuguaacagaccuucauauguacccccaaaccuaaaauaaaaguuaauaaaaaucaauaaaucaauaaauaaaagcuggaaguugaucugaaaaaaaaaauuaccccaugguaaagguaccgcagaaguuauccggaggaaaauguuucuaauuguuuccuaggaaguugaugacuagaaagaaauuuggugguuuuguguuuguuuuuuaacuguaaauauuucagugaaggaggucaaaucuugaaugucacaagccuuauaugaguagagaaagggaaaauuagugaauagugaaaaacguugacauugacucuccuguuuuugcugauugucacugcuugggguugaaacauagaaacaguggaaaagaaaucauucuggcugggcacaguggcaagcacagguaauccuaucacuuuggaggccgaggugggaggcuugucugagcccacgaguuagaggcugcagugagucgugaucaugccacugcacuccagccugggugauagagugaaacccugucccucucuucucucugucucucucugucucucucugucuuucucugucucugacacacacacacacacacacacacacacacacacacacacacacacacagucuuuccaccauaucuaucccuaagaucccccagugauuucccuucucacacagaguaaaauccaaagccucugaccauggucuacaaggcccugcaucucacguacacuccacauacuacacacacacacaccacgcgcuacacacacacccccacaccaagcauacaugcacauacgugccccauucuaacuuaaucucccucuacuugucuacuuccccuaacucauguacuggacuccuguucuuugcacguaauacucccuccugccuuaggccuuuguacuuguuucuccccuucggaccacucuccccacuagacagcuguauggccggcucccucacucuccucaggucuaucagaggguggccacugaccucauugucucaaacauuauauagaacacacacgcacccaugcacgcacaccgucguucuucauccgccugguuccgugcacuauuccaggaccuacagcagugccuagaacacagaacauccauuagcaacauuuguuuaaugaauuuauagugccuaaaccugcacaacucugacuuugccuugcuauuagaaaaugcaaggccaggcgcgguggcucacaccuguaaucccagcacuuugagaggccgaggugggcggaucacuugaggucaggaguucaagacaagccuggccaacauggcgaaaccucuucuuuacuaaaaauacaaaaauuagcuaggcaugauggcaugugccuauaaucccagcuacuagagaggcugaggcaggagaaucacuugaauccgggaggcagagguugcagugagccaagaucacaccacugcacuccagccugggcaacacagcaagacucugucucaaaaaaaaaaaaagaaagaaaaugcaaauuccaaaggcugcauuugagaagucaguaaaugggagaguaauuauagaagaaacugaaacagagucgcuuuaagagcaaguuuuguuagugcauuuaaaaugggauucagucugcacagaucggaugcacguguaaucccuaggcacauuuacauuguguuuucagaaggaugcagcucuguuucuauuaugugaaguaauuacuugguuacauuggacugcuaauguaguuaucagaaagugguuugcauauucucccagagggagguauaauuuucuagaugcucuuaggacuucaauaugacauauuuccaagauuuuaggaugucacaguuguaaaagcaucaugaauuuuguacagcugagggaaaauauuaaauacuacuuuaaauauuuagaaauauuucuuuuuuguuuuguuuugucuuguuuuagacggagucucgcucugucucccgggcuggagugcaguggcgcgaucucagcucacuguaaccuccaucucccagguucaagugauucaccugccucagccucccagguagcugggauuacaggcacccgccaccaugccuggcuaauuuuuguauuuuuaguagagacaggauuuuaucacauuggccaggcuggucuugcacgccugaccucaagugaucugccccccucagccucccaaaguguagaaauauuucuccauagcauaaauuuaugcauguacuauauuccgcuuucuccuucaguaucacacucaaaauuugaaucuaccucuuucaguuugaaucuaaaaauucuuguaaaucaguuuuugaccauugacacuuaacgcuuguauuagugaaacuggccacuuuucuuacuugugaucaugauuuacucuggcaccuuuaggauuaauauuauaauuuugaaacacauugacaaauacugagguugaugcuacauuuccuguuugguuaaagcuuuguuuaacuccccccaucugccgccuugcaagucagcuuguuuggugccuggcuggugaucacuguguuaguccauuugcauugccauacagaaaggguaauuuauaaugaaaagagguuuaauuggcucaugguaccucaggcuguucaagaagcaugacaccagcaucugcuucuugugagggccucagaaagcuuccagucauggcaggaggugaaaggggagcaggcaggucacauggcgagagcaggagcaacagagaggaggaggaugucccagacucuuuuaaacaaccagaucucacgugaacucacugagugagaacucacucaucaccagggggauguugcuaaggcauuggugagggaucugcccccaugauccagucaccucccacuaggcccgugcuccaacacuggggacugcauuucaaugugagauuuggacaaacaucccaaccauaucaaucaccaaaacacacugagcucuuuuagcuuugaacauucucucauagauccugagugccuuuccuugcauugccuggcacaagaaaagcaaucgucuacauagucuucuacauacauugucacuuuucaugugugagugcacgguuugugaaaauauuucaaguggcagugaggguuucaaauuuaaguuaaaaugaagucggauguauugcuaggaaugggaguaauuucaguggcaguugcaugagccagcgccaucuaagccugcugaguucacaggcacgcucacaugcuggcugggggugcugcaucagacugaggccuggcagcuggcaaggaccuauugacaucaaacauaagaugcuuuucggccggacgcaguggcucacgccuguaauccuagcccuuugggaggccgaaauggguagaucaugaggucaggagaucgagaucauccuggccaacauggugaaaccccgucucuacuaaaaauacaaaaauuagccaggcaugguggcgugugccuguagucccagcugcucaggaggcugaggcaggagaaucgcuugaaccugggaugcagagguugcagugagccgagauugugccacugcacuccagccugggugacagagcgagacuccgucucaaaaaaaaaaaaaagaaaaaaaaaaaaaaagaugcguuucuucccagaaauguaaagaugugagaagaauggggcuuauuaucaagaaauagaguuucauauuuucauuuuaaacaugaagaagaucuauuuucauugucaucugcaagagcuguucauaggaaaauuacccucaauuguguguagguacaagccuguuuuagcaaaguucauccuugcaaagugcagugaauauagucacugaguuaugaauguuagcagcagaggagggaucgcaggucuugaaacuaacuaaaauugcuacaagcaaagauagauauuuauuuuuuccuuucgggggguucccugcacuucucucauugguugauggcuuuuucuguuuguucuaguguguguuuuuccugugcuuuauuacaguacucacuuuucaguuaucaagccagucagcagauaccagauccugccauuaauuaauaaaguauaccaaaaaauuaguugcuauaaagacacaauaauuggccaggugcuguggcucacaccuguaaucccagcacuuugugaggcugaggcagauggaucauuugaggucaggaguuugagacuaucccggccaacaugguaaaacacugucucuacuaaaaauacaaaaauuagcuguacaugguggcgagcgccuguagucccagcuacuugggaggcugaggcacaagaauugcuugaacccagaaggcggaguuugcacugagcagagaucacaccacugcucuccaaccuggaugacagagcgagacuccaucucaaaaaaaaagacacaauaauuaauugccuuuguuuguuaagggaucccacacggaccugcccagccuugucaugacucuggcgagggcuuuguagguggcuuaguuaccuacucagucggcagggaguuggcugccuuguuccuuugacugcuucucagccucauugucucccuuugcuuucaccugucaggccuauguuauagguuguuggaguucaaauuuacuagacucugggcugaacgccuugaauuucaaaguagcauuguuucuccuucuuacugaaauacuuuaauaccauacuuuuuuuuuuuuuuuuuuuaauagcaggccaggcuggucucgaacuccugaccucaagugaucugcccgccuuggccucccaaaagugcugggauuacaggcaugagccaccgugcccagcaaauaucauagucgcucucuugcccaggcuggagugcaguugugugaucucagcucacagcagccucugccucccgggauuuaagagauucuccugccucagccucccaaguagcugggauuacaggcacacgccaccaugccuggcuaauuuuuuuguauuuuuaguugagauaggguuucaccauguuggucaggcuggucuccaacuccuauaccucaagugauccaccuaccuuagccucccaaagugcugggauuacaggcuugagccaccgcguuuggccaauaucauaccuguauuccaaggucaauuauguguaguuuuccaaagucuaaggacaaugauguccauacagacauguguccuuuaacgagagggauacauucugagaaauggaucguuaggcagauuggucauugugugaacaucauagaguauacuuacacaaccuagaucauacagccuacuacacaccuaggcuaugugauauauagccuguuucucuuaggcuacaaaccuguacugcauguuaguguacugaacacucuaggcaauuagaugcuuaugccaauuauggugaguauuuguguaucuaaacaugucuaaacauagaaaagauacaguaaaaauauggcauuauaaccuugugggaccacuaggguauauuugguccaucacagagugaaauguuguuauguggcgcauguguuacaaauguguuccaaaauuaguuaugcauaucuaucugucuguaaaacaugucaauuccucuugguccuguuaguuucuagacauuaauuguguguccuggguugaaguagggaugugucucucacauuccugauguucccauacuuuuuuucuuuuauuuuaggacagcgucucucuuugucgcccaggcaggagugcaguggcaugaucucggaucacugcaacaaccuccucccacggucaagugauucuugugccucagccuccugaguggcugggauuacagacgugugccaccacgcccaacaaauuuuuguauuuuuaguagaaacaggguuucgcccuguuggucaggcuggucuugaacuccuggccucaagugauccaccugccuugguguacgaaagugcugggauuacaggcaugagcuaccauacccggccauauuaccauccuuuaucaucuucuguauguagguuuuuugccaaguuuauguuuucucauuuucuucauuucaguacuccuuacuuuuuccugucguaauuaauccguaugugucuuuuauguauaucaaauccguuugugaguuaaacaccagauuuguuauguggccugucaaugguugauuuuaacuuuguuuaauguccucaaauuuaacccuugugcuuauguuugguuuuuaucucagaggauaguuacuacuaacauaacagugcuucacaguauagacugcugauauuuuacaaagcaccuccacauuauuucauuaaaaccccacugcaaaagagauggagguucuagcuucagguaacaaguaagcagugggguugagacuagaacccacgucugguuacuccuaguacaauauuuuuguuuugucuuuuacuauacuacuuuaccuuuuucacugauaguuuuagaguuuuuaugucgauagcaaauauguucaugucuccuccuaacuggagaguuucuuaaccuuugguucuauugccaaauguuagaugagggcuuuugagauccaugguagaagucacaaagaugagggcuauuuugucagucccuuauaacuuuucccccaaagaguuugauuacagcaguagcauagucuggcuuuaaccuacagcccucugagugaugccauucuuuuugguuaaaguaccugugaugucccuuccaaugcuuaacacuugguaccaguucuuagugcuucugguuuucuaaguugccaccugcaguaagaagcagcccuucuuaggucccugaaauguuaccaaaaguuacuauuguuggcuuuggagcaggugaaacaagcagucaggguggaucuuggccgcauggguguuugugcuuuguuauguguacagggauccuaacaggcuuucugcugcagaaaugcaaacucugccaaaaauaaucaagagauaagaaucagaauuucuucuugucuucucugaaguuugggagccucugguggagcaaguaauugggauuccuacagugaccauuucaccauugaaaccugcaaagagacagauaugcugaacuaccucaucgaguguuucgaccgaguuggaauagaggaaaaaaaagcaccaaagguaauaugaaauggauuaacuuaaaaaaaaaaaagccuaguuauuuguuugauuauccccaccccuggagcauucauugauuuauucaaucaguaaagcaauuauugagcauuugccaugugccaggcacaauacuaggaacuuaggaugugucgaugaacaaaacagagaucccugcccucguggaacucacauucuaauagagacagagccaagguuugaaccuagauggccuggcuucagaguccucucuugaccacacuguagcucgguaccgccagugacucauauggcccugauaauucuacugcuuuguuauaauaaccaacauuauagagccucuguagauugccaaggacugugccaggucgacauuagcuuguauccucaguugcucuguuagugcaguggaacccgguauaacauaggcauucuuuuuucaacguaugacuaagcaaaugacucucagagagauuaaguacuuguccagaaucacguaaauaauaaguugcaaggcugggcuuaaacucaguaagcuacccuuuucccaucacuucucuugacuggcuucauuguuuucucauuuuauuccuauuucauuuucugauuuuaauuuuacguuagaaacgaaccucguugcccacugguuaguuucauauuuguaaagggccuucuuugggcuuuguuguacuuagccuuaguggaagcgaaaugagugggcaugucuccaagguuuuuuguuuuuuuuguuuuuugagauggagucucguucucucacccaggcuggagugcaguggcgcuaucucagcucacugcaaccuccaccuccuagguucaagcaauucuccugccucagccuccugaguagcugggauuacaggcaccugccaccacacccagcuaauuuuuuuuuuuucuuuugagacggaguuucacucuuguugcccaggcuggaguacaauggcacaaucucggcucaccgcaaccucugccuccuggguucaagugauucuccugccucagccucccgaguagcugagauuacaggcaugagccaccaugcccggcuaauuuuguauuuuuaguagagaugggguuucuccauauuagucaggcuggucucuaacucccgaccucaugugaucugcccaccuuggccucccaaagugcugggauuacaagugugaaccacugcacccggcacacccagcuaauuuuuauguuuuuuuuaguggagaugggguuucaccauguuggccaggcuggucuuuuuuuuuuuuuuuuuuuuuuuuuuuuuuuuugagauggagucucacucugucaccaggcuggagugcaguggugcaaucuuggcucacugcaaucucugccuccuggguucaagugauuccccugccucagccuccugaguagcugggacuacaggcgugcaccaccaugucuggcuaauuuuuugucuuuuaguagagaugggguuucaccauguuggccaggauggcgucgaucuccugaccuugugauccgcccuucuuggccucccaaagugcugagauuacaggcgugagccaccgugcccggcccaggcuagucuuaaacuucugaccucaagugauuugcuugccuuggccucccagagugcuggaauuacaggugugagccaccgcgccuggccucuaagguucuuaaguauaaguuuggucaccucaaacuuacgcuucuuucuucucugacaucaguuucugcagaggcaguacacuuggaaggcacaguuacuguagcucguucacuaagaauaaaggaagaggaaagcacgcuguuuacugaugguccaucccuuuuaacucuuauuuuuaacagcauggaauuguauuguuuguuucuugucguccucacuuccaccuuuccuuuucagaugugcagccagccagcagucagccagcuucugagcaacauccgcucacagugcauaucccauacugcuuuaguacuacaaggcucccuaacacagcccagguaugaagacccgugacgugcuugacauuagcaggcagagagcccuagccgucaguggacaucaggcucucuggccauucuugcaccaccuuagauaacucccuuccucaccuguaaaaugaaggucccuuuccuucgcuaaaauacuaugaaaauaaacacuccuuucuuccucaucuucuaaaguaguacaaagcauauuuuaaaaagaaauuaguuauguuuuaagaauucugccugcuuuuugaaauagaccauuguugaacuauguggacaagcauggcagaaaauuaguaacugacuauacagcaacugccugaaguugguggagguauuugauaaaauguguagaucaucaccuuccauguauaacacggucaauuucuguuacugaguaauaaacaauaguaauggaauggauaguuuaggaaucaaccaaagugcuacauuauuugcuucugagaauccuauaaagguugcaaauuuuuguuuuuauuuuguuuuuaaaaauuuuuuuucuuugccucucagucuucuaaagguagcaaguuuuuaaaaaggauguguauuucauuucuuuuauauaaaaaauaucuaaagggaaaagcuuacauuuaaaaguuuaggccgagcaugguggcucacaccuguaaucccagcacuuugggaggcugaggcuggcggaucaccugaggucaggaguuugagacuagccuggccaacauggcaaaauuccgucucuacuaaaaauacaaaagacuuagcugggcauuguggcaugugccuguaaucccagccaccugggaggcugaggccagagaaucguuugaacccaggagguggagguugcagccgagaucgugccacugcacuccagccugagugacagagcaggacucugucucaaaaaauaaaaauuaauaaaauaauaaaaaauuaaaaguuuacaggccaggcucaugccuguaauccuaucacuuugagaggccaaggcagauggauugccugagcucaggacuucaugaccagccugggcaacauggugaaacccuaucucuacuaaaaauacaaaaaauuagcugggcaugguggcacgcaccuguaaucccaacuacuggggaggcugaggcacgagaauugcuugaacccgggagguggagguugcagugagcugagaucacgccacuucacuccagccugggcaacagagcaagacugucucaaaaaauaauaauaauacuaaauaaauaaaaauucacaaacauaacauuacauuuauuuauucuagguguucuuauguuauuuuguaugccauaaccauauguuuuugaaacuuuucaaaaagaaggaaaauuauauacauguaccaaaacuuuaaaaaacguuccuugauuaaaauuaauaagcccucagccacuacuaauauuuuuucccccaauuuagaugaggcauaaagaaacauauaauacggccaggcgugguggcuuacaucuguaaucccagcacuuugggaggccaaggcagguggaucaccugagguuaggaguuugggaccaacauggugaaaccccaucucuacuaaaaauacaaaaauuagccaggcgugguggcaggcgccuguagucccagcuacuugggaggcugagcaggagaaucacuugaacccgggaggcggagguugcagugagccgaaauugcgccaccauacuccagccugggcaacagagcgagacuccaucucuaaaaaacaacaaacaacaacaaaaaaaacauauaauacuucuuuuuuauuuuuauuuauuuauuuauuuuuaagagacagaaucucacucuguugucuaggcuggagugcucacuauaaccucaaacuccugggcucaggcaguccuccugccucagccuuccaaguagccaggacuccaggcacacaccaucuugcccaguugauauuuucaucuuuuguagagacagagucuugcuguguugcccagacuggucuucaacucugggccucaagugauccucccaccucagccugccaaagugcugguauugcaggcgugagccaccgugccuggccaugcuuccuuuuuucagugcuucauuuuuaaagggcucuauguaggaaaagaugaauucuuugaaaauucccauagugucucauuaaaaagaccaaaaagugauuacuauugguaagaaggguuagcuuucgccugaaacuauuuugcagaauauuugggagaugucaaguuugacuuuugacugggcaguuguugcugacaugacauuucacgugccucuguagugaguugacuucaucaccgucccuaauguucauggguccacagguccuugcagcagccguccuuccuagugccguauaugcuguguaggaaucucccauauggcuucauucaggaacuggugagaaccacucaccaggaugaagaaguguucaagcagguacggucguaugaguuugcucuugcaaauuuuagccugagagccucuaugucgaggcuaauuucugaccauugaaaacuuuugccugaauucgaacauccauguguuauuagagagaaggccuacccaauauucuuuugaggaaaucagauugacagcugcauuguucaaaucaugugcccauuucaacgaaucagucaaacaucuaucuucuaaacaaggucugcacuaggugcuucgggcaauaugaaaaaaauauguaaggccccguuccugauuucaaggagcuuuuaaaacaagaauacccagagacggcauaaggcaugauaugcauuugccagauaaguagugucaaaaauucauucucugaguuuguaagauuaacuuaaugaccauauuagcucauuggcagccugcaugccauauagaaucuuugucuucuucccacuaggaaagaugucucauaucuuccuaauuauuucauuugguauuuauacauuguuuugguaucucauuguguaaagccaggugaaaaugcagauauguagugcuuaaaaauaaagcuguguacguagucuugaagguuucuuccaaggugaaacuuuguuguuaacauugcuguuugaaggaccuguuugggaaaguaagcacuuugccuuuagcaacugucacacaaguuuuuucccugaugaaagggcuuuuaucaaauuuucuuacaguuugcuguaucaucacuuccuuuuuugugacuacagagaauaacagaggcaauagcuauaauugguaugauuccuuucacucuguuuuauaccuaagauuauuuauaacuguuaauuuuaagaccuuugaauucuugggaauuguguuuucagcagucuucaaaauauuuguaaaagaagcagccaggauccaagaauaaaaauuccaguuaguguuguguauucugucuggaauucacuagcuguuuaucuuaggugaugaucuuacugacuaauggaaauauuaauggcaacauagugagcuuuucuucucuagaaggguaagugaacucucaggaaaauaaaucacugucggccgggcgcaguggcucacgccuguaaucucaacacuuugggaggcugaggcggauggaucgccugaggucaggaguucgagaccagccuggccagcguggugaaacccggucucuacuaaaaaugcaaaaauuaacuggguguggugacgggugucuguaaucccagcuacuugggaggcugagguaggagaauugcuugaaccaaggagacgagguugcagugagccgagauuacaccacugcauuccagccugggugacagagcaagacugucucaaaaaaaaaaaaaaaaaaaaaaaaaauuacugucuuggaagguuugagugaugcacuacauuaaagagguaauggguaguaauuagaauacuuuuccuauucaagaagauaccauuugaggaaucgaguaguucucucuauauaaaaucagcccagugaccagcugaaagggguauauugagccuacuuuauucauaaacaaacuuacacaagagguuaugaaaugaccucuggguguuuuuuguuuguuuguuuccccaucaccagcuuuggacagagaaguccugcauuuuuuaaauuaagaugaaauucauauaacaucaaaccaccguuguuguuuuguuuuguuuuguuuuguuuuuugagauggaauuuugcucuuguugcccaggccuaagugcaauggcaugaucucggcucacugcaaccuccgccucccggguucaagcgauucuccugccuuagccucccaaguagcugggauuacaggcgccugccaccacacccagcuaauuuuuuguauuuuuauuagagacgggguuucaccauguuggccagacugguguugaauuccugaugucaggugauccacccgccucagccgcccaaagugcugggauuacaggcaugagccagcacaccuggccucaagccaucauuuugaaguguacaauucaguggcauuuacuacauucacaguguuauacgaccaccacagaccuguuuauucuauuaauuaauuaauuaauuuugagggugagucucucucuguuacccaggcuggagugcaguggcgccgucucagcucacugcaacuuccaccuucuggguucgagcgauucuccugccucagccucccaaguagcugggauuauaggagcguaccaccaugcccagcuaauuuuuguauuuuuaguagagaugaaguuuugucauguuggccaggcuggucuugaacucuuggccucaaggcuggucuugaacucuuggccucaagugguccgcccaccucggccucccaaaaugcugggauuacaagugugaaccacagcgccuggcccagaccuguuuguuuuuaaucccagaauucugcugacuuuucagccacucaguguugaauacucuuugucuuuucuuaugugcuaccauguguuuuaucuagagaggaaugauaacugggauggagcuguuggacugcaaagcagcauuuuaccuuuuugucuugaaagaguggcaaaugugaauuauuaaaucuuugacugaaauaucuaccuccuuuuaauguuugagaaauguucacagauaaauaaauagcagcuagaauuuaggacuggagguggauacuuacaguauuuuuaaucagugcuaggagguauucauuugaaaauugaagaauuauuuaaaauauauaggucaggccaggcaugguggcucacgccuguaauccuagcacuuugggaggccgaggcagguggaucgccugagcucaggaguucgagaccaggcugggcaacauggcaaaaccccaucucuacucaaaauacaaaaaauuagcuggcgcagaagugcaugccuguagucccagcuacuugggaggcugaggcaggagaaucucuugaacccgagugauggaggcugcauuuagcugagaucgcgccacugcacuccagccugugcgacagagugaaauugugucuggaaaaaagaaaaagaaaaagaaaaagauuaugcuuaguaauauuuuaccugugcaaugcacaaaaggauaacuauacaagaaaguguaauuauauuuuacuuguagccucccuaaaaaaauuuggagauuuuucaggacaaccaguuaugaacuaauuuuuggugauucuggaaccucuguuugucuuuucuuccucauuacaauguuggcauuccccagcuccacaccugaguguuacuucuccauuuuuaucuggcauaugagagcaaguuacaucuaccuugauuguugguauugcagaaaccauagaaugaucucuuccagagcuguauugauaucucacaacacuccacggacacuuugucauccagggcaccuguguuuuauacugugcucuuuaaauuauuaaggugcucauggaaugaaauuaguaggaaagggaauuuuucaaguuuucuaguggcuacauaguauacuccuauuacaacuuguuggcauucagauugucagcuguuguuuacaacauuucuauuuaauguuauuagccuugaaucccaaccaacucccuaaauguguugaucagugcuugcauugugaaauuugaagaugagcuaggcugaguaaaucuuacaugguguuaccugguauuaaucauaaauguauaaaagcagauuugaguuccuuuaagugccaauagcagguuaauguauuaauuacacuauauguggagguaaggcuuucuaacuaaagcuuucuuuguaaauuucaacauuuaccaacuagcucuuugcucuaauuuaaguuuaauguaguaauaauguugauuguuggccuguuuaucuuguuuuccucaaaauaaauggggaaaagcuuuuaaaaaauauugauagagggccaagcgcgguagcucaugccugugaucccagcacuuugggaggcugaggcggguggaucacgaggucaggaguucgaaaccagcguggccaacaaagugaaaccccgucucuacuaaaaauacaaaaauuagccaggugugguggcacaugccuguaaucccagcuggcucgggaggcugaggcaggagaaucacuugaaccccagaggcacagguugcagugagccaagacugugccauugcacuccagucugggugacagagcgagacuccgucucaauauagauagauagauagauagauagauagauagauagauagauagauagauagaaaggaggaaauauuggaacauuuaauugaauuuuuuaacagguuauagaugcuugguaaucaagaacauauuaguugcugagaugugcagaauuuaauugaguagagcaacgacuccuggagaguucuucaacaggcuccaaauguauggguuuuguugaauuacuggguuuuguugaauuacuggggguccugucagaguauuagaguucaccaaacuccucuuacuucuggagaauucagcuguauuacuuuaugguuagacuugucaaagaacaggucaacacucuggcugaauucuagacuuuuauaugcaaaaaagcuuuucccuggggaaggaaugaaauuuggacauucaguucuagcaccuuauuugacauacuucccacucuuagauucucuuaaacuuauauuucugauuuuguuuuuuuucuuauagauauuuauccccauuuuacaaggccuggcucuugcugccaaagagugcucccucgacagugacuacuuuaaauacccccucaugguaaaacuuuguucuuuuucuuuaacucauucaauagauguuuuucuuucagauuauuuugacauauacuuuucuuucagguccaugagaucaaccuuguuuucaaauuuaaaacaugaaaucacuguguuggccaugcagaguguuuggugugcagugagaugcaucagugaagacaguuagcagccugguacaucuuccaccuauccaaguccuagacaggaguuaaaugcacuuauuacaauguacuuuguauagcuuaugaaaaagauaacuuaucuccuagcaaugagcauaccauaguugggaugaaauuuuguuacuuaaaaaaaaaaaaccuauuaaaaaugcaaauaaaaaaggcaaagcuguacauacuaagaaaaugaauacaauuuuaucuuuauguguuuacuuugugcagaaaaucucaguguagcucucuuguucacccucccuguuuccuaaggucauauuuacuugggaaguagaaaucugcuuagcucuuuaacgcacuuagagcaggcauacauuguggacagaagcuucagcuagauucccauggggaggcuugaauguugugaaaaugcugaaacuagaaugaaaauuagaagcuccuuucuguucugaauucgcuuauuugaaauuuugggagaaaaguauuuugaaguguuacugaauauuuucguugcagaaguguaaaggaaaaaauaucaaaaugaaauuaguuuauucuauguauaaauuaagucuuauguaaauugagaccaugguuguuuuucuuacuguauuuauuucuuuuacuuauuccacugauuggauuccauuauaccaugaauucauuacugacgaucuguucugugcuagacacuggugauacagaagcuaggaagacaaggucccucuccucaaggcacucauaaucuacugcaaaaauaagagcuacagcgcaacaguugaacagauacugugauaaauguuaaaacagagcuguacacaaaggguguauuuaucuauuuaaaaaauucaaaccugucauggcacuaaaaggcuacaagaaugcugggaaauuagaaggugaaaccagaauuccuacuuuaaaaaauaauuuuaaguggauuuaugccagagcucuuuccauuguacauguuauuggggcuccugguaaaauuauuugaauccuuauguauuguucucccuguggcagauaaaaggaaguggaauaaucugauuguuugaguucagugaugaaauauuuuagugaacacuaauuaucaccauauuauguagauguuccuucaugggacuguuggcuuuuggguuguggugugaauuagcuugauguuucagugaggagcuuuuagcaucugauaucaccaaaauguccuuuuguucaaaagacagaggccuccauugugguagacagugauuucauuuugugccauuauugaugcuugcauaauaacgaggacacagugagugagaggguacaauaaugagaggcaggaagcggaagacuguugaagcuaaaaucagaaaucauugugaucauucucuaggucaguggauccugcugugccauacguuggaaucaccuuggaaucagcuggggaucuuuaaagguguuucugccuggcuccccaccccagaccuugugauuuaauucaccagggguguggcauggcauugggguuuccaaaggcuucccaugugauccuaauaugcagccacguuugugaacuccugcacuaggcagugagaacgcuuccuucugaguugaggcugccugaaccucaaaggcaucucaacguugugucaaugccuaaaugcacucuucggcucauguagcaacuucuagagcugcguccgaaucacagaggaaauuaacuguugaaaauaauguuugauugaguuaccaugggcaugcuaaauuauguuuaugucccuaaaaaguguuuuucaucguucucuaauguuaggaugguuggaugucugaaggaaaguguuggaauucuuaaaaguacuagaaaucuugaaaccaaguuauguuuuuaaauauguuuugaauuugauagcuuauuaaauuguaauuauuuauagucauguuuaacacuggcaagaggagccaucuaaaguuuaugaaauaaaucuuuuugacauggaaagauaugaaguggaaaaacuuuuuuguaaaaaacauauauagauacaguacacaaaaauauaucugaaaacuguugcucaaaauaucaauagagguuaucuuugaggguaaagcuugaguaauuuuuaguuucauuuuauauuucuguuuuauuucaaguuuucacauugcauguguuuuaguuuauuaaucagaaaaaguagugaagcugcugccauuucagagggaaugcaugugugccauuuuagagggaacgaauuuauagcagcaguuaaaacuguuucuuuaugcuacaaaugacagucaguuuaagaugaaaugcauuuaaaugacucugaucuuauuucuaggcacuaggugagcucugugaaaccaaguuugggaagacacacccugugugcaauuugguaagcacucaccugaugggcuugcacauuuucagugaauauaucauaacccagaaggcauuccucuagugagauggccuggaaaaugucucuugaaggacauuuagguguaggcggagguaacgugucugggaggcucucaacuguuacauuuuuguuagacacguuauauccugcauuacaguuguucauuucuaugauuuuuuucccuuuuuuuucuaagaaucucacucugucacccaggcuggauggagugcaguggugggaucuuggcacacugcagccuacgccuccuggguucaagugagucucgugccucagccucccaaguagcugggaauacaggcaugcauuaccaugcgaggcuaauuuuuuuguauuuuuaguagagauggaguuuuaccauguuggccaggcuggucucgaacuacugaccucaggugauccacccgccucagccucccaaaguguuggguuacaggcgugagccaccgcaccgggccuguuuuuuuucccuugacaaguauuguacaacuaaacuaacaagagguauggaaaaguuauucgaguccuuuggugguauaagaagaguucauuugaacuucauccaauaguauccugaaacuuaaacauucuuuuuuuugagacagagucucacucugucacccaggcuggagcgcaguggcgcaaucucagcucacugcaaccucugccuccuggguucaagcgauucucuuggccucagccuccccaguagcugggauuacaggcgcacaccaccacgcccggcuaauuuuuguauuuuuaguagagacgggguuucuccauguuggccaggguugucucggacuccugaccucaggugacccacccccacccacacuggccucccaaagugcugggauuacaggcgugagccaccaugccuggcugaaacauaaaaguuuuaauaauaucuugugaaaauacagaggagcuggagaguuuucauuacauuuuuaccccaccggccuguucagcggcuugacuggcucuuccaucuucugccuagguugcuucuuugcgguugugguugccgaaauccuuaaguccuggcugugggcgggagcugcagagacucucuuacuuaggggcuuucuuuagcuucucagucuuugcagaagaugauguaaguauaguggcuacuuguacuuugcugcccuuuuauucagauucuuucccaaaugugcauuauauguugacugcauuuuuuccuucucuuuccagguuaaagugguugaaaaauacuucucagggccugccauuacccuggaaaacacucgugugguuagccaaucauugcagcauuacuuagagcucggaaggguaaguguucagaaaacaaauccagaggaaguaucaaagaugagcuccagauacagagcuuuuauuuuguagacuggacuaugcccaguagacaaacggcuaacaaaagccaauucgaucuuacauaaaaaagauaaacuauaaguaaguagccugugucuugaauaacagguuguaacaacagcaguaugcugccuuuguauguagcaucacugggaacugguccuaagcuuaguggcccggcuccuccuccagcuggcccuuaggcauuuacacugugagggugagcaaggauuguuaguuugcacacacccucacugacuugcuuaucccaaaugcagauuaauaugucuucaauucucaaacuuaaaggcagagaagggccgggugugauggcucaugccuguaaucccaacacuuugggaggccgagugggguggaucaccugaggucaggaguuugagaacagccuggccaacaugacgaaaccccgucucuacuaaaaauacaaaaauuagccaggcauggcagcgcgugccuguaaucccagcuaccuagcuacucgggaggcugaggcacaaggaucacuugaacccaggagguggagguugcagugagccaagaucacgccacugcacaucagccugggcgacagagcaagacuccaucucaaaaaaaagaaacaggcaaagaaguuacaggcuuggguaacuaagguaauuuugaucaugggaaagaaguaacaaagccuauuuuauuaaaacuguaacugccggcugggcguguuggcuaaugccuguaaucccaacacuuugggaggcugagaugggcugaucacgaggucaggaagucauccuggccaacauggugaaaccucgucacugcuaaaaauacaaaaauuggccaaggcagguggaucacgaggucagcaguuugagaccagccugaccaacauggugaaaccccaucucuacuaaaauacaaaaaaaauuagcugggcaugguggcgggugccuguaaucccagcgacuugggaggcugaggcaggagaaucgcuugaaaccgggaggcggagguugcacugagccgagaugugccacugcacuuuagccugggcaauaagagcaaaacuccgucucaaaaaaaaaaacaacaaaaaugcaaaaacuagcuggguguggcggcgugugccuguaaucccaacuacucgggaggcugaggcaggagaauggcuugaaccugggaggcgcagguugcagugagcugagauugcaccacugcacuccagccuggcaacagagcuagacucugucucaaaaaaaaacaaaaaacuguaacugccuaccucccccacuccauauucugcuuucaugcucauuacuuugacauaguuggauguggauauuucuuauauucuuucacucaggcucuucuaaaaugaguagaagugggagaggagagaacgugggaaguaggcuagcuguucgugaagucaaaaaggaaucaugugcaaaauaguuuuaauuuguuucuucuuuuuaaaaauaaauuucagcaagagcuuuuuaagauucugcauaguauuuuguuaaauggcgaaacccgugaggcugcucucaguuacauggcggcugucgucaaugccaauaugaagaaagcacagaugcagguaggauuccuacagacugcuuuucgcuguuugucaaauucauucaucugacccagauuuagucagcaccuaccaggcacuguucuaggaguggggguacaguauugaacaagguagacgagcuuccugcuuuuguggagcccauguuccacagaauaaacaaguagacauauaaauacaugauuuuagacaguuguauaaucagugaagaaaauagagcaaaguaaaugacaugagaagaacuguagguaccagaaggaagaucugaaggugauuuuugauuggguggcaggaaaggccucccugaggaggugacauuuguuucauaggaaggagccagccauuguaguggcugagaaaagagcuauccaauguggaaacgaagcagcuuugguacaagcccagcacgcaggcuuuuguggcuggagaagagugaacaggagggaaugucggguccuggaguuaguggauaggcagggcgccaucggguuagguuuacgugaucagaacugucaugggaggguuuucagcagggaaaccacaaaagcugcuauguagacggaccaaaacagaagggggcagccaggaacagacccaagggggcagccaggaacagacccaagaaggcagcugcaagggcgugagugcuucgguccgggugagacaggccaguggcugcagcugcuuugccagaggagaaaagggcauccuuccuugacuaguaauaaauaaugaaugaaugaugugauguguauacucagaagcaaaaaucauguagagagaagagcacagaucuugugauuucugaucgugguuccaccguuuacuaacugcgggaccuuagacagugacuccucugugccuccauuuccucaucugcuaagcugcgguacuacugguacuggguuuauuauauauaaagcuguuagaguggugccugguacacagugaucacucaaccaauauuaacuaucauucuuaucauuguuguauuauuauuuuuuucuuaacagagguaaucaaguuacauuguuauauugcuaaugcaggagcaugcugaugcugucaccuagagaaacaaugucacaugauaagaaguggagcaacuuguuuugaugcucuugagggaaauaaagaggagaaagaggccgggcaugguggcucacgccuguaaucucagcacuuugggaggccgaggugggaggaucacuugagcccaggcauuugagaccagcccuggcgacauaaugagaccccaucucuacaaaauauacaaaagucaucugggcaugguggcuggugcaugccuauaguuucagcuacuugggaggcugaggcaagaggaucacuugagccagggaggucgagaccagccugggcaacauagggagacccugucucuacaaaaaaaauaaaaaauuagccaguauaguggcauagaccuguagacccaguuauucaggaggcugaagugggaggaucacuuaagcccgggagguugaggcugcagugagcuauguuugcaccacugcacuacagccugggcaacagaguaaaacccugucucaaaaaaaaaaaagaaagaaagaaagaaacauuuauuguguuucuacuuacuaauuuugagccucaggcaaaucacuucagggucucugagucuuuauuuccuccugcauaaaauguuaacagcaguauuacugaccuguaagaauuaucgugaugguucaguaaaagaauguauaaaauggccaagcgugguggcucaugccuguaaucccagcaauuugggaggccgagacgggcguaucaccugaggucaggaguucgagaccagccuggccaauauggugaaaccccaucucuacuaaaaauacaaaaaauuugccgggcgugguggcgggugccuguaaucccagcuacucgggaggcugaggcaagagaaucacuugaacccgggaggcggagguuguagugagcgaggaucgugccacugcauucuagccugggcaacaagaguggaacuccaucucaaaaaaaagaaaagaaaagaaaagaauguauaaaaugccucuuauauaaauaauaauuauauaauaggcgguauucaacaaguagcaccugcuaauauagaauuaauggaaugacaguggugaugagauauaugucuucucauugacuuuaggauacaguuauguuugaaaguucagucugcuuucuuacaaaguuugccaaaauuucuauucauguuauuuuaaauacuuuuucuuggcuggucacaguggcucacaccuguaaucccagcacuuugggaagcugaggugggcggaucacuuuaggucccagcuacuugggaggcuaaggugggaggauugcuugagccugggagguggagguugcagccaagaucacaccccuucgcuccagccugggcaacagagugagaccccaucucaaaaaaaauuuuuuuuaauguuuaaaaauacuuuuucuuuucaacuuucacagacagaugauagauuggugucuacagauggauuuaugcugaauuuccuuuggguacugcagcagcuaaguacaaaaaucaaguuagaaacaguugaucccacguauauuuuucacccaagaugucggauuacucuucccaaugaugagacgcgugugaaugcaacgauggaagaugugaaugacuggcugacugaacucugugaguacuguguucgugacucggucauuaaaacacugcccucuugucugugugcuaguaguuccucacagauuguuaccaccucaccauaaaaugaacuuaagagauagagaaacauaauaaaaauuaauacaguaggccuggcguggugacucauaccuauaaucccagcacuuugggaggccgaggcagguggaucacgaggucaggaguucaagaccagccugaccaccguggugaaaccccgucucuacuaaaaauacaaaaauuagcugggcaugguggcacacgccuguaaucccagcacuuugggaggcugaggugggcagaucaaaagguccggaguucaugaccagccugaucaccauggugaaaccccaucucuacuaaaaauacaaaaauuagcgggugugguggcacgcaccuguaaucccagcuacucaggaggcugaggcaggagaauugugugaacccaggaggcugagcuugcagugagccaugaucacggcacugcacuccagccugggcaacagagugagacucugucucaaaaaaaaaaaaaaaacagauacaaauugaaaaaaaaaaucaaguuaucauaauauaucuauaaaaaagccaaaaccaaagugauaaaauagaauguaaguuuuugaagaaguaggugauauuuaaucaauuuauuuaaccuaucugaagugaauucuggugauucauagcaaaaaauauaauacuguuguucucaauaauucuacuuuucagguuauauucccaaaguuggaggaaaaaggaauaauuuuguuuacauaaauccucccaguaguaacauuauuuauaauagaaaaaaauuagaaaaaagaaauaugcagggaaacggcucuggaaucaguaguuuauuaacauaauuuaauaccauuucgagauuuaaauauuucuguauuguguugaaaaauggagauuuuauacaauacaucaguaaggaacaucaccaaagauuguugaugggcugggaaugguggcucacauccauaaucccagcacuuuuggaagcugaggugggaggagagcuugagcccaggaguucaagaccagccugggcaaaauaaggaaaccccaugucuacaaagaaaaaaauuagcccagcaugguggcacaugccuguguucccagccacccaggagacugaggcaggaggauugccugagcccaggaaauugaggcugcagugaucugugaucuuaccacugcacugcacugcagccuaggugacacuaggugacagaguaagacccucuuaaaaaaaaaaaaaaaaaaagauugugauggacaucuguaugcacauuuaacgagguaggacagaauacggugguccuugaauggagcuaacaggaauucucuucuucuuguaguauuguuuaaguuuauaauugcaaaaguauccuuaaacuucuggcggggcaugguggcucacgccuguaaucccagcacuuugggaggccaaggaggguagauugccugaggucaggaguucgagaccagucugagcaacauggugaaaccucgucucuccuaaaaaugcaaaaguagccaggugugguagcacacgccuguaaucccagcuuacuagggaggcugaggcaggagaaucacuugaaccugggaggcggaauuugcaguaagccaagaucgugccauugcacuucugccugggugacgagagcaaaaguccaucucaaauaaauaaauaaauaaauaaacaaauaaaaaguaucuuuaaacuucauaaaaauucaaauguaauuuucucuucugaauucagcuuuuucucugauugagacauguaauagauuuuauuuagggaaugauguuauuuuuccuagauggcgaucagccuccauuuucugagccgaaauucccuacggagugcuucuuucucacccugcaugcucaccaccucucuauucugccuaguugccgucgcuauauccgcagacuccgggcuauccgggagcucaauagguaugugccaugauaccguguccugggauugccugaguuaccacuuuuucucaggggcaggcaauuccauugugaacaguaguuuugaauguugggggagguauguacguuauauaguguucugucugccuccaccgccacauccauguugcucaguuguccagaguucuuuaccuggugaagugauccaaaccuugauuucugagaguucugaacccuggauauuucacucuguuuaugguuacuacagacuuccauuaacuuuucccacugggcauacauuaccaggaggcacuucaaacuuuaaaaguuuaaaggauccccuggguuucagacauaccccuucuucccuggacugugaaaaaguaaccaugguuucccuugauaaccaggaucauuuacuccugccuacauguaauucucuuuuuggcuuguucuguggcaugagggguccaaaauggccagauagcagccucaaauuuccaauucauuagcaccaugguuguguuucuuacucuaagcauuuuuuccuguguacuaacaccaacaaacagaagucacaggaacacagaagcaaauauuuuugagcagguuaucuggaauaauaaugaugccacuucugcuuuuuggucuagaaccugcguagucugucuaugagagaaacugaaucauauuuauaucucuguaucuaccuugcuuaaaucacuuacuaauucuuuuuuuuuuuuuuuuuuuuuuuuuuuuuuugagacggagucucgcucuguugcccaggcuggagugcagugguacgaucucagcucggugcaaccucugccucccagguucaagcgauucuccugcuucagccucccgaguagcugggauuacagaugugcaccaccacgccuggccaauuuuuuuuuuuuuuuugauggagucucacucuguaguccaggcuggaguccaauggcaugaucucggcucacuguaaucucugccgccuggguucaagcaauucuccugucucagucuccugaguagcugggacuacaggcgcccaccaccacacccagcuaauuuuuuguauuuuuaguagagacgggguuucaccguguuagccaggauagucuugaucuccugaccucgugauccgcccgccucagccucccaaagugcuggaauuacaggcgugagcccaugcaccuggcccaauuuuuuguauuuuuuguagagacgggguuucuccauguuggucaggcuggucucaaauuccugaccucaggcgauccgacugccuccgccucccaaagugcugagauuacaggugugagccaccgugccuggccuaaaaucacuuacuaauucuaauaguuaacucugcaaauucuuuaugauuuacuuucuacacauaaucaugucuauaaaugaugacaauuuuauuucuuuuacuuuuuuuuucaugccuuagugcccaggcuguaauuuuuaguacaauguugaauagaaauaaccuugaaauuuccaucuuguuucaguugguggaggaaagcuuucuauauauccucaguuaccagauuaagaaaauuuccuuuuauuucaauaguuaguucccuuagcacugguugaauuuuauuaaauacuuuugccauaucuguugaggagacuagacuuuuuucuucucuauucuguuaaugugguugaauuauaucaguugguuuucuguuauuaaaccagucuuucuuuccuggaguaaacuuaacuuuuauauuaauguuuuuauaucuaauuggauauacaauuugcuaauauucuguuuaggauuuuugcaucuguucaaaagaaagccugaccuguaauuuucauuucuuguuaagugcaucucaaauuuugguaucaagguuaugcugccuuauagaagaaacugggggcugggcacaguggcuuacgccuguaaucccaacacuuugggaggccgaggcagacggaucaccugaggucaggaguuggaugcuagccuggccaacauagugaaaacccgucucuacuacaaaaauuagcugggcaugguuggcgcaugccuguaaucccagcuacuugggaggcuauagcaggagagucgcuugaacccgggaggcggagguuguagugagccaagaccgagccacuguacuccagccugagcaagagugagacucugucucaacaaaagaaaaaaaaaaagaaagaacuggagaauauucuccuguuuuuuauguucccuggaagaguuuauuguauaagaauuauguuguuucuuccuuaaaugucagaaaaaauucagugaugaaguugucagggcuuaagaguuuucuguguggggauguuuuuaauuauggauuuaagacaguuaauauauauaagacuauuuagauuuucauuacaucuugugucaguuuuucuaaaguuugaaaauguuuuggcaugaaguuguucauaauauccuuuuaucauuuuaaugucuguaggauccuuauuauuucugcuuuuauuuauuuauuuuaguuuuugagaggagguucacucuuguugcccaggcuuguugcccaggcaggagugcaauggugcaaucuuggcucaccucaaccucugccucccagguucaagugauucuccugccucagccuccugaguagcugggauuacaggcaugugccaccacgcccagcuaauuuuguauuuuuaguagagacaggguuucuccauguuggucaggcuggucucgaacuccugaccucaggugauuugccugccuaggccuugcugggauuacaggugugagccacugcacccggcccauuuuaauuggcuuucuacugccucuugagauggauauuuagaucauccuuuccaacccuuucgcuuauguguauauuuaagacuauuuuguuucccucuuagugugaccuuagcugcaucccucauuuuuguuauaucauaucuuauuacucaguucaaaauguuuucuaauuuuuguuuguucuuauguaaccuguggguuauuucaaaauauauuauuuaaauucuagguucuuaggguauuugucuauguaucuuuuguuaauugauuucuagauaaauuccaucaugguaagaaaauauauuuuaugugauuugugucuuuugaaguuuauugaaauuuacuuuauagccuuuuacauuaguagaccugaaaagacugcuaucuguguuguuuuuacaguguuccacauauauuauuuaggucaaguuuguuaauuuucuguucaaguuuuccuuauaucuaaugauuuuaucagcuuauaauaucaaucacugagagaagcuuauaaaaaauucaaacuaugauuguggauuuaucuguuucuuuauccuccgauggauuaccuccugggauacagucacucccgcuggcuuuagaggguccauuucaauggaaccaucuagaaccuuugcuccuggcuugcagcagauagccuuuauugugcuuuccagagacauuuauguucaccucaucuguguauuuuucaaugcugugauuuaagaaguaucuucuaggacauaguugggguguguauaugcguauuggaaagaggauuaucugagcaaaucacauaaaguaaauccaccuuaauuuuccaagcucuuuaaguuuugaaucauuuccucugaauuagaucaaagaauauuuggcaacucagcuucauucaguauaggucacugucaauucaaaguuugggucaacuaguugguugcauaauaugaaccucucccaacucagaauaauacugaauucagggucucugguagguauaaucaugucagugauuuuagcccuacauagaaguauaucagcauuuucuucucuugcugaucaagcauccucagaauccauucccauacauaauccuacauaaccgucauguuucugcaguacauaugugguugguagaguaauggcaucucaaaggugcccacauccuggucucggaaccugugaauauguuaucuaacuugauuaaagggacuuugcagcugugauaucagguucaugaucuugagguggggagauuauccuggauuauguggguagguccagugucauugcaaaggucuucauaagagggaaucaggagggucacagggagagacggaaugugauggggaagcagagguuggagugguuuggggucaugagccaauccgguaaccucuggaagcuggaaaaggcgaggaaacuuguucuccccuagagccuccagaaggaaccaucccugcugaccccuuuuagacuuccagaacucuaagacuauaauugugugguuuggagccacugagguugugguaacuuguuacagcagcaauagaaaacuagcauaacacauuagcaaaucuugccauuuuuuuucuucaaauaugugcuucuguugcauccaauuuuguaauaaugccauaaggacaguccuugaucugacucuagcugugguucuggaagcgaagagggaugauggguuagaaccuaggggaaaauagcauuacccugcaaggugacuaucucugaugaggucauuauagaaacugcuucugcuagcaagcaaggcucagggaauuuagagauuuagguacuuggagucagcuaguucucccaaacuccuccauuugaacucuuugggucccagucuuugccuuaacuuucagauaagagguccagcaaaguuauuaauuucuucuguacuguaauuuguagaacuggagcugcuccuuuccuuuaacaacagucuuagaaacuccugauuaauucacauuuccuggagauaagaauuuaaaaucugaagccugucauuuuuuuuuuucuauaagcuccaccacauaauuagagguagccacuccacauccucauuccagaucaccagggaucauguauauagcuguuuuucuacucagagccuugggcuaccaguguuccauccucaaauacuaauuguaucuucaccaugcagcccaaucaaagaacugaucccagagccccauuuuuuucaugaaggccuguuaccuauaaacucuugugauacccguagccauauaggucauuaucuuaguuuccuaugacugcaacaacaaauuaccacaacuuuagucacuuaaaacaacacauauuacaguucugaaggucaggaguccuaaaaucggcccagcgcaguggcucacgccuguaaucccaacacugggaggccgaggugggcagaucacaugaggucaggaguucgagaccagccuggccaacauggugaaaccucgucacuacuaaaaauacaaaaauuagccggucaugguagugcaugcauguagucccagcuacucaagagguugaggcaggagaaucgcuugaacacgggagacggagguugcagugagcugagauugcgccacugcacuccagccugggagacagagcgagacugucucaaaaaaagaagaugaagguugcauucccugcagaggcucuaggggagaaucuccuuugccuuuuccaucuucugaaagcugccuacguuccucugcuccuuaucaccccccaccccaccccaccuuacuguauuuucaaagccagcaacauaguaucuuuagaucuccuucgcuugccugguguaucgcagcacuuugggaggcugagguggguggaucacuugaagucaggaguuugagacccgccuggccaacauggugaaacccuuuucuaccaaaaaauacaaaaauuagccaggcaugguaacgcaccccuguagucgccacuacucaggaggcugagguacgagaauuauuugaacccaggagguagagguugcaaugagcugagaucgugccacugcacuccagggcaacagagugagagacccugucucaaaaaagcaaaaaacaaggcugggcacgugucugacaccuguaaucccaucacuuugggaggccaaggcagguggaucauuugaggucagaaguucgagaucagccuggccaacauguugaaaccccaucucuacuaaaaauauaaguuagccaggccugguggcaggugucuauaauuccagcuacuugggaggcuguggcaggagaaucgcuucaacccgggagucagagguugcagugagccagaugaugccaguuuacuccagccugggcaauagagugaggcucagucuaaaaaaaaaagacaacaacaagaucuccuucucucucugaccuuugcuuccauugucccauugucacaucuccuucucugucucugaguccuuuuuucucuuagaaggaccuuugugauuauauugggcccuccaaaaucauccaagauacucuucccaucucaaauccauacccuuaaucacaucuacaacgucccuuucgccaugggagaucacauguucacagguucccucgaaggauucggaugcgacaaguuuggaggagccauucuuuugucuaccauacucauguuucaguuguagacgaaagaauccaauucuucugggauaagcagaaaggggaacuaguugguuuacugaaucauuggaauggcuauaauagaagauucccagagcuauacuuugaacaaggaagcugcuucggaggucagccugacagcacagccucugccacagcuucagccaaaaccccucuaccacuguacuuccagaaggaucaugcaaucacgcagucacuucacaguacucacucugccuucagugaggguucaucuuggugaaaacuaggucuuacagaaaugcuggcaggaggggagucuaggaaauguagcuuuuggagauuuagcagccucuaguauuacacacaacaucaugauagaaagggguugaaauaguguuaagagagucggucuucaaaauaugcagccuauuaggugauggggaagccuuuuacugcagagacagaugguguuugagcagacaccugaggggagugaaggagcaaagccagagauaaccucagagaagagcauugcgagcagagggaacaguuguaaaggacgaugccguuaguaaaauagccuuuuguuuuggguaauugaauaggcaaaguaaccucgaauuuucaugagagacuucuuuuuuucccucccagaaaaauaagggaacaauguacuuucuugcaacaaaaaagaugauuauauucaccaaaucuguagugccauccauucaaagacacaucauuguuuuaggaaccaauaaaaaagaaaaauauggcccgacgcaguggcucaugccuguaaucccagcacuuugggaggcuggggcaggcagaccacaaggucaggaguuugagaccagccugcccaacauagugaaaccucaucucuacuaaaaauagaaaaaauuagcugggcaugguggugagcaccuguaaucccagcuacuugggaguuugaggcaggagaaucacuugaacccaggaggcggagguugcagugagcugagauugcagcacugcacuccagccuggugacagagcgagacucugucuuaaaaaaaaaaaaaaaagaaagaaagaaagaaaaaugcugccaauuaaacuaugauuugccgcugguuguaagauauacucugauuuuaaagauguuacaaugcgaaaacaaacaacugcgugugagagucagugaaaugagcaagaugaauggguaagauggauccggcuguuuucuuucauuugacuguuagucuuugauuucagaacuguagaagauuugaaaaauaaugaaagccaauggaaagauuccccacuggcaacuagacaccgcgaaaugcugaagcgcuguaaaacucagcuuaagguuuguauagcuaaguggaauaauuauagaccagccucauagugauaauuuucccaacagaauauaugccuugagugagcaguuuaguguccucacuuuuucuuuguuauucuuuucccuuccaauaaaauaguauauuuuaaaacuuguugauaccuuacuuauauguguauauaaugauuucagucucaggacagaauauggauagauaugcuucugcugugauuaugaauucuuaauggguuuuaugauucucaguuuaacaucaccucccuuggccgggcgcaguggcucacaccuguaaucccagcacuuugggaggccuaggcgggcggaucacgaggucaggagauggagaccauccuggcuaacacggugaaaccccgucucuacuaaaaauacaaaaaaaaauuagccgggcgugauggcgggcgccuguagucccagcuacucaggaggcuaaggcaggagaauggcaugaacccaggaggcagagcuugcagugagccaagauggcgccacugcacuccagccugggcgacagagcgagacuccgucucaaaaaaaaaaagacaacaacaacaaaaaucaccucuccuucccugccuuaugcagggcccuccucaccugcugucucccaccccucgccccaacacucauccaguauaucuagccaugcauuuccaugauauuugacaaagaguaucugugguaguggaaagaucucuuuccuuugccccucauucuuucuuuuuaauugaaauugauucaucacacaaaaccuaacuauagaugggaauauucuugcuggugagacauagcuaaaaacauaugccagcugacauuguacaaauaaagcauagauagcaaauuuaugcauuuuucuucuauucauguuccaguuauaaaccugaguguuagcuggucaugcauucuguugaacaguaggauaauauguggaaaguuuaccugacauagcuuucuaguaccaguuaagauuucaguuuuauuuacuaauagacuagacuucuucaagaugcacaauuaacaaggggcccuuaucuggggucugugcaccccccuaagcaguccacagauguguuucaaggggaucuauaaacugcuuaaauugccaggcaugguggcucacaccaguaaucccagcacuuugagaggccgaggcaggcagaucaccugaggucaggaguucgagaccagccuggccaacauggugaaaccccgucucuacuaaaaauacaaaaauuaacugggugugguggcacacgacugaaaucucugccauucgggagacugaggcaggagaauugcuugaaccugguaggcagagguugcagugagccaagaucgcgccacugcacuucagccugggcaacagagcaagacucugucucaaaauaaauaaauaagaaacauaaaaacugcuuaaauguauacaucagugugugcaugcauguguguguaauucugucaacaggccucuagguaggaauuccauccuuaguggccagcauuuugcccgagggcagcucguaagaggcgacacuggaauucagacacugauuguuuggcuuuuucccacuaaccacccugacacccaaagggccucccugucgccacccucuccucaucagguuauuuacuugugacuguuggaacucaacauuuugagcuuuaacugugugcuagaccuggugguacucggugguuugcuugccacgccuuuguuuuucucaggaaaaaggucuugagacacaaccagcaucuuauagcuaguuaggagaugaagcucuagaagcucuggaacccaaauuucccaucuccuggccccagucccugcccagucccccuguagggacuuagcuacugacugaucuuuggguggggacaucccugcuuccacagaaacugguacggugcaaggccugugcugaugcuggccuacuugacgagagcuuccugagaagaugucugaauuuuuauggccuucucauucagcugcugcuccgcauccuggaccccgcauaucccgagugagugugcuucuuccuguuucccuugucccuccuuggcugggcucuguugucuuuauuguccuucaaaguugauaacuaaaaccaaaacccuuucuuuaucaagaauucacuucucugcaaggcgcagugguucacgccuguaaucccagcacuuugggggaggcugaggcagauggauaacuugaggucaggaguucaagaccagccuggccaacauggcgaaaccgugucucuacuaaaaauacaaaaauuagccgggcuugguggcagaugccugcagucauagcuacucaggaggcugaggcaugagaaucguuugaacccgggaggcggagguugcauugagccgagaucaugcuacugcacuccagccugggcgacagagcgagacucuguccccacccaaaaaaaaagauaauucacuucucaguuuccagauugcauuuauauagauuauguaguuauauugauagguguuuucccuguaauuaguuacaauaauaggcaaaugucaacaccuguuauuuuaauuuugacaaguuuucuuuaaaauuugcuauaaagucuuugauugauagaaagagaaaucuauaaauuggaagccaaaagcuggagauaauauuaggcccuccuaagcacuggguccaggaauacccaccuaauucagagagugagcuaagaacauuguugaucacuuugucaucaacuggucaucuccuccaggcaaaccauuuuuguuuuauuuauuauuauuauuauuuuacuguuaugaagucucugguucacugauguuggugagauuggcccaagacccgugaaggcguggaaaauauuauuuaaaauauguguguaggccgggugcgguggcucacgccuauaaucccagcacuuugggaggccagggcggguggaucacauggucaggagaucgagaccaucuuugcuaacacggugaaaccccgucucuacuaaaaauacaaaaaauuagcugggcgcuguggcgggugccuguagucccagcuacucgggaggcugaggcaggagaauggcgugaaccugggaggcggagcuuccggugagcggagaucacgucucugcacuccagccugggugacgagcaagacuccaucucaaaaaaaaaaaaaaauguguguagcucuguuguuuccguuugaguugcacaaaaugaccaaauaggaccuuuuuauuuccuucccauuuuacuuauugcauuaaccuuagcaagaagucaagaaggcugggcgugguggcucacgucuguaaucccaguacuuuggaaggcugaggcaggcggaucacuugaggucaggaguucgagaccauccuggccaacguggugaaacaccgucucuacuaaaaauacaaaaauuagccaggugugguggugggcgccuguaaucccagcuacucgggaggcugaggcacaagaauugcuugaacccaggaggcagagguugcagugagccgagaucacgccacuguacuccagccugggugacagggugagacucugucucaaaaaaaaaaaaaaaaucaagaaaagggccaggugugguggcucacaccuguaaucccagcacuuugggaggccaagauggguggaucacuugaggucaggaguucgagaccagccuggccaacauggugaaacccugucucuauugaaaauacaaaaauuagccagguaugguggcacgugccuguaaucucagcuauucgggaggcugagacaugauaaucgauugaacuggggagguggagguugcagugagccaagauugcaccacugcacuccagccugggugacagagugagacuccaucucaggggagaaaaaaaagaaaucaagaaaaggaaaacauuucacacauacccuugcauaugcacugucuucauuauucccuguucauuucugguuguaguuucuuugccuacauauuuauuacauaguauuacagaaugauuuucuuccccaaaugaaauacuuauccgaugguaauguaauacuccuuguaguuugauguaccauaauuucauuuaauaaauuguccuuuuuuucucuuugacaguauaacacugccuuuaaauucagauguccccaagguauuugcagcguugccugaguuuuauguagaagauguugcagaauuuuuauuuuuuauuguacaguaagugccuuuaauauuuuacauaguucuaauauguuuuuaugcauaauaguauaauauucugagcuauguugcaaaccuccauuucaugccugaaauuugauguaacuguuuuaacugaaugcugccuagagacuggaaaaaauaaauccaacuguggcaucaguccaauuccaauaauaucucaaagacagaggcaggauuaacagugcagauaauguauuccuugaaaauugaguugaauuucuaauaguuaaauauguguuucugagcaacagaaggaggaaacaguuuauaaaugucugaaugaacaucccaaaaccagaaauauccacaucuauauuuuguacuaaaauuugucucaauuguaaaauuggagaaugcuuaccaagaaaugguuugaauuucuaacugguauuguaggguuuuaauuuuuuuuucaaauccuuauuugguuuaucaaauuaacauuuuauuucuaaaacauuacagguuagaagaauuacaauuucaaucccuuggcaccaugauagcaccuaugacuagcugagggagugguaugugaagucuauugugaaaaguaaaagucaugcugggcacuguggcucaugcuuguagucccagacaugcaggaggauugcuugagccuaguucaagaccagucugggcaaugcagcaagucugcaucucuuuaaaaaauaaauaaauaaauaguauagguccccagucacagaauacaaauugugaaaguuuuguaacaaacaacaggaaaaaaacaaaauuaguauaaaugauuuuaaaauaagggccaaaaguaaauggagcaaguuaauauugcugucauaaaagcugccuuuaaaaaaaagcccaaaucaaggcagagguugcaaugagcagagaucaugccacuacacuccaaccugggcaacauacacaaaaaaacccaaaucauuggugacacgugauuuugauugguaugaaauuuuaaaagugacucaaaaacgugguuuauuuguugaaaaaccaaccuuggaauuuaagcaacucaagucacauuuuaaaauuuguucuaugcacagugauacaaaagacaccuauuugaaaaauuucauuuauucucauuuucagcagagauuaaaaaaaaacuaucaaaauuuuuauguuuugguagugaugaucuuuugugaaguuuaucugauuugaucauagguuuuguuuauaguuaauauaacaugcuacagccaguaaccauguuugguuuuaaaucugucuuguuacagugugaauagucacuguaggcugggugcaauggcucaugccuguaaucccagcacuuugggaggccaaggugggcaaaucacgaggucaaaagaucaagaccauccuggccaacauggugaaaccccaucucuacuaaaaauacaaaaguuagcugggcaugguggcaggcaccuguagucccagcuacucaggaggcugaggcaggagaaucgcuugaacuuuggaggcggagguuucagugagccgagauugugccacugcacuccagccugggcaacacagcgaggcuccaucucaagaaaaaaaaaaaaaaauaggcugggcgcaguggcucaugccuguaaucccaccauuuugggaggucgaggcgggcggaucacgaggucaggagaucgagaccauccuggcuaacauggugaaaccccaucucuacuaaaaauacaaaaaaaauuagccgggcaugguggcaggugccuguagucccagcuacucgggaggcugaggcaggagaauggcgugaaccugggaggcggagcuugcagugagccgagaucgcgccacugcacuccagccugggcgacagagcgagacucugucucaaaaaaaaaaaaaagucacuguaaacugaaugaguucaagggcacucccaaaccuacuuauccugccuuccccuccucacuuacugacaccagccuucacccaagaugaguuucucagcaguuucucagcggucucuuucuugcucuucuugccucuguucagauacucuccccaggcgcuuuaugagcccuguacucaggauauugugauguuccuuguugugauguugugcaaccagaacuacauccgaaacccauauuugguggccaaacugguagaagucauguuuaugaccaacccugcuguucagccacgaacccagaaguuuuuugaaaugauugagaaccauccucucuccaccaaguuguugguaccuucccugaugaaguuuuauacagguagguugcuggaacacaguguagcacauggcaggccaacuuagguaaggucaucuaaagcuaguggacgacguugcucuaagccuguuaccuaauauccugcuaccuguguguauagccuacuaaccuguggccugcagaggauguacuuuugguucuucuugcccugaguaguuaggaauaggacaaccauuccaccuacuggucucugaugauucagcaggaacuacugaaagucagaugauuggcaccgagacccaggguaucaagagcacaaguugguaguguuaucugaauggaauuaucugguucauuuuaccuuugaacuuacagcauuuguuuuuuaacacuauccuauaacccacuuuccaaagugugggugaaacagggagcuuguuaaaaaugcauauucuugguccgggugcgguggcucaugccuguaaucccagcacuuugggaggccgaggcgggcggaucacaaggucaggaguucaagaccagccuggccaguauggugaaaccccaucucuacuaaaaauagaaaaaaaaauuaaauuagccgggcaugguugcaggugccuguagucccagggcgguugagggaggagaauugcuugaacccgggaggcagaaguugcagugagccgagaucccgccacuguauuccagccugggcaagagaacaagacuccgucucaaauaauaauaauaauaauaauaauaauaauaauaauaccacuuuucaccugucaaauuuauuucuuaaguugaaaauaccugguacaaacaugguuguggagaaguaagcuaaccugcaaaaaaaccugcuuaaucuacccuauagccagugugcagauuuagugcuaugaaacucucaugagaaugcaaauuuaaagccuuucugaaaggcaguuuagcagcccacaccaagagccuuaaaaaugcuuuuaucggggccaggugcgguggcucauaccuguaaucccagcacuuugggaggccgaggcggguggaucaccugagaucaggaauuugugaccagccuggccaacauggagaaaccccgucucuacuaaaaauacaaaaauuagcuggguguggcgggcggcgccugucaucccagcuacucaggaggccgaggcacgagaaucgagugaaccuaggaggcagagguugcauugaacugagaucacaccagugugcuccagccuaggagaaagggcaagacuccgucucaaaaaagaaaaaaaaaaagcacugggauaacaaauaguaggugcaggaaguagccaucuucuaucccucagucuggggacccaagggaagagccuggggaucucagaacccagcugcccugaugagggcuuggacggagcuaggacccaguccucuguggaaggcccuuggccaguaggugcuggugucucucucggggguugugcacgguugcuagcucuggggguacgagacaaagcugaaaauuggaaccaacugcuacugcugacaguaagugcaagguccuaagucccuuguuucuccuucaguuuuccaguucuccugcagcacccccuauuggcaacccuagagagggcgggcugccaaaggaaagauucugcagugccagccccagaaucacaaagccaacuacaaagagugcaugugggcugggcacggugacuccagcuaauaauccuagcacuuuaggaggccaaggugggaggauuguuugagccuaagaguuggagaccagccugggcaacauggcgagaccccaucucuacgaaaaauuuaaaaauuagaugccuguugucccagcuacuaaggaggcagaggugggaggaaggcuugagcccaggaguucaaggcugcagugagcuaugaucuugcugcugcguuccagccugugaaacaaagcaagacccuguuucuaaaaaaaaaaaaaaaaaaaaaaaaaaaaggguaaaaagacuggguuucggccaggcacaguagcuuacacuuguaaucccagcacuuugggaggccaaggcaguggaucaccugaggucaggaguucgagacuagccugaccaaaauggugaauccuagucucuacuaaaaguaaaaggccgggcgugguggcucacgccuguaaucccagcauuuuggaagacugagguggguggaucacaaggucaagagaucgagaugagccucgccaacauggugaaaccccgucucuacuaaaaauacaaaaauuaggccuggcacaguggcucacgcuguaaucccagcacuuugggaggcugaggugggcgaaucaccugaggucgggaguucaaaaccagccugaccaacauggugaaacccugucucuacuaaaaauacaaaauuagccuggcaugguggcacaugccuguaaucccagcuacuugggaggcugaggcaggagaaucacuugaacccgcgaggcagagguuacggugagccaagaucgcgccauuguaauccagccugggcaacaagagcaaaacuccgucucaaaaacaaaaauuagcuggacaugguggcaugugccuguagucccagcuacucgggaggcugaggcaggagaaucucuugaacccgggaggcagagguugcaaugagccaagaucgcgcuacugcacuucagccuggugacagagcaagacuucaucucaaaaacaaaacaaaaaacaaaacaaaacaaaauuagccgggugacgcaugcguguaaucccagcaacuugagaagcugaggcaggagaauagcuugaacccgggagguggagguuguaguuagccgagaucuaaaaaaauuuuaaaaaaaaagaguggauuuggagcuacgagacaacagcugaauagcuauacucugacauaagaauuuaauuucuugaaauuuauucaauggaaauaauuacgaauguuuguaagugauguucuccacagcauuauuuauaaagcagugcagugaaaauaauaaaaacaacuggccgggcucagugacucacgccuguaaucccagcacuuugggaggcugaggcaggaggaucaccugaggucaggaguuggaggcuuagucuggccaaaauggugaaaccccgucucuacuaaaaauacaaaaaaauuuagcugggcguaguggugcacaccuauagucccagcuucucuggagucuaaggcagaugaaucacuugaaucagggaggcagagguugcagugagccaagaucgugccauugcacuccagccugggcuacaagagcaaaucuccaucucaaaaaaaaaaaaaaggaauguagggaaggacauauaccaaaauaguaacagcgcauugguuauuuuugaaugguagcauuauaaauaguuuuuauuuuuauuuuauuaucugaacuucuuaauuuuucuacaguaaacauguauuguuaguaguaaagacaaaacaauuuuaguuaaauuuauuuuguagucaguguucugggccugucacuguggcuucaggagagagagagagagagagaguguguguguguguguguguguguguuuguguauuuguguuuacacaacagaacugggccuguugccuauaagacgagugcugggccuaguggaguccugcugggaauguuccagaaggaauuggguggggguuguucucucuuuccucuuugccaugugugcccucuggccuggaccaccucuucagucauagauggaugacaucuguacuaauaauagccaccacuuauugaaugcuuacuaauccuuucacuuaauccccacggcaguccuaaagauaguacuauaaauacauccacuuuacaaaugaggaaacugaagcuuaaaagggucaagaagcuugcugaaggucaguggcuagcaaguggcagcaaccucgcagaugcccuuuagcacaggucccccuggcuacugugcuggucuuccuacagcuacuaagggaccggugugaggguaccccugagggaggcaucacagacauaguccccagugcucaucaccuccaugugaagaccuggcugauuagguccuggucccugagcagaugggacccucagauauaaauuaaaaguugccacacacaagaucaguauguggaacaagcuccucuuaacaccacagagauaguauucuagcuuagaaaaugcucaaguuaggcugggcgugguggcucacgccuguaauccuagcacuuugggaguccgagacaggugaaucacuugaggccaggaguuugagaccagccuggccaacauggcgaaacccugucucuacuaaaaauacaaaagauuauccgggugugguggugggggccuguaaugccagcuacuugggaggcugaggcuggggaauugcuugaaccgggaccugggagguggaggucgcagugagccaagaucuugccacuguacuccagccugggcuacagagugagacuccaucucaaaaaaaaaaaaaaagaaagaaggcagcaagaauaccuggggggaggagggagagguucaacacaagucuaguccaccuacggccuucuagaacaaggaccugggaauuagaacuugggcugguaugacuuugagggaacaguagaagugaauaagaagaaaaaaaaacuguugggagaaauguauauuguuuuguuucauuuucuuuucuuuuuuuuuuuuuuuuuugagcuagggucuugcucugucacccacgcuagaguguagugguacaauuacagcaccaugcacucuugaccucccgggcucaagugauccuccuaccucagccuccccuguagcugggacugcaggcaugugccaccacacccagcuaauuuuugugguuuuuguagagacgggguuucacgauguucaccaggcuggucucaaacuccugagcucaagugaucugcccacccgggccuccugaagugcuggaaauacagaugcggggcccugcugagauacauauugcuacauaauaaauuaacauuuacuuagucucuacuauauucagaauugggugcagauauuggggcauuuuagaugauaugaggcguuggguugguccuccuguaucuuccucuuguaggcuauccuuaugucaacacuccacacuuuagcucaugcuuuuauacaauuaauaaaugacauuuaguuuauuuuaaggaaagguuacuuaaugaauauacauaaguacuuucggaucuuaguaugauagguguuaauuaucuuauuuuauuuuuaaauagcuguuuccuuuuuuggucacacacaaaaaaauguguucuuuggaaaauacagaaaauaucaaagacaagguauaguggcucacaccuguaaucucaguacuuuggaaggacgauguaggaggaucgcuugaggcaggaauuugaaaccagccuaggcaacauagugagaccccaucuguaaaaaaauuaaaagugaaaaaaaaaauuuuugagacagagucuugcuuugucgcccaggcuggagugcaguggcaugaucuuggcucacugcaaccucuguaucuggauucaagcaauucuccugcuucagccuccugaguagcuggaauuaugggcacacaccaccaugcccugcuaguuuuuguauuuuuauuaauaguagaggcgggguuuugcuauguuggccaggcuggucucgaacuccuggccucaagugaucugccugccucggccucccaaagugcugggauuauaggcgagagccaccacgcucagccauaaaaaauaagccacgcgugguggauacaccuccagucccagcuacuugggaugcugaggugggaggaucacuugagcccgagagguugaggcugcagugagccauuauucacaccacugcacuuuacccugggugacagggcaagacccugucuccaaaaaaauaauaauaaaauaguugggcacgguggcucacaccuguaaucccagcacuuugggaggccaagguggguggaucaugaggccaagagaucgagacaauccuggccaauauggugaaaccccaucuuuacuaaaaauacaaaaauuagcagggcgugguggcgcaugucuauagucccagcuacuagggaggcugaggcaggagaauugcuugaaccccgaggcagagguugcagugagcugagaucgugcuacugcacuccagccuggcgacagagcgggacucugucucaaaaauaauaauaauaauaauaaaauuugucaugaauucugaaauuucucaugccuaagcuuuugccauuuggacaaacaaguuugauuuuuaucccucuuuaauagauuuagggaugauagacacauugguguuuuuucaacaccaaaaauggucaauagauagacacauuuaguaaauacauggcccucaauaaaauuaaaccuaacuuuuuauccgcugaaguauguccauuugaggugccauagaauuucuguaaauuaauaacuuaaaauuagguggggggaguaugauaauucagcuuuuggucauugguaaguugauguuguccuaaugaugggaguuuuccuagccccguuccuuuagguguugugucauugucaaaucuucauugugaaacuuuugucuuuaaaagcagcuuauaauuucugucgugcccuacaugcaaaagaagugcaaaauuucaccagcucucugauuuugcagguuuacauucacucaguaucauuguuggggcaauaacuggauuuggaaagcaagaaaauacauaucccucaguaccuuugucuuucuucuuuagauguugagcauaccggagccaccagugaguuuuaugacaaguucacaauucgcuaucauauuagcaccauuuuuaaaagccuuuggcaaaacauagcucaccauggcaccuuuauggaggaguucaagugaguauggggccccucgugucacaacuugcuuucuugcaaaucgcagguaggauugcagcuuaaaagcaugcacagcuggguucuuguugacuguuugcuuggucucagacuccuuugaguuuaccacaagaugccacuaaaugugggcaggauuuuuuaaauggcuuuacuugcaagauauugcugaauuuuagauuugucaagauacuuugggggugguacacaagcgaagauuguauagggcagggcgugguggcucacgccuguaaucccagcacuuugggaggcagaggcgggcggaucacuugaggucaggaguucaaaaccagccuggccaacauggugaaaccccaucucuauuaaaaauacaaaacauuaacugggugugguggcgcacgucuguuauccuagcuacuugggaagcugaggcaggagaaucacuugaacccgggaggcagaauuugcagugagccgagauugugccagugcucuccagccugggugacagagcgagacuccgucucaaaaaaaaaaaaaaaaaggaaaagaaaagauccuauaaauaugcugagaugauggguuaaguguuuuuuugguguuuucuacgaugacaguguuaaaugaaguugucagaaugagugaaaugaaaucuuaguuccugaauguuggaaggacuuuagauuuugcaacaauuaggucagaguugucauuuaaaguaucauucuuugugguaaggcccuaaaccuuaauuaaagacuuuucauauaccuaccugaaaucugagugacugcuuaaaccuggacauuaguaauuccaucuaaauuaucugucagugccuaaaaacaaaagggagaugaagaugcugaacucuugaauuauucuucaaaaauuuuaucccaucuaagggccgggcgugguggcucaugccuguaaucccagcacuuugggaggccgagcagggcggaucaggaggucaggagaucgagaccauccuggcuaacauggugaaaccccgucucuacuaaaaauaccaaaaaauuagccaggcaugguggugggcgcgguggcgggcgccuguagucccagcuacucaggaggcugaggcaggagaauggcgugaaccugggaggcggagcuugcagugagccgagauggugccacugcacuccagccugggcgacagagugagacuccgucucaaauaaauaaauaaauaaauaaaaauuuuaucccaccuacuuggaucuuuugcaacccauguuagaucuuugaucaaaucuagcuauacuuguuaaccgaauuacuagucaauaauauacaaauuaccaguggaauaacuauuugccagauagauuucugugaagcaaacuuuuuaacuuuuuguuuccauaaacugcucuuauggucagaauuguguuccagcuaaagccuggcacgaggcaggcccauggcuuggucugaauggugcugauuggagcgcuuguccugaacuugccauguuccugagaucgaggccuccugcacuuguucacaggaacuucucuucuccagcaugggcuuaccaccccguaguugcacaguuguagacccugaaguguagcuucuuuuuuucucuacgaaucuggcaucuccagagucuaacagagguaggccaagcuauuucaguucaccagcaaguucucauuauaacacgaucugcagaacaguuccuuagauuggaggcuuccaguuuuaaaguaaguuaauaucccacuuuaucaauauuacagguuccaauuuuucuuccaugcgucagucuuugugauaaggaauaacuauaucaguuguuuucuuaucuguuguaugugguuaauuauuugcauuuucuugguauauuggugaguauaugcguuuuuccuguucuagucuggaagaaguguuuucucuccuuaaaaacauugagggagugagcuaggggugugcugguaagccugcucugggaagcagggugggggagucagcauuugcugguuuuccauggugugacuguuuccucuguugcccaauuuaaggugccaggggaaucugguuauaaaauucuggaauauuuagcacuugacugucaucagccgugcaagguggcuccaaauaccacuggaaugagcuuaucauaaacaauuuaaaagaauaacaaaauccaggccaggugugguggcucaucucuguaaucccaacauuuugaggggcugaggugggaggaacgcuugagcccaggaguuugagaccagcccuggcaacauaacaagucccugucucuacaaaaaauacaaaagcugggcgugguggugugugccuguaguuccagcuacuuaggaggcugaggcaggaagauugcuugagcccuggaggucgaggaugcagugagcugugauugugccacugcauuccaggcugggcgacagagugagacccugucucaaaaagaaacaagauuaacauaaucuaaagagaagcuuggugguccuugaauuccauagugccugacuugugccaggguagccaggcuuuuagggugagauaguugcagucuggguggaggugcuuguucccugggauuugcuguggcauuuugcuucagggagauguaugaccauguacaauauaauugccuuuccagcuccgggaagcaguuuguucgcuauauaaacauguugauaaacgacacgacguuuuugcucgaugaaagucuggagucucugaagcgaauccaugaagugcaggaagagaugaagaacaaagaacagugggaccaguugccccgggugaggacgugguccagaggcuuggacagcuuugcaggccaucugccuccacacacgggcagagcugcuuuggggcugcauuugugggucugaugauaugcgaucugacaugcugggauuuuccuuccaugaaaucauauugcaggauuggaauaggaaaauucuuaaauaccuuaucugaagcuaagaaauggguugagaagucuuugaaaauguacacugaaaacuuucucugccuuuuuaauuuuaaagggcuuuuuuggagaugagcuuuuauugucugaauauauuaauauucaugaacauaauuaggaaagaaaucucuagaauuaugucugcuggacaagaauuugauuuguuccuaugggcuucucuaggcaacugugugaaucacucaggauccuggcgggguguuuuuucccuuucaguugaucuuggguuuuauauucaguuauuaauagaaaagaggccuggcuugccagguuccauggaaagcacgugccgugccaguaccagugcucuuuccugacgugcguagcagccacugagauacuuccuuggucgcuuaugaggcccuugacaguugcuggugacuucuuagauuggcuuagguuuauugauucuguucuuggaauugucaggcucagaaucagaacugauuuccauaagggguucucaugucaaaguggggacugcuuuuucuucacuuuuucuuuuuuuuuuuuuuuugagacggaguuucacucuugucgcccacgcaggaguacaguggugcgaucucuucucacugcaauccccgcuucuccgguugaagcgauuuucgugccucagccuucugaauagcugggauuacaggcgccugccaccacaccuggcuaguuuuuguauuuuguuuguuuguuuuugagacggagucuugcucuuucacccaugcuggagugcaguggcacgaucucagcucacugcaaucuuugccuccuggguacaagugauucuccugccucagccucccaaguaguugggacuacaggcaccugccacuacgccuggcuuauuuuuuguauuuuuaguagagaugggguuucaccguguuagccaggauggucucgaucuccugaccuugugauccgccuuccucggccucccaaagugcugggauuacaggcgugagccauugcacccggacaauuuuuguauuuuuaguagugacgggguuucaccauguuggccaggccugucuuggacuccugaccucaggugauccauccgccucagccucccaaagugcugggacuacaggcgugagucaccgcgcccagacuuuuuuuuuuuuuuuuucuuuuuuaauuucaacuuuuauuuuagauucaggggaugggguacaugugcagguuuguuacauggguauaccgugaugcugaggcuuuaugauucagccugucacccagggagugagcauaauaccuaauagguaguuuucaacccucacuccucccucacuccccucccuuguaguccccagugucuguuauucccgucuccguccauguguaccaauguuuagcucccauuuauaccugcuuuucuucuuauguauuaaaguucuacccauucucugaguaagguccuauccaaauacucccucagguuugucuucgccaaucagcauagcugaaaauucucaccuuucuccuuacuucuguaacacccacuuuauaccauucacagugcuugguaugcccagcuuauauuuuauuuacuuauuuguuuuuuauuauuauuaauaaauaaagacagaguguugaucugucgccuuggcuggagugcacuggcaggaucauagcacaccacagccucaaccuccuggacucaagugauccuccugccucagccuuuguagauccaaagagcuggaucuacaagcauguaccaccacgcuuggcuaauuaaaaaaauuuuuuuuauagagacaaagucucacaugcuugcuucagcagcacguauacuaacauuggaacaaugcagagaagauuaccauggccccugcucgaggaugacaugcaaauucauaaagcauuccauccuuuaaaaauaaauauuaggccaggggugguggcucacgccuguaaucccagcacuuuggaaggccgaggcgaguggaucacaaugucaagagaucaagaacauccuggccaacauggugaaaccccgucucuacuaaaaauacaaaaauuagcugggugugguggcacgccgcuguagucccagcuacuugagaggcugaggcaggauaauugcuugaacccgggaggcggagguugcagugagccaagaucgcaccacugcacuccagccugggcgacagagugagacuccgucucaaauaaauaaauaaauauuaaagagagagagucuugcuaguuuucccaagcuggucuuauauuuuauuuacuuacuauuuuuauuauuaaauuauuuuuuauuuuauuuuauuuuauuuuuugagacagagucucacucugucacccagguuggagugcaguggcgcaaucuuggcucaauuuaugccugcugggauuacaggcgugcaccaccacguccggcuaauuuuuguauuuuuaguagagaugggguuuugccacauuggccaggcuggucuugaacuccuggccucaagcaauccacccaccucagccucccaaagugcggggguuacagacaugagccaccaugcccagccuuauuauuauuuuuuaauagaaacagagucuugaccgggcacaguggcucaugccuguaauaucagcacuuugggaggccgaggccggcagaucaccugaggccaggaguuugagaccagccuggccaacauggugaaacccagugucuacuaaaaauacaaaauuuagccaggcauggugacaggugccuguaaucccagcuauuuggaaggcugaggugggagaaucacuugaacccaggaggcagagguugcagugagcugauaccaugccacuacauuucacauuucagccugggcaacagagcgagacuccgucucaaaaaagaaaaaaaaaaagaaagaaagagucuugcucugucacccaggcuggagugcaaugacagaucuuagcucacuacagccuacaaccuccuggccucaagcaguccucccaccucagccucccaaaaugcugggauuauaguugugagccaccauggcuggccagcguauauuuuagauguuggaaugcaggucuauagcacauucucguauucauagucaguacuuaauagcauuuguuuaugagccaacugaacaaauaauauugauuuuuccuguguuaauggaugaaaaaggcccaaauaauucccacaauugcuauuucagaaauaauuuuuauuuggcuuugaagucacuuucuaccucccacugcccuggcuguuccugcucaucucccugacgucugagcuuggugagcuccagcacucagcccuuaggcuucaauuucuuucccacucaugcucucuagguuaguguuucucaacgagggcacuaguuggaauuuugagccuaguggaauuugguauaauaauaacucaugaugagaaaccaucccauauauugcaggacauuuaggaucucuguuuccugccauuuaaugucagggauguacccuccuacccccagccuucaggcaacgagaaacacugccacacauaaccugaugucccccggugaacaucacugcuuggugagcucagguauaccaaggcauuaaauaccuguguucuaaagacuccagaauauaucucccuggcucagaucugacugcagacuugcagaccaaguauuugucuaaucagugucucaaacucacuguguccaaaacggaacccuugauguuguccacaucuccugccugagucugcccaaucucaguaaauggcgccuucauucuaccagcugcucaggcucgaugcuuuggaguugcucuugauuucucugcgucucucagcaaaugccucuaagcucugucuuaaaauauauccauuaucugaccucuucucagcaccuccagaccguuggcaucucuuaccuggguuauugcaguagcccacugcuuggucuucaaccuccacucuugagcauguccauaucagggaugguguuaaacaucucagucugaucaacaucaccacucagcucagccauuuugggcuucccuuaucacucagagccaaauccuguggugagagcagccuacagcacgcaggaggaccuggccccacaauguguuucugcucucagcuuuggacagucucuucuccacucacucuaccccagccagacucaccuccuggcccuuccacugacacgugagggccuuuacaccugcucuucccccuaccuggaaugcucuucccucagauuuuccgacuccuucagauauacccucccucagggauaccuucccugaccacccuuuccagaauagcauucccugacuccugacccugcuucauuuuuccucaucacugucagacuuacugugugucugucuggguauuuguuucuaugaagcagauccucccuaacggaaucuaagcugcaugagagcugggagccuuuuuauucuaucuccagugcccaaaggcuguagaagggccuguugagacacccagguacacauuuagguaguucacgccuggcuguucuugugucuuuccuggcucugccuuucuuucaguaggcucauucuugaccagggaacggcaggccccccaguaucccugcagaaucuccaucaagcacagacuggagcacuuucccagagggcacucaccggccagcuucagcucugccagcuguguuccuuucccaacaagaaaaggccucugaacagauguaagaauugaggcuuuuccugaugggucuguguuugacccauuucagagccugcagugcaguaccugauuguauccaugagucaaacagcucuuauuaucuccuccccagcccauggcagaguugaaggaggaaagugcgccagagguaagcgugcugacaguucuguggugugacagccucacaguuuggaaagacaaaauuuuaaaagcuuaguaguccacaggcacuuguagaggcagagaggcagacccgauaggccucaauacgguggcacacugcaucucauaguuuuaaaauaaugaagacuggcugagcacgguggcuuacacuuguaaucccagcacuuugggaggccuaggugggcagaucaguugaggucaggaguuugagaccagccugaucaacauagugaaaccccaucucuacuaaaaauacaaaaauuaggccaggcgcauuggcucacgccuguaaucccagcucuuugggagguugaaguggauggaucaccugaggucaggaguucaagaccagccuggccaacauggcgaaaccccaaucuuuaccaaaaauacaaaaauuagucaagcaugguggcacgcacguguaaucccagcuacucaggaggcugaggcaggagaauggcucgaacccgggaggcagagauugcagugagccaagaucgcgccacugcacuccagccugggcaacagagugagacccugucucaaaaaaaauaaauaaaucacacacacacacacacacacacacacacaaaaaaaaaaaauuagcugggcauggugguccacuccuguaaucccagcuacuugggaggcugagacaugagaaucacuugaaccugggaggcggagguuacagugagccgagauugugccacugcacucuagccugggugacagaggaagacuccaucucaaaaaaaaauaacaauaauaauagagggccgggcacgguggcuuacgccuguaaucccaacacuucgggaggccaaggcaggcugaucaccugacgucaggaguucgagaccagccugaccaacauggagaaaccccgucucuacuaaaaauacagaauuagccgggcauggugacacaugccuguagucccagcuacucgggaugcugaggcagaagaaucacuugaaccugggaggcggagguuccggugagccgagaucgcgccauugcacuccagccugggcaacaagcgaaacuccgucucaaaaaauaauaauaauaauaauaauaauaauaauaaugacuaaguaaaaguuauuauuaagggaaauaaacuacccuuucuuagugccaugaugugugucagauacuauguuccauuaucuuauuucauccugaauagaaguugauggugacuuuuuuuuuuuuuuuuuuuuuugagacggagucucacucugucacuaggcuggaguacaguggcgcgaucucagcucacugcagccucagccuucuggguucaagcaguucuccugccucagccucccaaguagcugggacuacagccacgcaccaccacccccagcuaauuuuuguauuuuuaguagcgacgggguuucaccauguuggccaggguggucucgaucucgaccucgugauucgcccaccuuggcuucgcaaagugcugggauuacacgcgugagccaccacgcccggcagauggugacuucuuuuaucauugaggaagcagaguuaaauaaggcaccaacaucaccuggcuggaagucucaaagagcuccgaugcugaaaggaugaaacuucaguuaucugggacauguggcaggcgguucugucauucccuaagcauguuggguuuaucacgcacuuuccaguuaugugcuuggcgcuuugcugagcugaugaccaggaccgagccuuacucagcgucuguucgauguguccuaggaucagcagcaggcucgucagucucagcuugcucaggaugagcgugugucccgcucuuaccucgcccuggccaccgaaaccguggacauguuccacauccucacgaagcagguccagaagcccuuccucagaccggugaguagaaacccggggcucuguuuggugguuuggacuccacauucagacucucucacuuauaacuuuagcaguuguugaaguucuggaaauuuuaggaucacagucaucaauaagugaaauucugugacugauuuuguucccaguuaugcuaauugauaccagacucuguugauggacugaagagcagaugucugaugucaccacauagucuacagccacuuccaaaugccuuacugcacuuugugcuuagacaguacauuggauuauucauguugaugucaugacauauuuuuaccauuauugauuccuauauuuuacuuauagaaaaagcauaaggugccgggugcgguggcucacgccuguaaucccagcacuuugggagcccaaggcgggcagaucacgaggucaggagauggagaccauccuggcuaacacagugaaaccccaucucuacuaaaaguacaaaaaauuagcugggcgugguggugggcaccuguagucccagcuacucaggaggcugaggcaggagaauggcgugaacccgggaggcagagcuggcagugagccgagauggugccacugcacuccagccugggcgacagagugagacuccaucucaaaaaaaaaaaaaaaagaagaagaaaaagcauaagguaacagcuguugacaauggaaggauauuaaguagaauaauugagaccguguaaaaucuuuggcucucuuagcuguaccuuuguuacacucaggaagccaaagguuaaugggagccggccaucacuaggguuuaugguggauugcaaauagucagaauguuuguucucaacuaguaagaccugguuccuauuucuaaaauugaaacugagcagcaucacugaagauuucugcccugcuucagccacccccaccacaaaguugaaaaguuuuaugguguggccaggacaaggguagugaggaaggcaagacggggaccuaagauucgguagccauuugccuauguggagacauguuuacuuuacaauggaauaugacguuacugcauauuuccccugauuuucuguauuugcucuuaccuucguuaugugacucucuguuaugugacuccugucaucagcagaggcacuauugccacucccuggccuggggacaacucuuuuccacucuuuuaacuuuccaccucaugucucuucauaaacagauuucagugcaagagccauggaacacgaaacaaaacagcucagacacuggccucccuuaaaaguuugcaaagugcaaggccauggagcaugaaacaaaacagcucacuggccagacacuggccucccuucaagguuugcagaauucugugaaggccagauaguaaauaguugauuaauuccuuuguaacaaggucaacacccaccuauuuuguacacuuguugggaagacuaagcgaaaacacacauagaaguaccuggcauaaggccaagcacgguggcucaugccuguaaucccagcacuuugagaggccaagaaggguggaucaccugaggucaggaguuccagaccagccuggccaacauggcgaaaccccgucucuacuaaaaauacaaaaauuagccaggcgugguagugcaugccuguaaucccagcuacuugggaagcuguggcaggagaaucacuugaacccaaaaggcagaggucgcagugagccgagaucacgccacuccaaccuggguaacagagcaagacucuucucaaaaauaaauaaauaaauuuauuuuaaggccugcucauagaccugagccaucuguacacuguagcccuguucuuuuggccccagccugugccugugccugcugugauguuuucauuuccuuugcuacacuauuuacuaucuggccuuugcagacaaaguguaaaggcauuucauuuugcaaaccuuuaagguuugcauuuucaccuucuuuacugacuagcucagaucucuccuacuucaaacagaaugaccaacucuguccuguuaugacucuuuuauuucacagcuucucaacagugaaauacaggaguacucugugcaaaagcaaauucuugaaaagcuaaguauauguugaauuuguauaaauccaguuauuacauuucaugaaaaccuugugacuuaaaggaaugcuuucgugacucccuuuuauggccaguguuuaaugcucucuaagccacaucuuccuguuucagguuugcuuaaaaccauguaugcccaaccguaguggguacugagucaccuugugagauuacagcauagauuauuacuauuuuccagguguuucauuuaaguuuacucugucucauugacuagauuuaaaacuauucaaggcauaacuuuuaucuucuuuccuugcauuacuuuguuauuuguaucugauaaguacauaagaaugacacagacugaacugccaggggcuuuuaacauuuauggggaaaaaaguuuaugaaauacuggcuggaagagcugacucaaaacuuuuuuugcucagauaaugguaagauuuguauaauuuucucucuuuuacuuguuucucaaugaauuuggagugauacuuuuuuuaauuaaaagcauaaauguaaagaaaaguuuggcuucuuuugguauuuauaaauaaauauuucaucagccugcaacauuccauuaaguauuagaauuaucagaucagaaauggggaguaaaguugaaauauaauguugucuuucuucagcuuaugauacacagcaccuguaaggauucuuugaagauuaauccaaccaauuccuguuccuccacugaaaugggaguuuuugguccuuuucacuugucucaacagcaugaauuguccuauuauccugugauuuccuaggagcuuggaccccgauuggcugcaaugcugaacuuuaaucuucagcaacuuuguggccccaagugccgugaccugaaaguugaaaacccugagaaauacggcuuugaaccaaagaagcuguuggaccaacugacggauauuuacuuacagcuggacugugcucgguucgcgaaagccauugcugacgaccaggucagugaguugaguuggucucucugugaguuuacuggcagauuuggagauaauaaccacaguggccagggaacucgucugguguaaaugaagaugaguggguuguuuuccuuugagugugaagagcagauuugggcugggcgcgguggcucaggccuguaaucccaacauucugggaggccaaggcagggggauugcuugaggccagacugcagugagccgugauugcaccaccacacuccagaaugggugagagagugagauccugucucaaaaacacgguggcucacgccuguaaucccaacacuuugggaggucgaggcgggcagaucaagaggucaggaguuugagaccagccuggcuaacauggugaaaccccaucucuacuaaagauacaaaaaauuaccucagugugguggugcaugccuguaaucacagcuacucgggaggcugaggcaggagaaucgcuugaacccaggaggcagagguuucagugagcugagauugugccacugcacuccagccugggcaacagggugagacucugucucaaaauaaauaaauaaguaaguaaguaaguaaaaaacaaaaguaaagagcagguuuggcgcucugagcccucuccaguugaguucuuaccccaucuuuuuaagggccuucuugacaaauccauuacauuucugaaaagagcccgguuucucaagggaucagaaucuucuuuccuagucuccugcuagagugcuguuauuuuugggguuguccagauuaaaaaucuugugugguuuucuuuacauucuucccucuccuuuauuccgugggucuccugugagcagaucugucugugugugcuucauuuccacagccaccgauuuaggcuaagcugucccugcgugaucuucuagucaucccauaaagggcuggcccccuccaugguccguucugccucauuuucaacguccucacagcuaauguuuauuaacuguacaccucauuucacccacuuuucguaucuccacccauuuaguccucacaaaauccuuugagguagguucuguaaagucuuuguuuuaaagugaggaaagaggcacagagagguuaaauagcuugcucgaggucacagaguuagugugggacagaggcaugauccauguccaggcagccuggccuugaacccauauccucagucucucugcuguccacuuaaaaugcccacaaagaaccaugcuugucucugugucucugucuuuguucacacuacuuauccaaauacuauucauggcucaaguuaaucaucaguaggcauucuagaagguucuuuacccauaucucauccaaaggaguaauauuacaauagaagcauuguagguacuuuuuuuuaaugacagcuuuauugagcuauaacucacauauguaggugcuuucugauguagcaggggaaguggucuuaacaaaggauuugcagugaaaaaauacauagucaugugcuguuucugucgaugcuggaccacaaagaccauguggccccaucauauuauaauaccguauuuucacuguaccuuuucuguguuuagaauacucaccauuguguuacaacugccgacaggauucaguacagucccacacuguacaguuuuguagccuaggagcaauaggcuauaccauagagccucgacgugguguaggccacgccaucuagguuuguguaaguaaauucuaugauguuuacacagcaacgaaauugccuaacaagacauuucucagagcgacacaugacugugugucuaaagcaguuuuaucauacaaaguaguggcucguaagaggguuaggaaauuuuaguuacuuguagauguuaaaauauauacugcuggccgagcgcgguggcucaugccuguaaucccagcacuuugggaggccgaggcggguggaucacaaggucaggagaucacgaccauccuggcuaacacggugaaaccccgucucuacuaaaaaaaauacaaaaaaauuagccgggcgugguggcgggcgccuguagucccagcuacucgggaggcugaggcaggagaauggcgugaacccaggaggcagagcuugcagugagcggagaucgagccacugcacuccagccugggcgacagagcaagacugucucaaaaaaaaaaaaaaauuauauauauauauacacacacacacacaaacacugcuuuacuagcccccgacuauauaauacugcacugauuuagaaacagaaagcaagucauagccugcagugagggaaagaaaagggaagcacuuacccauugaggugggguccacaccugacuguagcuggcgucuccagcccagccagaggucgguguggaaagccccagggcucuuccaucguugccguagagagacuuggaagagcuguuuagugugcgcccucuccagggugguugugcuguggcugccacaucacaggcgcuuaacguaacacacagaagguuucggugugggugggcacagcacgcccagugaggugaugcaaagcaacugggugacaaaggaaugcuuugagcggccuuuguuuggugaccaaccacacauugcauugccuggucaugccuuagauuauggugguggccucugguggcaccuggcuuggguuguagacagcaguuucuggcacagugacacacggggcuccuugaaugucuaaauaguccuguucuuccagaguggugaaacaaacacacaugugccagugacacauggagagaaaagcauauuuuaagaaguguuggggcugggcgcaguggcugacaccuguaaucccagcacuuugggaggccaagguggguggaucaugaggucaggaguucgagaccagccuggccaagaugaugaaaccccaucucuacuaaaaauacaaaaauuagccgggcacaguggaaggcggcuguaauuccagcuacucggaggcugaggcaggagaauagcuugaacccgggaggcagagguugcagugagcugagaucgcaccgcugcauuccagccugggugacagagcaagacuccauaucaaaaaaaaaaaaaagaagaaguauugggcugggugcgguggcucacaccuguaaucccagcacuuuggggagccgaggcgggcagaucaccugaggucaggaguuugagaccagccuggcuaacauggugaaacccuguuucuacuaaaaauacaaaaaauuagccgggcaugguggugugcgccuguaaucccagcuacucgggaggcugaggcaggagaaucgcuugaaccugggagguggagguugcagugagccgagaucgugccauugcacuccagcuugggcaacaagagcgaaacuccgucucaaaaaaaaaaaaaaaaaaaaguguuuuugcuuccuuucacaguguggugugugugcugauuguuggguauuuucuauuuauauuggccauaagcugauuaggggccugcuuacuugauuguuuuagaagagagcuuugguggggcagggggcgguaagugcagaaggauggaugguuggcaagcacuggggaagagguuguaaaauugcauuuucuucuuuggaagcagcaguaucuuaguuugcuuugguaugucuuaguuugguuugguaugucuuguuuuccgggaaagacaaaggaagaggaaaaugacagcuuugcagguaaagaaacugagaggcuucucucccucuauaccaagaguaggcugaagacccauguccagaaggcugacagaaaggugccugggugaagagccacugagcuugaugcucaggaaucugagggcagagcuccaugccagagaagugggauaccacauugguccugggagccaagaggaccaggauagggagauguuaaaguggccuagacugugucuuuaugggcagacgccaguuccauggacagacugcauaucugucguccaugaagcauugucuguuaacaccauuuuccauuaaaaaagaaaaaaaauucagcaccuacuuagaaaauaaaaaaaaauagccgggugcaguggcucacgccuguaaucccagcacuuugggaggccaaggcgggcggaucacaaggucaggagaucgagaccguccuggcuaacacggugaaaccccaucucuacuaaaaauacaaaaaauuagccaggcgugguggcgggcgcccguagacccagcuacucgggaggcugaggcaggagaauggcgugaaccugggagguggagcuugcagugagccgagaucgcgccacugcacuccagccugggcgacagagcgagacuccgucucaaauaaauaaauaaauaaauaaauaaaaaagaaaauaaaaaaaauaaaaaucccaucagucacacuucccccaugcagucagucuuuccuaaguaauugcucccuccucuaaccuaccagaauaugagucugcgucucacaaauguaaugcuucauuuucuuguuauuuuuuucuucuuuaaugagguaagauuaauauauaacguagaaguaaccauuuaaaaguguaccauuuuguggcauguaguacagucacagcguugcacagccaccaccucuaccuaguuccacuacauguaucaccccaaaaggaaaacccuuaaagcagucgcugucuagacccccuugccccagccccuggcaaccacaaaucugcugucucucuuuuccuauuuuuggauuuaccuauucaccucuccgggauauuucauauaaacggacuuauacaguguguaaccuucuaugucuggcuuccuucacuuagcaucauguuucaagguucauuuguguuguagaauguaucaguauuucauuccuuuuuaaggcugaauaauauuucauuguauggauauaccaccauuuguuuauccucauccauugauagacauuuggguugucuccagccuuuggcucuugcaaauagugcugcuaugaacauuuguguaaaaguauuuaaacaccuguuuucaguuacuuugggucuacacuugggagugggauuguuggucaugugguaauuccauguuuaacuuuuugagggaugccagaauguuuucuacagcugccgcccauuugacauucccacuggcaauguauaagguuuaaguuuccauucuuuuucauuuuuuuucuuugguuuaguuuauauucuuuccaucaugaaguuuaaaaauuaaacauguuaauuuguuuuuguuucuuaaauacucauccuagugggagugacgugguauuucauugcgguuuugauuuguauuucccuaaugucaaauaccauuggacaccuuuucaugugcuugcuggccauuuuuauauuuucuugggagcaaugucuauucauguucuuugcccauuuuuuaauuggguuguuuguguuuuuguuguugaguuggaagaguucuuuuuuucuuuuucuuuuuuuuuuuuuuuuuuugagauggagucucccucuguugcccaggcuggagugcaguggugcgaucucagccuacugcaaccuccaccucccagauucaagcaauucucuugccucagccucccaaauagcugggacuacaggcgugcaccaucacgccuggcuaauuuuuuuuguauuuuuaguagagacgggguuucaccauguuagccaggauggucucgaucuccugaccucaugaucugccugccuuggccucccaaagugcugggauuacaggcgugagccaccgcgcccaaccagaagaguucuuuauguauucuggaugcuaggucauaucagaugauacauguaucauuggauauaugauuugcagauauucuuguguuaguccauugcaucacuauacagaaauacccaaggcuagguacuuuaugaagaaaagagguuuaggccgagcacaguggcucacgccuguaaucccaccacuuugggaggccaaggugggcagaucacuugaggucaggagaucgagaccagccuggccaacauggcaaaacccugucucuacuaaaaauacaaaaaaauuagccagccgugguggcgcacaccugaaaucccagcuacucaggagguggaggcuucagugagccgagagcgugccucugcacuccagccugggugacaaagcgagacuccgucucaaaaauuaaaauuaaaauuaacugggcauaguggcaugcaccuguagucccagcuacuuggguggcuaaggugagaggauugcuugagcccaggaguuugaggcugcagugagccaugauugcaccacugcacuccagccugagugacagaaugagacucugucucaaaauauauauauauauuuauaguaaaacauauauggcaaaaacacuggccacuuguuuugcgauggugauacaaauacaaauauauaucaucacuaagcaaguggccaguguuuuugccauauauguuuuacuauaaauacaaacuacagcauacuuuacuguuuggcauggcagugauuuuuaugaauuaggcaccugugagguagauguuacucugcccauuuuacacucaaagaaccugggcuuaggaggguucagauuugccuacgacugcacagcugguaggugguagagccagaauucaaguucagauuugucuggguccacggugggcgccugaccuccacuccacaacuucccuuccuggggacauaaaucgugucuguucccaggccuauucaucaguucaccaggguggucuaacguccauggagccccugacaugugcuagugcugaacuaaaugagcuugaagaagcuugaaagugaacaggagaaggcuccucuagaguaugaacaauaguggauuguuuuuaccaugcuuaccuuuguggaagagagcugaaauuuucaccucuucuuucuuauaggcugccagggcacagugccccccaaggacugaaauagacuagauuuccuucucuuuuuaauguuuaaacuuuaaaagaaaugcgugcuagcuguaaaaauucaaaaaaaaagcccgucugccucaguccugcagcccucuccagagggagugaccucguacaguuuggcacauauuauuccagucuuuauccauuuguaagcauaaaaagugcauacuuuuaugaggcuauaaaugcauaaagacggauauauaaaauauauaaguguauauauaauuuuagggcuuuuuuagugggggaaaauccacaaauggauaauacuuuggauauuuucugcagcucgcuuuuuuccaccugacguacauuuacgucucacauugccauuccuccuuugcagagauccuacaguaaggaauuguuugaagaaguuauuucaaagaugcggaaggcagggaucaaauccacaauagcaauagaaaaauuuaagcugcucgccgagaaaguggaggagauaguggccaagaacgcacgcgcagaaaucgacuacagcgacgcuccugaugaguucagaggcaaguggacucgucguuuucaugcugauuucuuuugaguuaacuggaaaucgauaacauuacaagaggacguccugugcaauuaauuuuuuaauggugugcuagagcugcuuuuugagacaaucugucuuaaauuacauuugccuauuuuuagcucauauuguaaauugagaggaagaaacauccuuagcuuagccugacuuaaagccagauaacaacccugaagauucuaagggcagggcugccuuugcaaguggggauucacauuuucaaagaauucccagaaguccuaagacaaagaauuccagccugccguccucgccacggagccuguggggccugcugcugggucugucccaggcuuucuucucuguucccuccccccagcaguagcugacaaagaagcgccuuccccuuacaaaaggcaauguauaugccuuuauugaaggcugauuuccuucuaaaccugggggccucacaggggcccuuugauugcuguuccuuuggauagauuuuucgcugguagaacgggcuuuguuuucuuuuucagucgugggcucucaguagauuagaguuugcuuugcuuuguccccgcagacccucugauggacacccucaugacagaccccgugcggcugcccucuggcaccaucauggaccgcuccaucauccugcggcaccugcucaacucccccacggaccccuucaaccggcagacgcugacagagagcaugcuggaaccagguagaggagggugcaguuugaggugcagcgcuggcgucaguaccaagagauaaagcccaagucacauauuggagaugaagcagaagggaaauuuaucaaaugcagaaacuaccuacuuuaugacacucuguagcaaagacccaaaacacucuuggcccuuuuucccugcagacauccagucccucccucucaugucccaguccuucuggagucuucggcucaaugagggaaagaauggccuuuucuucccauuuauacagagcgacaagcauccucucucaggaagagcccucccaucuggggcauuaauccuccuuuuuuucuuuucucagugccagaacugaaagagcagauucaggcguggaugagagagaaacagaacagcgaucacuaaaccguuccgccgcccacccucugcuagacacagccaaggccaacgaggcaagcagaagcagcggccgcagcgaagcugccguucauguguuggaggccaaauguggcaaaccaaccccaggcccacccagagcgagcaaacgcugagaccugaaaggacauggaugagaagaggagcccgcuuccuguacauauauuuaagugacaaacacggucaaaagcuuaagggacagguuuuaugguugcuuguguaauaaagcauguccuucguaugucacaguuuggggcaacggaagucuuuuagugauggcuaaugggucugggcagcaucccuucaugaauuuuuuuuuaauccaauauccguugauuugauugugauuagagaaccuuggacauuuugcugcuaaagaaucuuuuuuccccucucccccuuccugacccuacuugcacugcuguggauuuuuuuaagagaagcaaaaacaaaaguaaacuccuuucccuggcccuccaaacauauauucugugagauaacugugccugcuaccaaguguuaauccugggaucguauuuuuauaucauauucacauauuuguuuuuuuaauugguguuagaugacaugauuaauaaaaaaggcaagauauuuucagaauuugaauuucaguuuuuuuuuucuuuugaaaugucccuuuaagauuuuuuuauucuaaacaaaauaaagaaaauccugcugcucugguccuugugauaagccucucuucggcaucugaggagcagcugcagcaaaaucuagggguguaaguguaucaggacuuaugugacuuauauuuuggggagaugaggguuggguuuuuuuuuuaaugcuacgugacaguuugaaaccuucacaguuauccucuggggguaaaucaauucuucaacccuugggugugugaguuugaggcagggucauuugugugauguguuuggccuuaccaaagcaaaagagggugcaagaaugugggaguaugucugccgguuucaacacacacagacaaacacagccacacgcgcacacaaguauaagacuuuuuguauuacugcucccuacuuaacauacuugaauucucaaauuuccuuugggguaaaaaaaaaaaaaggauuugaaaccauaaaguguucugaagaaauuaagucuauaaaaagcauacuuucuuuuuucuuuuccuuuuuucccuccacagacaauguccucuguucaauuccuaacgcaaacuacaauaaauggugacacacguucagaagaa

SEQ ID NO: 191433 - RNA, 148256 nt, Homo sapiens
uucuucugaacgugugucaccauuuauuguaguuugcguuaggaauugaacagaggacauugucuguggagggaaaaaaggaaaagaaaaaagaaaguaugcuuuuuauagacuuaauuucuucagaacacuuuaugguuucaaauccuuuuuuuuuuuuuaccccaaaggaaauuugagaauucaaguauguuaaguagggagcaguaauacaaaaagucuuauacuugugugcgcguguggcuguguuugucuguguguguugaaaccggcagacauacucccacauucuugcacccucuuuugcuuugguaaggccaaacacaucacacaaaugacccugccucaaacucacacacccaaggguugaagaauugauuuacccccagaggauaacugugaagguuucaaacugucacguagcauuaaaaaaaaaacccaacccucaucuccccaaaauauaagucacauaaguccugauacacuuacaccccuagauuuugcugcagcugcuccucagaugccgaagagaggcuuaucacaaggaccagagcagcaggauuuucuuuauuuuguuuagaauaaaaaaaucuuaaagggacauuucaaaagaaaaaaaaaacugaaauucaaauucugaaaauaucuugccuuuuuuauuaaucaugucaucuaacaccaauuaaaaaaacaaauaugugaauaugauauaaaaauacgaucccaggauuaacacuugguagcaggcacaguuaucucacagaauauauguuuggagggccagggaaaggaguuuacuuuuguuuuugcuucucuuaaaaaaauccacagcagugcaaguagggucaggaagggggagaggggaaaaaagauucuuuagcagcaaaauguccaagguucucuaaucacaaucaaaucaacggauauuggauuaaaaaaaaauucaugaagggaugcugcccagacccauuagccaucacuaaaagacuuccguugccccaaacugugacauacgaaggacaugcuuuauuacacaagcaaccauaaaaccugucccuuaagcuuuugaccguguuugucacuuaaauauauguacaggaagcgggcuccucuucucauccauguccuuucaggucucagcguuugcucgcucugggugggccugggguugguuugccacauuuggccuccaacacaugaacggcagcuucgcugcggccgcugcuucugcuugccucguuggccuuggcugugucuagcagagggugggcggcggaacgguuuagugaucgcuguucuguuucucucucauccacgccugaaucugcucuuucaguucuggcacugagaaaagaaaaaaaggaggauuaaugccccagaugggagggcucuuccugagagaggaugcuugucgcucuguauaaaugggaagaaaaggccauucuuucccucauugagccgaagacuccagaaggacugggacaugagagggagggacuggaugucugcagggaaaaagggccaagaguguuuugggucuuugcuacagagugucauaaaguagguaguuucugcauuugauaaauuucccuucugcuucaucuccaauaugugacuugggcuuuaucucuugguacugacgccagcgcugcaccucaaacugcacccuccucuaccugguuccagcaugcucucugucagcgucugccgguugaagggguccgugggggaguugagcaggugccgcaggaugauggagcgguccaugauggugccagagggcagccgcacggggucugucaugaggguguccaucagagggucugcggggacaaagcaaagcaaacucuaaucuacugagagcccacgacugaaaaagaaaacaaagcccguucuaccagcgaaaaaucuauccaaaggaacagcaaucaaagggccccugugaggcccccagguuuagaaggaaaucagccuucaauaaaggcauauacauugccuuuuguaaggggaaggcgcuucuuugucagcuacugcuggggggagggaacagagaagaaagccugggacagacccagcagcaggccccacaggcuccguggcgaggacggcaggcuggaauucuuugucuuaggacuucugggaauucuuugaaaaugugaauccccacuugcaaaggcagcccugcccuuagaaucuucaggguuguuaucuggcuuuaagucaggcuaagcuaaggauguuucuuccucucaauuuacaauaugagcuaaaaauaggcaaauguaauuuaagacagauugucucaaaaagcagcucuagcacaccauuaaaaaauuaauugcacaggacguccucuuguaauguuaucgauuuccaguuaacucaaaagaaaucagcaugaaaacgacgaguccacuugccucugaacucaucaggagcgucgcuguagucgauuucugcgcgugcguucuuggccacuaucuccuccacuuucucggcgagcagcuuaaauuuuucuauugcuauuguggauuugaucccugccuuccgcaucuuugaaauaacuucuucaaacaauuccuuacuguaggaucucugcaaaggaggaauggcaaugugagacguaaauguacgucagguggaaaaaagcgagcugcagaaaauauccaaaguauuauccauuuguggauuuucccccacuaaaaaagcccuaaaauuauauauacacuuauauauuuuauauauccgucuuuaugcauuuauagccucauaaaaguaugcacuuuuuaugcuuacaaauggauaaagacuggaauaauaugugccaaacuguacgaggucacucccucuggagagggcugcaggacugaggcagacgggcuuuuuuuuugaauuuuuacagcuagcacgcauuucuuuuaaaguuuaaacauuaaaaagagaaggaaaucuagucuauuucaguccuuggggggcacugugcccuggcagccuauaagaaagaagaggugaaaauuucagcucucuuccacaaagguaagcaugguaaaaacaauccacuauuguucauacucuagaggagccuucuccuguucacuuucaagcuucuucaagcucauuuaguucagcacuagcacaugucaggggcuccauggacguuagaccacccuggugaacugaugaauaggccugggaacagacacgauuuauguccccaggaagggaaguuguggaguggaggucaggcgcccaccguggacccagacaaaucugaacuugaauucuggcucuaccaccuaccagcugugcagucguaggcaaaucugaacccuccuaagcccagguucuuugaguguaaaaugggcagaguaacaucuaccucacaggugccuaauucauaaaaaucacugccaugccaaacaguaaaguaugcuguaguuuguauuuauaguaaaacauauauggcaaaaacacuggccacuugcuuagugaugauauauauuuguauuuguaucaccaucgcaaaacaaguggccaguguuuuugccauauauguuuuacuauaaauauauauauauauuuugagacagagucucauucugucacucaggcuggagugcaguggugcaaucauggcucacugcagccucaaacuccugggcucaagcaauccucucaccuuagccacccaaguagcugggacuacaggugcaugccacuaugcccaguuaauuuuaauuuuaauuuuugagacggagucucgcuuugucacccaggcuggagugcagaggcacgcucucggcucacugaagccuccaccuccugaguagcugggauuucaggugugcgccaccacggcuggcuaauuuuuuuguauuuuuaguagagacaggguuuugccauguuggccaggcuggucucgaucuccugaccucaagugaucugcccaccuuggccucccaaaguggugggauuacaggcgugagccacugugcucggccuaaaccucuuuucuucauaaaguaccuagccuuggguauuucuguauagugaugcaauggacuaacacaagaauaucugcaaaucauauauccaaugauacauguaucaucugauaugaccuagcauccagaauacauaaagaacucuucugguugggcgcgguggcucacgccuguaaucccagcacuuugggaggccaaggcaggcagaucaugaggucaggagaucgagaccauccuggcuaacauggugaaaccccgucucuacuaaaaauacaaaaaaaauuagccaggcgugauggugcacgccuguagucccagcuauuugggaggcugaggcaagagaauugcuugaaucugggagguggagguugcaguaggcugagaucgcaccacugcacuccagccugggcaacagagggagacuccaucucaaaaaaaaaaaaaaaaaaagaaaaagaaaaaaagaacucuuccaacucaacaacaaaaacacaaacaacccaauuaaaaaaugggcaaagaacaugaauagacauugcucccaagaaaauauaaaaauggccagcaagcacaugaaaagguguccaaugguauuugacauuagggaaauacaaaucaaaaccgcaaugaaauaccacgucacucccacuaggaugaguauuuaagaaacaaaaacaaauuaacauguuuaauuuuuaaacuucaugauggaaagaauauaaacuaaaccaaagaaaaaaaaugaaaaagaauggaaacuuaaaccuuauacauugccagugggaaugucaaaugggcggcagcuguagaaaacauucuggcaucccucaaaaaguuaaacauggaauuaccacaugaccaacaaucccacucccaaguguagacccaaaguaacugaaaacagguguuuaaauacuuuuacacaaauguucauagcagcacuauuugcaagagccaaaggcuggagacaacccaaaugucuaucaauggaugaggauaaacaaauggugguauauccauacaaugaaauauuauucagccuuaaaaaggaaugaaauacugauacauucuacaacacaaaugaaccuugaaacaugaugcuaagugaaggaagccagacauagaagguuacacacuguauaaguccguuuauaugaaauaucccggagaggugaauagguaaauccaaaaauaggaaaagagagacagcagauuugugguugccaggggcuggggcaagggggucuagacagcgacugcuuuaaggguuuuccuuuuggggugauacauguaguggaacuagguagaggugguggcugugcaacgcugugacuguacuacaugccacaaaaugguacacuuuuaaaugguuacuucuacguuauauauuaaucuuaccucauuaaagaagaaaaaaauaacaagaaaaugaagcauuacauuugugagacgcagacucauauucugguagguuagaggagggagcaauuacuuaggaaagacugacugcaugggggaagugugacugaugggauuuuuauuuuuuuuauuuucuuuuuuauuuauuuauuuauuuauuuauuugagacggagucucgcucugucgcccaggcuggagugcaguggcgcgaucucggcucacugcaagcuccaccucccagguucacgccauucuccugccucagccucccgaguagcugggucuacgggcgcccgccaccacgccuggcuaauuuuuuguauuuuuaguagagaugggguuucaccguguuagccaggacggucucgaucuccugaccuugugauccgcccgccuuggccucccaaagugcugggauuacaggcgugagccacugcacccggcuauuuuuuuuuauuuucuaaguaggugcugaauuuuuuuucuuuuuuaauggaaaaugguguuaacagacaaugcuucauggacgacagauaugcagucuguccauggaacuggcgucugcccauaaagacacagucuaggccacuuuaacaucucccuauccugguccucuuggcucccaggaccaaugugguaucccacuucucuggcauggagcucugcccucagauuccugagcaucaagcucaguggcucuucacccaggcaccuuucugucagccuucuggacaugggucuucagccuacucuugguauagagggagagaagccucucaguuucuuuaccugcaaagcugucauuuuccucuuccuuugucuuucccggaaaacaagacauaccaaaccaaacuaagacauaccaaagcaaacuaagauacugcugcuuccaaagaagaaaaugcaauuuuacaaccucuuccccagugcuugccaaccauccauccuucugcacuuaccgcccccugccccaccaaagcucucuucuaaaacaaucaaguaagcaggccccuaaucagcuuauggccaauauaaauagaaaauacccaacaaucagcacacacaccacacugugaaaggaagcaaaaacacuuuuuuuuuuuuuuuuuuuugagacggaguuucgcucuuguugcccaagcuggagugcaauggcacgaucucggcucacugcaaccuccaccucccagguucaagcgauucuccugccucagccucccgaguagcugggauuacaggcgcacaccaccaugcccggcuaauuuuuuguauuuuuaguagaaacaggguuucaccauguuagccaggcuggucucaaacuccugaccucaggugaucugcccgccucggcuccccaaagugcugggauuacaggugugagccaccgcacccagcccaauacuucuucuuuuuuuuuuuuuugauauggagucuugcucugucacccaggcuggaaugcagcggugcgaucucagcucacugcaaccucugccucccggguucaagcuauucuccugccucagccuccgaguagcuggaauuacagccgccuuccacugugcccggcuaauuuuuguauuuuuaguagagaugggguuucaucaucuuggccaggcuggucucgaacuccugaccucaugauccacccaccuuggccucccaaagugcugggauuacaggugucagccacugcgcccagccccaacacuucuuaaaauaugcuuuucucuccaugugucacuggcacauguguguuuguuucaccacucuggaagaacaggacuauuuagacauucaaggagccccgugugucacugugccagaaacugcugucuacaacccaagccaggugccaccagaggccaccaccauaaucuaaggcaugaccaggcaaugcaaugugugguuggucaccaaacaaaggccgcucaaagcauuccuuugucacccaguugcuuugcaucaccucacugggcgugcugugcccacccacaccgaaaccuucuguguguuacguuaagcgccugugauguggcagccacagcacaaccacccuggagagggcgcacacuaaacagcucuuccaagucucucuacggcaacgauggaagagcccuggggcuuuccacaccgaccucuggcugggcuggagacgccagcuacagucagguguggaccccaccucaauggguaagugcuucccuuuucuuucccucacugcaggcuaugacuugcuuucuguuucuaaaucagugcaguauuauauagucgggggcuaguaaagcaguguuuguguguguguguguauauauauauauaauuuuuuuuuuuuuuugagacagucuugcucugucgcccaggcuggagugcaguggcucgaucuccgcucacugcaagcucugccuccuggguucacgccauucuccugccucagccucccgaguagcugggacuacaggcgcccgccaccacgcccggcuaauuuuuuuguauuuuuuuuaguagagacgggguuucaccguguuagccaggauggucgugaucuccugaccuugugauccacccgccucggccucccaaagugcugggauuacaggcaugagccaccgcgcucggccagcaguauauauuuuaacaucuacaaguaacuaaaauuuccuaacccucuuacgagccacuacuuuguaugauaaaacugcuuuagacacacagucaugugucgcucugagaaaugucuuguuaggcaauuucguugcuguguaaacaucauagaauuuacuuacacaaaccuagauggcguggccuacaccacgucgaggcucuaugguauagccuauugcuccuaggcuacaaaacuguacagugugggacuguacugaauccugucggcaguuguaacacaauggugaguauucuaaacacagaaaagguacagugaaaauacgguauuauaauaugauggggccacauggucuuugugguccagcaucgacagaaacagcacaugacuauguauuuuuucacugcaaauccuuuguuaagaccacuuccccugcuacaucagaaagcaccuacauaugugaguuauagcucaauaaagcugucauuaaaaaaaaguaccuacaaugcuucuauuguaauauuacuccuuuggaugagauauggguaaagaaccuucuagaaugccuacugaugauuaacuugagccaugaauaguauuuggauaaguagugugaacaaagacagagacacagagacaagcaugguucuuugugggcauuuuaaguggacagcagagagacugaggauauggguucaaggccaggcugccuggacauggaucaugccucugucccacacuaacucugugaccucgagcaagcuauuuaaccucucugugccucuuuccucacuuuaaaacaaagacuuuacagaaccuaccucaaaggauuuugugaggacuaaauggguggagauacgaaaagugggugaaaugagguguacaguuaauaaacauuagcugugaggacguugaaaaugaggcagaacggaccauggagggggccagcccuuuaugggaugacuagaagaucacgcagggacagcuuagccuaaaucgguggcuguggaaaugaagcacacacagacagaucugcucacaggagacccacggaauaaaggagagggaagaauguaaagaaaaccacacaagauuuuuaaucuggacaaccccaaaaauaacagcacucuagcaggagacuaggaaagaagauucugaucccuugagaaaccgggcucuuuucagaaauguaauggauuugucaagaaggcccuuaaaaagaugggguaagaacucaacuggagagggcucagagcgccaaaccugcucuuuacuuuuguuuuuuacuuacuuacuuacuuauuuauuuauuuugagacagagucucacccuguugcccaggcuggagugcaguggcacaaucucagcucacugaaaccucugccuccuggguucaagcgauucuccugccucagccucccgaguagcugugauuacaggcaugcaccaccacacugagguaauuuuuuguaucuuuaguagagaugggguuucaccauguuagccaggcuggucucaaacuccugaccucuugaucugcccgccucgaccucccaaaguguugggauuacaggcgugagccaccguguuuuugagacaggaucucacucucucacccauucuggagugugguggugcaaucacggcucacugcagucuggccucaagcaaucccccugccuuggccucccagaauguugggauuacaggccugagccaccgcgcccagcccaaaucugcucuucacacucaaaggaaaacaacccacucaucuucauuuacaccagacgaguucccuggccacugugguuauuaucuccaaaucugccaguaaacucacagagagaccaacucaacucacugaccuggucgucagcaauggcuuucgcgaaccgagcacaguccagcuguaaguaaauauccgucaguugguccaacagcuucuuugguucaaagccguauuucucaggguuuucaacuuucaggucacggcacuuggggccacaaaguugcugaagauuaaaguucagcauugcagccaaucgggguccaagcuccuaggaaaucacaggauaauaggacaauucaugcuguugagacaagugaaaaggaccaaaaacucccauuucaguggaggaacaggaauugguuggauuaaucuucaaagaauccuuacaggugcuguguaucauaagcugaagaaagacaacauuauauuucaacuuuacuccccauuucugaucugauaauucuaauacuuaauggaauguugcaggcugaugaaauauuuauuuauaaauaccaaaagaagccaaacuuuucuuuacauuuaugcuuuuaauuaaaaaaaguaucacuccaaauucauugagaaacaaguaaaagagagaaaauuauacaaaucuuaccauuaucugagcaaaaaaaguuuugagucagcucuuccagccaguauuucauaaacuuuuuuccccauaaauguuaaaagccccuggcaguucagucugugucauucuuauguacuuaucagauacaaauaacaaaguaaugcaaggaaagaagauaaaaguuaugccuugaauaguuuuaaaucuagucaaugagacagaguaaacuuaaaugaaacaccuggaaaauaguaauaaucuaugcuguaaucucacaaggugacucaguacccacuacgguugggcauacaugguuuuaagcaaaccugaaacaggaagauguggcuuagagagcauuaaacacuggccauaaaagggagucacgaaagcauuccuuuaagucacaagguuuucaugaaauguaauaacuggauuuauacaaauucaacauauacuuagcuuuucaagaauuugcuuuugcacagaguacuccuguauuucacuguugagaagcugugaaauaaaagagucauaacaggacagaguuggucauucuguuugaaguaggagagaucugagcuagucaguaaagaaggugaaaaugcaaaccuuaaagguuugcaaaaugaaaugccuuuacacuuugucugcaaaggccagauaguaaauaguguagcaaaggaaaugaaaacaucacagcaggcacaggcacaggcuggggccaaaagaacagggcuacaguguacagauggcucaggucuaugagcaggccuuaaaauaaauuuauuuauuuauuuuugagaagagucuugcucuguuacccagguuggaguggcgugaucucggcucacugcgaccucugccuuuuggguucaagugauucuccugccacagcuucccaaguagcugggauuacaggcaugcacuaccacgccuggcuaauuuuuguauuuuuaguagagacgggguuucgccauguuggccaggcuggucuggaacuccugaccucaggugauccacccuucuuggccucucaaagugcugggauuacaggcaugagccaccgugcuuggccuuaugccagguacuucuauguguguuuucgcuuagucuucccaacaaguguacaaaauagguggguguugaccuuguuacaaaggaauuaaucaacuauuuacuaucuggccuucacagaauucugcaaaccuugaagggaggccagugucuggccagugagcuguuuuguuucaugcuccauggccuugcacuuugcaaacuuuuaagggaggccagugucugagcuguuuuguuucguguuccauggcucuugcacugaaaucuguuuaugaagagacaugagguggaaaguuaaaagaguggaaaagaguuguccccaggccagggaguggcaauagugccucugcugaugacaggagucacauaacagagagucacauaacgaagguaagagcaaauacagaaaaucaggggaaauaugcaguaacgucauauuccauuguaaaguaaacaugucuccacauaggcaaauggcuaccgaaucuuagguccccgucuugccuuccucacuacccuuguccuggccacaccauaaaacuuuucaacuuugugguggggguggcugaagcagggcagaaaucuucagugaugcugcucaguuucaauuuuagaaauaggaaccaggucuuacuaguugagaacaaacauucugacuauuugcaauccaccauaaacccuagugauggccggcucccauuaaccuuuggcuuccugaguguaacaaagguacagcuaagagagccaaagauuuuacacggucucaauuauucuacuuaauauccuuccauugucaacagcuguuaccuuaugcuuuuucuucuucuuuuuuuuuuuuuuuugagauggagucucacucugucgcccaggcuggagugcaguggcaccaucucggcucacugccagcucugccucccggguucacgccauucuccugccucagccuccugaguagcugggacuacaggugcccaccaccacgcccagcuaauuuuuuguacuuuuaguagagaugggguuucacuguguuagccaggauggucuccaucuccugaccucgugaucugcccgccuugggcucccaaagugcugggauuacaggcgugagccaccgcacccggcaccuuaugcuuuuucuauaaguaaaauauaggaaucaauaaugguaaaaauaugucaugacaucaacaugaauaauccaauguacugucuaagcacaaagugcaguaaggcauuuggaaguggcuguagacuauguggugacaucagacaucugcucuucaguccaucaacagagucugguaucaauuagcauaacugggaacaaaaucagucacagaauuucacuuauugaugacugugauccuaaaauuuccagaacuucaacaacugcuaaaguuauaagugagagagucugaauguggaguccaaaccaccaaacagagccccggguuucuacucaccggucugaggaagggcuucuggaccugcuucgugaggauguggaacauguccacgguuucgguggccagggcgagguaagagcgggacacacgcucauccugagcaagcugagacugacgagccugcugcugauccuaggacacaucgaacagacgcugaguaaggcucgguccuggucaucagcucagcaaagcgccaagcacauaacuggaaagugcgugauaaacccaacaugcuuagggaaugacagaaccgccugccacaugucccagauaacugaaguuucauccuuucagcaucggagcucuuugagacuuccagccaggugauguuggugccuuauuuaacucugcuuccucaaugauaaaagaagucaccaucugccgggcgugguggcucacgcguguaaucccagcacuuugcgaagccaaggugggcgaaucacgaggucgagaucgagaccacccuggccaacauggugaaaccccgucgcuacuaaaaauacaaaaauuagcugggggugguggugcguggcuguagucccagcuacuugggaggcugaggcaggagaacugcuugaacccagaaggcugaggcugcagugagcugagaucgcgccacuguacuccagccuagugacagagugagacuccgucucaaaaaaaaaaaaaaaaaaaaaagucaccaucaacuucuauucaggaugaaauaagauaauggaacauaguaucugacacacaucauggcacuaagaaaggguaguuuauuucccuuaauaauaacuuuuacuuagucauuauuauuauuauuauuauuauuauuauuauuuuuugagacggaguuucgcuuguugcccaggcuggagugcaauggcgcgaucucggcucaccggaaccuccgccucccagguucaagugauucuucugccucagcaucccgaguagcugggacuacaggcaugugucaccaugcccggcuaauucuguauuuuuaguagagacgggguuucuccauguuggucaggcuggucucgaacuccugacgucaggugaucagccugccuuggccucccgaaguguugggauuacaggcguaagccaccgugcccggcccucuauuauuauuguuauuuuuuuuugagauggagucuuccucugucacccaggcuagagugcaguggcacaaucucggcucacuguaaccuccgccucccagguucaagugauucucaugucucagccucccaaguagcugggauuacaggaguggaccaccaugcccagcuaauuuuuuuuuuuugugugugugugugugugugugugugugugauuuauuuauuuuuuuugagacagggucucacucuguugcccaggcuggagugcaguggcgcgaucuuggcucacugcaaucucugccucccggguucgagccauucuccugccucagccuccugaguagcugggauuacacgugcgugccaccaugcuugacuaauuuuuguauuuuugguaaagauugggguuucgccauguuggccaggcuggucuugaacuccugaccucaggugauccauccacuucaaccucccaaagagcugggauuacaggcgugagccaaugcgccuggccuaauuuuuguauuuuuaguagagaugggguuucacuauguugaucaggcuggucucaaacuccugaccucaacugaucugcccaccuaggccucccaaagugcugggauuacaaguguaagccaccgugcucagccagucuucauuauuuuaaaacuaugagaugcagugugccaccguauugaggccuaucgggucugccucucugccucuacaagugccuguggacuacuaagcuuuuaaaauuuugucuuuccaaacugugaggcugucacaccacagaacugucagcacgcuuaccucuggcgcacuuuccuccuucaacucugccaugggcuggggaggagauaauaagagcuguuugacucauggauacaaucagguacugcacugcaggcucugaaaugggucaaacacagacccaucaggaaaagccucaauucuuacaucuguucagaggccuuuucuuguugggaaaggaacacagcuggcagagcugaagcuggccggugagugcccucugggaaagugcuccagucugugcuugauggagauucugcagggauacuggggggccugccguucccuggucaagaaugagccuacugaaagaaaggcagagccaggaaagacacaagaacagccaggcgugaacuaccuaaauguguaccugggugucucaacaggcccuucuacagccuuugggcacuggagauagaauaaaaaggcucccagcucucaugcagcuuagauuccguuagggaggaucugcuucauagaaacaaauacccagacagacacacaguaagucugacagugaugaggaaaaaugaagcagggucaggagucagggaaugcuauucuggaaaggguggucagggaagguaucccugagggaggguauaucugaaggagucggaaaaucugagggaagagcauuccagguagggggaagagcagguguaaaggcccucacgugucaguggaagggccaggaggugagucuggcugggguagagugaguggagaagagacuguccaaagcugagagcagaaacacauuguggggccagguccuccugcgugcuguaggcugcucucaccacaggauuuggcucugagugauaagggaagcccaaaauggcugagcugaguggugauguugaucagacugagauguuuaacaccaucccugauauggacaugcucaagaguggagguugaagaccaagcagugggcuacugcaauaacccagguaagagaugccaacggucuggaggugcugagaagaggucagauaauggauauauuuuaagacagagcuuagaggcauuugcugagagacgcagagaaaucaagagcaacuccaaagcaucgagccugagcagcugguagaaugaaggcgccauuuacugagauugggcagacucaggcaggagauguggacaacaucaaggguuccguuuuggacacagugaguuugagacacugauuagacaaauacuuggucugcaagucugcagucagaucugagccagggagauauauucuggagucuuuagaacacagguauuuaaugccuugguauaccugagcucaccaagcagugauguucaccgggggacaucagguuauguguggcaguguuucucguugccugaaggcuggggguaggaggguacaucccugacauuaaauggcaggaaacagagauccuaaauguccugcaauauaugggaugguuucucaucaugaguuauuauuauaccaaauuccacuaggcucaaaauuccaacuagugcccucguugagaaacacuaaccuagagagcaugagugggaaagaaauugaagccuaagggcugagugcuggagcucaccaagcucagacgucagggagaugagcaggaacagccagggcagugggagguagaaagugacuucaaagccaaauaaaaauuauuucugaaauagcaauugugggaauuauuugggccuuuuucauccauuaacacaggaaaaaucaauauuauuuguucaguuggcucauaaacaaaugcuauuaaguacugacuaugaauacgagaaugugcuauagaccugcauuccaacaucuaaaauauacgcuggccagccaugguggcucacaacuauaaucccagcauuuugggaggcugaggugggaggacugcuugaggccaggagguuguaggcuguagugagcuaagaucugucauugcacuccagccugggugacagagcaagacucuuucuuucuuuuuuuuuuucuuuuuugagacggagucucgcucuguugcccaggcugaaaugugaaauguaguggcaugguaucagcucacugcaaccucugccuccuggguucaagugauucucccaccucagccuuccaaauagcugggauuacaggcaccugucaccaugccuggcuaaauuuuguauuuuuaguagacacuggguuucaccauguuggccaggcuggucucaaacuccuggccucaggugaucugccggccucggccucccaaagugcugauauuacaggcaugagccacugugcccggucaagacucuguuucuauuaaaaaauaauaauaaggcugggcaugguggcucaugucuguaacccccgcacuuugggaggcugagguggguggauugcuugaggccaggaguucaagaccagccuggccaauguggcaaaaccccaucucuacuaaaaauacaaaaauuagccggacgugguggugcacgccuguaaucccagcaggcauaaauugagccaagauugcgccacugcacuccaaccugggugacagagugagacucugucucaaaaaauaaaauaaaauaaaauaaaaaauaauuuaauaauaaaaauaguaaguaaauaaaauauaagaccagcuugggaaaacuagcaagacucucucucuuuaauauuuauuuauuuauuugagacggagucucacucugucgcccaggcuggagugcaguggugcgaucuuggcucacugcaaccuccgccucccggguucaagcaauuauccugccucagccucucaaguagcugggacuacagcggcgugccaccacacccagcuaauuuuuguauuuuuaguagagacgggguuucaccauguuggccaggauguucuugaucucuugacauugugauccacucgccucggccuuccaaagugcugggauuacaggcgugagccaccaccccuggccuaauauuuauuuuuaaaggauggaaugcuuuaugaauuugcaugucauccucgagcaggggccaugguaaucuucucugcauuguuccaauguuaguauacgugcugcugaagcaagcaugugagacuuugucucuauaaaaaaaauuuuuuuaauuagccaagcguggugguacaugcuuguagauccagcucuuuggaucuacaaaggcugaggcaggaggaucacuugaguccaggagguugaggcuguggugugcuaugauccugccagugcacuccagccaaggcgacagaucaacacucugucuuuauuuauuaauaauaauaaaaaacaaauaaguaaauaaaauauaagcugggcauaccaagcacugugaaugguauaaaguggguguuacagaaguaaggagaaaggugagaauuuucagcuaugcugauuggcgaagacaaaccugagggaguauuuggauaggaccuuacucagagaauggguagaacuuuaauacauaagaagaaaagcagguauaaaugggagcuaaacauugguacacauggacggagacgggaauaacagacacuggggacuacaagggaggggagugagggaggagugaggguugaaaacuaccuauuagguauuaugcucacucccugggugacaggcugaaucauaaagccucagcaucacgguauacccauguaacaaaccugcacauguaccccauccccugaaucuaaaauaaaaguugaaauuaaaaaagaaaaaaaaaaaaaaaaagucugggcgcggugacucacgccuguagucccagcacuuugggaggcugaggcggauggaucaccugaggucaggaguccaagacaggccuggccaacauggugaaaccccgucacuacuaaaaauacaaaaauuguccgggugcaauggcucacgccuguaaucccagcacuuugggaggccgaggaaggcggaucacaaggucaggagaucgagaccauccuggcuaacacggugaaaccccaucucuacuaaaaauacaaaaaauaagccaggcguaguggcaggugccuguagucccaacuacuugggaggcugaggcaggagaaucacuuguacccaggaggcaaagauugcagugagcugagaucgugccacugcacuccagcaugggugaaagagcaagacuccgucucaaaaacaaacaaacaaaauacaaaaacuagccaggugugguggcaggcgccuguaaucccagcuauucagaaggcugaggcacgaaaaucgcuucaaccggagaagcggggauugcagugagaagagaucgcaccacuguacuccugcgugggcgacaagagugaaacuccgucucaaaaaaaaaaaaaaaagaaaaagugaagaaaaagcaguccccacuuugacaugagaaccccuuauggaaaucaguucugauucugagccugacaauuccaagaacagaaucaauaaaccuaagccaaucuaagaagucaccagcaacugucaagggccucauaagcgaccaaggaaguaucucaguggcugcuacgcacgucaggaaagagcacugguacuggcacggcacgugcuuuccauggaaccuggcaagccaggccucuuuucuauuaauaacugaauauaaaacccaagaucaacugaaagggaaaaaacaccccgccaggauccugagugauucacacaguugccuagagaagcccauaggaacaaaucaaauucuuguccagcagacauaauucuagagauuucuuuccuaauuauguucaugaauauuaauauauucagacaauaaaagcucaucuccaaaaaagcccuuuaaaauuaaaaaggcagagaaaguuuucaguguacauuuucaaagacuucucaacccauuucuuagcuucagauaagguauuuaagaauuuuccuauuccaauccugcaauaugauuucauggaaggaaaaucccagcaugucagaucgcauaucaucagacccacaaaugcagccccaaagcagcucugcccguguguggaggcagauggccugcaaagcuguccaagccucuggaccacguccucacccggggcaacuggucccacuguucuuuguucuucaucucuuccugcacuucauggauucgcuucagagacuccagacuuucaucgagcaaaaacgucgugucguuuaucaacauguuuauauagcgaacaaacugcuucccggagcuggaaaggcaauuauauuguacauggucauacaucucccugaagcaaaaugccacagcaaaucccagggaacaagcaccuccacccagacugcaacuaucucacccuaaaagccuggcuacccuggcacaagucaggcacuauggaauucaaggaccaccaagcuucucuuuagauuauguuaaucuuguuucuuuuugagacagggucucacucugucgcccagccuggaaugcaguggcacaaucacagcucacugcauccucgaccuccagggcucaagcaaucuuccugccucagccuccuaaguagcuggaacuacaggcacacaccaccacgcccagcuuuuguauuuuuuguagagacagggacuuguuauguugccagggcuggucucaaacuccugggcucaagcguuccucccaccucagccccucaaaauguugggauuacagagaugagccaccacaccuggccuggauuuuguuauucuuuuaaauuguuuaugauaagcucauuccagugguauuuggagccaccuugcacggcugaugacagucaagugcuaaauauuccagaauuuuauaaccagauuccccuggcaccuuaaauugggcaacagaggaaacagucacaccauggaaaaccagcaaaugcugacucccccacccugcuucccagagcaggcuuaccagcacaccccuagcucacucccucaauguuuuuaaggagagaaaacacuucuuccagacuagaacaggaaaaacgcauauacucaccaauauaccaagaaaaugcaaauaauuaaccacauacaacagauaagaaaacaacugauauaguuauuccuuaucacaaagacugacgcauggaagaaaaauuggaaccuguaauauugauaaagugggauauuaacuuacuuuaaaacuggaagccuccaaucuaaggaacuguucugcagaucguguuauaaugagaacuugcuggugaacugaaauagcuuggccuaccucuguuagacucuggagaugccagauucguagagaaaaaaagaagcuacacuucagggucuacaacugugcaacuacggggugguaagcccaugcuggagaagagaaguuccugugaacaagugcaggaggccucgaucucaggaacauggcaaguucaggacaagcgcuccaaucagcaccauucagaccaagccaugggccugccucgugccaggcuuuagcuggaacacaauucugaccauaagagcaguuuauggaaacaaaaaguuaaaaaguuugcuucacagaaaucuaucuggcaaauaguuauuccacugguaauuuguauauuauugacuaguaauucgguuaacaaguauagcuagauuugaucaaagaucuaacauggguugcaaaagauccaaguaggugggauaaaauuuuuauuuauuuauuuauuuauuugagacggagucucacucugucgcccaggcuggagugcaguggcaccaucucggcucacugcaagcuccgccucccagguucacgccauucuccugccucagccuccugaguagcugggacuacaggcgcccgccaccgcgcccaccaccaugccuggcuaauuuuuugguauuuuuaguagagacgggguuucaccauguuagccaggauggucucgaucuccugaccuccugauccgcccugcucggccucccaaagugcugggauuacaggcaugagccaccacgcccggcccuuagaugggauaaaauuuuugaagaauaauucaagaguucagcaucuucaucucccuuuuguuuuuaggcacugacagauaauuuagauggaauuacuaauguccagguuuaagcagucacucagauuucagguagguauaugaaaagucuuuaauuaagguuuagggccuuaccacaaagaaugauacuuuaaaugacaacucugaccuaauuguugcaaaaucuaaaguccuuccaacauucaggaacuaagauuucauuucacucauucugacaacuucauuuaacacugucaucguagaaaacaccaaaaaaacacuuaacccaucaucucagcauauuuauaggaucuuuucuuuuccuuuuuuuuuuuuuuuuugagacggagucucgcucugucacccaggcuggagagcacuggcacaaucucggcucacugcaaauucugccucccggguucaagugauucuccugccucagcuucccaaguagcuaggauaacagacgugcgccaccacacccaguuaauguuuuguauuuuuaauagagaugggguuucaccauguuggccaggcugguuuugaacuccugaccucaagugauccgcccgccucugccucccaaagugcugggauuacaggcgugagccaccacgcccugcccuauacaaucuucgcuuguguaccacccccaaaguaucuugacaaaucuaaaauucagcaauaucuugcaaguaaagccauuuaaaaaauccugcccacauuuaguggcaucuugugguaaacucaaaggagucugagaccaagcaaacagucaacaagaacccagcugugcaugcuuuuaagcugcaauccuaccugcgauuugcaagaaagcaaguugugacacgaggggccccauacucacuugaacuccuccauaaaggugccauggugagcuauguuuugccaaaggcuuuuaaaaauggugcuaauaugauagcgaauugugaacuugucauaaaacucacugguggcuccgguaugcucaacaucuaaagaagaaagacaaagguacugagggauauguauuuucuugcuuuccaaauccaguuauugccccaacaaugauacugagugaauguaaaccugcaaaaucagagagcuggugaaauuuugcacuucuuuugcauguagggcacgacagaaauuauaagcugcuuuuaaagacaaaaguuucacaaugaagauuugacaaugacacaacaccuaaaggaacggggcuaggaaaacucccaucauuaggacaacaucaacuuaccaaugaccaaaagcugaauuaucauacuccccccaccuaauuuuaaguuauuaauuuacagaaauucuauggcaccucaaauggacauacuucagcggauaaaaaguuagguuuaauuuuauugagggccauguauuuacuaaaugugucuaucuauugaccauuuuugguguugaaaaaacaccaaugugucuaucaucccuaaaucuauuaaagagggauaaaaaucaaacuuguuuguccaaauggcaaaagcuuaggcaugagaaauuucagaauucaugacaaauuuuauuauuauuauuauuauuuuugagacagagucccgcucugucgccaggcuggagugcaguagcacgaucucagcucacugcaaccucugccucgggguucaagcaauucuccugccucagccucccuaguagcugggacuauagacaugcgccaccacgcccugcuaauuuuuguauuuuuaguaaagaugggguuucaccauauuggccaggauugucucgaucucuuggccucaugauccacccaccuuggccucccaaagugcugggauuacaggugugagccaccgugcccaacuauuuuauuauuauuuuuuuggagacagggucuugcccugucacccaggguaaagugcaguggugugaauaauggcucacugcagccucaaccucucgggcucaagugauccucccaccucagcaucccaaguagcugggacuggagguguauccaccacgcguggcuuauuuuuuauggcugagcgugguggcucucgccuauaaucccagcacuuugggaggccgaggcaggcagaucacuugaggccaggaguucgagaccagccuggccaacauagcaaaaccccgccucuacuauuaauaaaaauacaaaaacuagcagggcaugguggugugugcccauaauuccagcuacucaggaggcugaagcaggagaauugcuugaauccagauacagagguugcagugagccaagaucaugccacugcacuccagccugggcgacaaagcaagacucugucucaaaaauuuuuuuuuucacuuuuaauuuuuuuacagauggggucucacuauguugccuaggcugguuucaaauuccugccucaagcgauccuccuacaucguccuuccaaaguacugagauuacaggugugagccacuauaccuugucuuugauauuuucuguauuuuccaaagaacacauuuuuuugugugugaccaaaaaaggaaacagcuauuuaaaaauaaaauaagauaauuaacaccuaucauacuaagauccgaaaguacuuauguauauucauuaaguaaccuuuccuuaaaauaaacuaaaugucauuuauuaauuguauaaaagcaugagcuaaaguguggaguguugacauaaggauagccuacaagaggaagauacaggaggaccaacccaacgccucauaucaucuaaaaugccccaauaucugcacccaauucugaauauaguagagacuaaguaaauguuaauuuauuauguagcaauauguaucucagcagggccccgcaucuguauuuccagcacuucaggaggcccgggugggcagaucacuugagcucaggaguuugagaccagccuggugaacaucgugaaaccccgucucuacaaaaaccacaaaaauuagcugggugugguggcacaugccugcagucccagcuacaggggaggcugagguaggaggaucacuugagcccgggaggucaagagugcauggugcuguaauuguaccacuacacucuagcgugggugacagagcaagacccuagcucaaaaaaaaaaaaaaaaaagaaaagaaaaugaaacaaaacaauauacauuucucccaacaguuuuuuuuucuucuuauucacuucuacuguucccucaaagucauaccagcccaaguucuaauucccagguccuuguucuagaaggccguagguggacuagacuuguguugaaccucucccuccuccccccagguauucuugcugccuucuuucuuuuuuuuuuuuuuugagauggagucucacucuguagcccaggcuggaguacaguggcaagaucuuggcucacugcgaccuccaccucccaggucccgguucaagcaauuccccagccucagccucccaaguagcuggcauuacaggcccccaccaccacacccggauaaucuuuuguauuuuuaguagagacaggguuucgccauguuggccaggcuggucucaaacuccuggccucaagugauucaccugucucggacucccaaagugcuaggauuacaggcgugagccaccacgcccagccuaacuugagcauuuucuaagcuagaauacuaucucugugguguuaagaggagcuuguuccacauacugaucuuguguguggcaacuuuuaauuuauaucugagggucccaucugcucagggaccaggaccuaaucagccaggucuucacauggaggugaugagcacuggggacuaugucugugaugccucccucagggguacccucacaccggucccuuaguagcuguaggaagaccagcacaguagccagggggaccugugcuaaagggcaucugcgagguugcugccacuugcuagccacugaccuucagcaagcuucuugacccuuuuaagcuucaguuuccucauuuguaaaguggauguauuuauaguacuaucuuuaggacugccguggggauuaagugaaaggauuaguaagcauucaauaagugguggcuauuauuaguacagaugucauccaucuaugacugaagaggugguccaggccagagggcacacauggcaaagaggaaagagagaacaacccccacccaauuccuucuggaacauucccagcaggacuccacuaggcccagcacucgucuuauaggcaacaggcccaguucuguuguguaaacacaaauacacaaacacacacacacacacacacacacacucucucucucucucucucuccugaagccacagugacaggcccagaacacugacuacaaaauaaauuuaacuaaaauuguuuugucuuuacuacuaacaauacauguuuacuguagaaaaauuaagaaguucagauaauaaaauaaaaauaaaaacuauuuauaaugcuaccauucaaaaauaaccaaugcgcuguuacuauuuugguauauguccuucccuacauuccuuuuuuuuuuuuuugagauggagauuugcucuuguagcccaggcuggagugcaauggcacgaucuuggcucacugcaaccucugccucccugauucaagugauucaucugccuuagacuccagagaagcugggacuauaggugugcaccacuacgcccagcuaaauuuuuuuguauuuuuaguagagacgggguuucaccauuuuggccagacuaagccuccaacuccugaccucaggugauccuccugccucagccucccaaagugcugggauuacaggcgugagucacugagcccggccaguuguuuuuauuauuuucacugcacugcuuuauaaauaaugcuguggagaacaucacuuacaaacauucguaauuauuuccauugaauaaauuucaagaaauuaaauucuuaugucagaguauagcuauucagcuguugucucguagcuccaaauccacucuuuuuuuuuaaaauuuuuuuagaucucggcuaacuacaaccuccaccucccggguucaagcuauucuccugccucagcuucucaaguugcugggauuacacgcaugcgucacccggcuaauuuuguuuuguuuuguuuuuuguuuuguuuuugagaugaagucuugcucugucaccaggcugaagugcaguagcgcgaucuuggcucauugcaaccucugccucccggguucaagagauucuccugccucagccucccgaguagcugggacuacaggcacaugccaccauguccagcuaauuuuuguuuuugagacggaguuuugcucuuguugcccaggcuggauuacaauggcgcgaucuuggcucaccguaaccucugccucgcggguucaagugauucuccugccucagccucccaaguagcugggauuacaggcaugugccaccaugccaggcuaauuuuguauuuuuaguagagacaggguuucaccauguuggucaggcugguuuugaacucccgaccucaggugauucgcccaccucagccucccaaagugcugggauuacagcgugagccacugugccaggccuaauuuuuguauuuuuaguagagacgggguuucaccauguuggcgaggcucaucucgaucucuugaccuugugauccacccaccucagucuuccaaaaugcugggauuacaggcgugagccaccacgcccggccuuuuacuuuuaguagagacuaggauucaccauuuuggucaggcuagucucgaacuccugaccucaggugauccacugccuuggccucccaaagugcugggauuacaaguguaagcuacugugccuggccgaaacccagucuuuuuacccuuuuuuuuuuuuuuuuuuuuuuuuuuuuagaaacagggucuugcuuuguuucacaggcuggaacgcagcagcaagaucauagcucacugcagccuugaacuccugggcucaagccuuccucccaccucugccuccuuaguagcugggacaacaggcaucuaauuuuuaaauuuuucguagagauggggucucgccauguugcccaggcuggucuccaacucuuaggcucaaacaauccucccaccuuggccuccuaaagugcuaggauuauuagcuggagucaccgugcccagcccacaugcacucuuuguaguuggcuuugugauucuggggcuggcacugcagaaucuuuccuuuggcagcccgcccucucuaggguugccaauagggggugcugcaggagaacuggaaaacugaaggagaaacaagggacuuaggaccuugcacuuacugucagcaguagcaguugguuccaauuuucagcuuugucucguacccccagagcuagcaaccgugcacaacccccgagagagacaccagcaccuacuggccaagggccuuccacagaggacuggguccuagcuccguccaagcccucaucagggcagcuggguucugagauccccaggcucuucccuuggguccccagacugagggauagaagauggcuacuuccugcaccuacuauuuguuaucccagugcuuuuuuuuuuucuuuuuugagacggagucuugcccuuucuccuaggcuggagcacacuggugugaucucaguucaaugcaaccucugccuccuagguucacucgauucucgugccucggccuccugaguagcugggaugacaggcgccgcccgccacacccagcuaauuuuuguauuuuuaguagagacgggguuucuccauguuggccaggcuggucacaaauuccugaucucaggugauccacccgccucggccucccaaagugcugggauuacagguaugagccaccgcaccuggccccgauaaaagcauuuuuaaggcucuuggugugggcugcuaaacugccuuucagaaaggcuuuaaauuugcauucucaugagaguuucauagcacuaaaucugcacacuggcuauaggguagauuaagcagguuuuuuugcagguuagcuuacuucuccacaaccauguuuguaccagguauuuucaacuuaagaaauaaauuugacaggugaaaagugguauuauuauuauuauuauuauuauuauuauuauuauuugagacggagucuuguucucuugcccaggcuggaauacaguggcgggaucucggcucacugcaacuucugccucccggguucaagcaauucuccucccucaaccgcccugggacuacaggcaccugcaaccaugcccggcuaauuuaauuuuuuuuucuauuuuuaguagagaugggguuucaccauacuggccaggcuggucuugaacuccugaccuugugauccgcccgccucggccucccaaagugcugggauuacaggcaugagccaccgcacccggaccaagaauaugcauuuuuaacaagcucccuguuucacccacacuuuggaaaguggguuauaggauaguguuaaaaaacaaaugcuguaaguucaaagguaaaaugaaccagauaauuccauucagauaacacuaccaacuugugcucuugauacccugggucucggugccaaucaucugacuuucaguaguuccugcugaaucaucagagaccaguagguggaaugguuguccuauuccuaacuacucagggcaagaagaaccaaaaguacauccucugcaggccacagguuaguaggcuauacacacagguagcaggauauuagguaacaggcuuagagcaacgucguccacuagcuuuagaugaccuuaccuaaguuggccugccaugugcuacacuguguuccagcaaccuaccuguauaaaacuucaucagggaagguaccaacaacuugguggagagaggaugguucucaaucauuucaaaaaacuucuggguucguggcugaacagcaggguuggucauaaacaugacuucuaccaguuuggccaccaaauauggguuucggauguaguucugguugcacaacaucacaacaaggaacaucacaauauccugaguacagggcucauaaagcgccuggggagaguaucugaacagaggcaagaagagcaagaaagagaccgcugagaaacugcugagaaacucaucuugggugaaggcuggugucaguaagugaggaggggaaggcaggauaaguagguuugggagugcccuugaacucauucaguuuacagugacuuuuuuuuuuuuuugagacagagucucgcucugucgcccaggcuggagugcaguggcgcgaucucggcucacugcaagcuccgccucccagguucacgccauucuccugccucagccucccgaguagcugggacuacaggcaccugccaccaugcccggcuaauuuuuuuuguauuuuuaguagagaugggguuucaccauguuagccaggauggucucgaucuccugaccucgugauccgcccgccucgaccucccaaaauggugggauuacaggcaugagccacugcgcccagccuauuuuuuuuuuuuuuucuugagauggagccucgcuguguugcccaggcuggagugcaguggcacaaucucggcucacugaaaccuccgccuccaaaguucaagcgauucuccugccucagccuccugaguagcugggacuacaggugccugccaccaugcccagcuaacuuuuguauuuuuaguagagaugggguuucaccauguuggccaggauggucuugaucuuuugaccucgugauuugcccaccuuggccucccaaagugcugggauuacaggcaugagccauugcacccagccuacagugacuauucacacuguaacaagacagauuuaaaaccaaacaugguuacuggcuguagcauguuauauuaacuauaaacaaaaccuaugaucaaaucagauaaacuucacaaaagaucaucacuaccaaaacauaaaaauuuugauaguuuuuuuuuaaucucugcugaaaaugagaauaaaugaaauuuuucaaauaggugucuuuuguaucacugugcauagaacaaauuuuaaaaugugacuugaguugcuuaaauuccaagguugguuuuucaacaaauaaaccacguuuuugagucacuuuuaaaauuucauaccaaucaaaaucacgugucaccaaugauuuggguuuuuuuguguauguugcccagguuggaguguaguggcaugaucucugcucauugcaaccucugccuugauuugggcuuuuuuuuaaaggcagcuuuuaugacagcaauauuaacuugcuccauuuacuuuuggcccuuauuuuaaaaucauuuauacuaauuuuguuuuuuuccuguuguuuguuacaaaacuuucacaauuuguauucugugacuggggaccuauacuauuuauuuauuuauuuuuuaaagagaugcagacuugcugcauugcccagacuggucuugaacuaggcucaagcaauccuccugcaugucugggacuacaagcaugagccacagugcccagcaugacuuuuacuuuucacaauagacuucacauaccacucccucagcuagucauaggugcuaucauggugccaagggauugaaauuguaauucuucuaaccuguaauguuuuagaaauaaaauguuaauuugauaaaccaaauaaggauuugaaaaaaaaauuaaaacccuacaauaccaguuagaaauucaaaccauuucuugguaagcauucuccaauuuuacaauugagacaaauuuuaguacaaaauauagauguggauauuucugguuuugggauguucauucagacauuuauaaacuguuuccuccuucuguugcucagaaacacauauuuaacuauuagaaauucaacucaauuuucaaggaauacauuaucugcacuguuaauccugccucugucuuugagauauuauuggaauuggacugaugccacaguuggauuuauuuuuuccagucucuaggcagcauucaguuaaaacaguuacaucaaauuucaggcaugaaauggagguuugcaacauagcucagaauauuauacuauuaugcauaaaaacauauuagaacuauguaaaauauuaaaggcacuuacuguacaauaaaaaauaaaaauucugcaacaucuucuacauaaaacucaggcaacgcugcaaauaccuuggggacaucugaauuuaaaggcaguguuauacugucaaagagaaaaaaaggacaauuuauuaaaugaaauuaugguacaucaaacuacaaggaguauuacauuaccaucggauaaguauuucauuuggggaagaaaaucauucuguaauacuauguaauaaauauguaggcaaagaaacuacaaccagaaaugaacagggaauaaugaagacagugcauaugcaaggguaugugugaaauguuuuccuuuucuugauuucuuuuuuuucuccccugagauggagucucacucugucacccaggcuggagugcaguggugcaaucuuggcucacugcaaccuccaccuccccaguucaaucgauuaucaugucucagccucccgaauagcugagauuacaggcacgugccaccauaccuggcuaauuuuuguauuuucaauagagacaggguuucaccauguuggccaggcuggucucgaacuccugaccucaagugauccacccaucuuggccucccaaagugcugggauuacaggugugagccaccacaccuggcccuuuucuugauuuuuuuuuuuuuuuugagacagagucucacccugucacccaggcuggaguacaguggcgugaucucggcucacugcaaccucugccuccuggguucaagcaauucuugugccucagccucccgaguagcugggauuacaggcgcccaccaccacaccuggcuaauuuuuguauuuuuaguagagacgguguuucaccacguuggccaggauggucucgaacuccugaccucaagugauccgccugccucagccuuccaaaguacugggauuacagacgugagccaccacgcccagccuucuugacuucuugcuaagguuaaugcaauaaguaaaaugggaaggaaauaaaaagguccuauuuggucauuuugugcaacucaaacggaaacaacagagcuacacacauuuuuuuuuuuuuuugagauggagucuugcucgucacccaggcuggagugcagagacgugaucuccgcucaccggaagcuccgccucccagguucacgccauucuccugccucagccucccgaguagcugggacuacaggcacccgccacagcgcccagcuaauuuuuuguauuuuuaguagagacgggguuucaccguguuagcaaagauggucucgaucuccugaccaugugauccacccgcccuggccucccaaagugcugggauuauaggcgugagccaccgcacccggccuacacacauauuuuaaauaauauuuuccacgccuucacgggucuugggccaaucucaccaacaucagugaaccagagacuucauaacaguaaaauaauaauaauaauaaauaaaacaaaaaugguuugccuggaggagaugaccaguugaugacaaagugaucaacaauguucuuagcucacucucugaauuagguggguauuccuggacccagugcuuaggagggccuaauauuaucuccagcuuuuggcuuccaauuuauagauuucucuuucuaucaaucaaagacuuuauagcaaauuuuaaagaaaacuugucaaaauuaaaauaacagguguugacauuugccuauuauuguaacuaauuacagggaaaacaccuaucaauauaacuacauaaucuauauaaaugcaaucuggaaacugagaagugaauuaucuuuuuuuuuggguggggacagagucucgcucugucgcccaggcuggagugcaguagcaugaucucggcucaaugcaaccuccgccucccggguucaaacgauucucaugccucagccuccugaguagcuaugacugcaggcaucugccaccaagcccggcuaauuuuuguauuuuuaguagagacacgguuucgccauguuggccaggcuggucuugaacuccugaccucaaguuauccaucugccucagccucccccaaagugcugggauuacaggcgugaaccacugcgccuugcagagaagugaauucuugauaaagaaaggguuuugguuuuaguuaucaacuuugaaggacaauaaagacaacagagcccagccaaggagggacaagggaaacaggaagaagcacacucacucgggauaugcgggguccaggaugcggagcagcagcugaaugagaaggccauaaaaauucagacaucuucucaggaagcucucgucaaguaggccagcaucagcacaggccuugcaccguaccaguuucuguggaagcagggauguccccacccaaagaucagucaguagcuaagucccuacagggggacugggcagggacuggggccaggagaugggaaauuuggguuccagagcuucuagagcuucaucuccuaacuagcuauaagaugcugguugugucucaagaccuuuuuccugagaaaaacaaaggcguggcaagcaaaccaccgaguaccaccaggucuagcacacaguuaaagcucaaaauguugaguuccaacagucacaaguaaauaaccugaugaggagaggguggcgacagggaggcccuuugggugucagggugguuagugggaaaaagccaaacaaucagugucugaauuccagugucgccucuuacgagcugcccucgggcaaaaugcuggccacuaaggauggaauuccuaccuagaggccuguugacagaauuacacacacaugcaugcacacacugauguauacauuuaagcaguuuuuauguuucuuauuuauuuauuuugagacagagucuugcucuguugcccaggcugaagugcaguggcgcgaucuuggcucacugcaaccucugccuaccagguucaagcaauucuccugccucagucucccgaauggcagagauuucagucgugugccaccacacccaguuaauuuuuguauuuuuaguagagacgggguuucaccauguuggccaggcuggucucgaacuccugaccucaggugaucugccugccucggccucucaaagugcugggauuacuggugugagccaccaugccuggcaauuuaagcaguuuauagauccccuugaaacacaucuguggacugcuuaggggggugcacagaccccagauaagggccccuuguuaauugugcaucuugaagaagucuagucuauuaguaaauaaaacugaaaucuuaacugguacuagaaagcuaugucagguaaacuuuccacauauuauccuacuguucaacagaaugcaugaccagcuaacacucagguuuauaacuggaacaugaauagaagaaaaaugcauaaauuugcuaucuaugcuuuauuuguacaaugucagcuggcauauguuuuuagcuaugucucaccagcaagaauauucccaucuauaguuagguuuugugugaugaaucaauuucaauuaaaaagaaagaaugaggggcaaaggaaagagaucuuuccacuaccacagauacucuuugucaaauaucauggaaaugcauggcuagauauacuggaugaguguuggggcgaggggugggagacagcaggugaggagggcccugcauaaggcagggaaggagaggugauuuuuguuguuguugucuuuuuuuuuuugagacggagucucgcucugucgcccaggcuggagugcaguggcgccaucuuggcucacugcaagcucugccuccuggguucaugccauucuccugccuuagccuccugaguagcugggacuacaggcgcccgccaucacgcccggcuaauuuuuuuuuguauuuuuaguagagacgggguuucaccguguuagccaggauggucuccaucuccugaccucgugauccgcccgccuaggccucccaaagugcugggauuacaggugugagccacugcgcccggccaagggaggugauguuaaacugagaaucauaaaacccauuaagaauucauaaucacagcagaagcauaucuauccauauucuguccugagacugaaaucauuauauacacauauaaguaagguaucaacaaguuuuaaaauauacuauuuuauuggaagggaaaagaauaacaaagaaaaagugaggacacuaaacugcucacucaaggcauauauucuguugggaaaauuaucacuaugaggcuggucuauaauuauuccacuuagcuauacaaaccuuaagcugaguuuuacagcgcuucagcauuucgcggugucuaguugccaguggggaaucuuuccauuggcuuucauuauuuuucaaaucuucuacaguucugaaaucaaagacuaacagucaaaugaaagaaaacagccggauccaucuuacccauucaucuugcucauuucacugacucucacacgcaguuguuuguuuucgcauuguaacaucuuuaaaaucagaguauaucuuacaaccagcggcaaaucauaguuuaauuggcagcauuuuucuuucuuucuuucuuuuuuuuuuuuuuuuaagacagagucucgcucugucaccaggcuggagugcagugcugcaaucucagcucacugcaaccuccgccuccuggguucaagugauucuccugccucaaacucccaaguagcugggauuacaggugcucaccaccaugcccagcuaauuuuuucuauuuuuaguagagaugagguuucacuauguugggcaggcuggucucaaacuccugaccuuguggucugccugccccagccucccaaagugcugggauuacaggcaugagccacugcgucgggccauauuuuucuuuuuuauugguuccuaaaacaaugaugugucuuugaauggauggcacuacagauuuggugaauauaaucaucuuuuuuguugcaagaaaguacauuguucccuuauuuuucugggagggaaaaaaagaagucucucaugaaaauucgagguuacuuugccuauucaauuacccaaaacaaaaggcuauuuuacuaacggcaucguccuuuacaacuguucccucugcucgcaaugcucuucucugagguuaucucuggcuuugcuccuucacuccccucaggugucugcucaaacaccaucugucucugcaguaaaaggcuuccccaucaccuaauaggcugcauauuuugaagaccgacucucuuaacacuauuucaaccccuuucuaucaugauguuguguguaauacuagaggcugcuaaaucuccaaaagcuacauuuccuagacuccccuccugccagcauuucuguaagaccuaguuuucaccaagaugaacccucacugaaggcagagugaguacugugaagugacugcgugauugcaugauccuucuggaaguacagugguagagggguuuuggcugaagcuguggcagaggcugugcugucaggcugaccuccgaagcagcuuccuuguucaaaguauagcucugggaaucuucuauuauagccauuccaaugauucaguaaaccaacuaguuccccuuucugcuuaucccagaagaauuggauucuuucgucuacaacugaaacaugaguaugguagacaaaagaauggcuccuccaaacuugucgcauccgaauccuucgagggaaccugugaacaugugaucucccauggcgaaagggacguuguagaugugauuaaggguauggauuugagaugggaagaguaucuuggaugauuuuggagggcccaauauaaucacaaagguccuucuaagagaaaaaaggacucagagacagagaaggagaugugacaaugggacaauggaagcaaaggucagagagagaaggagaucuuguuguugucuuuuuuuuuuagacugagccucacucuauugcccaggcuggaguaaacuggcaucaucuggcucacugcaaccucugacucccggguugaagcgauucuccugccacagccucccaaguagcuggaauuauagacaccugccaccaggccuggcuaacuuauauuuuuaguagagaugggguuucaacauguuggccaggcugaucucgaacuucugaccucaaaugauccaccugccuuggccucccaaagugaugggauuacaggugucagacacgugcccagccuuguuuuuugcuuuuuugagacagggucucucacucuguugcccuggagugcaguggcacgaucucagcucauugcaaccucuaccuccuggguucaaauaauucucguaccucagccuccugaguaguggcgacuacaggggugcguuaccaugccuggcuaauuuuuguauuuuuugguagaaaaggguuucaccauguuggccaggcgggucucaaacuccugacuucaagugauccacccaccucagccucccaaagugcugcgauacaccaggcaagcgaaggagaucuaaagauacuauguugcuggcuuugaaaauacaguaagguggggugggguggggggugauaaggagcagaggaacguaggcagcuuucagaagauggaaaaggcaaaggagauucuccccuagagccucugcagggaaugcaaccuucaucuucuuuuuuugagacagucucgcucugucucccaggcuggagugcaguggcgcaaucucagcucacugcaaccuccgucucccguguucaagcgauucuccugccucaaccucuugaguagcugggacuacaugcaugcacuaccaugaccggcuaauuuuuguauuuuuaguagugacgagguuucaccauguuggccaggcuggucucgaacuccugaccucaugugaucugcccaccucggccucccaguguugggauuacaggcgugagccacugcgcugggccgauuuuaggacuccugaccuucagaacuguaauauguguuguuuuaagugacuaaaguugugguaauuuguuguugcagucauaggaaacuaagauaaugaccuauauggcuacggguaucacaagaguuuauagguaacaggccuucaugaaaaaaauggggcucugggaucaguucuuugauugggcugcauggugaagauacaauuaguauuugaggauggaacacugguagcccaaggcucugaguagaaaaacagcuauauacaugaucccuggugaucuggaaugaggauguggaguggcuaccucuaauuaugugguggagcuuauagaaaaaaaaaaaugacaggcuucagauuuuaaauucuuaucuccaggaaaugugaauuaaucaggaguuucuaagacuguuguuaaaggaaaggagcagcuccaguucuacaaauuacaguacagaagaaauuaauaacuuugcuggaccucuuaucugaaaguuaaggcaaagacugggacccaaagaguucaaauggaggaguuugggagaacuagcugacuccaaguaccuaaaucucuaaauucccugagccuugcuugcuagcagaagcaguuucuauaaugaccucaucagagauagucaccuugcaggguaaugcuauuuuccccuagguucuaacccaucaucccucuucgcuuccagaaccacagcuagagucagaucaaggacuguccuuauggcauuauuacaaaauuggaugcaacagaagcacauauuugaagaaaaaaaauggcaagauuugcuaauguguuaugcuaguuuucuauugcugcuguaacaaguuaccacaaccucaguggcuccaaaccacacaauuauagucuuagaguucuggaagucuaaaaggggucagcagggaugguuccuucuggaggcucuaggggagaacaaguuuccucgccuuuuccagcuuccagagguuaccggauuggcucaugaccccaaaccacuccaaccucugcuuccccaucacauuccgucucucccugugacccuccugauucccucuuaugaagaccuuugcaaugacacuggaccuacccacauaauccaggauaaucuccccaccucaagaucaugaaccugauaucacagcugcaaagucccuuuaaucaaguuagauaacauauucacagguuccgagaccaggaugugggcaccuuugagaugccauuacucuaccaaccacauauguacugcagaaacaugacgguuauguaggauuauguaugggaauggauucugaggaugcuugaucagcaagagaagaaaaugcugauauacuucuauguagggcuaaaaucacugacaugauuauaccuaccagagacccugaauucaguauuauucugaguugggagagguucauauuaugcaaccaacuaguugacccaaacuuugaauugacagugaccuauacugaaugaagcugaguugccaaauauucuuugaucuaauucagaggaaaugauucaaaacuuaaagagcuuggaaaauuaagguggauuuacuuuaugugauuugcucagauaauccucuuuccaauacgcauauacacaccccaacuauguccuagaagauacuucuuaaaucacagcauugaaaaauacacagaugaggugaacauaaaugucucuggaaagcacaauaaaggcuaucugcugcaagccaggagcaaagguucuagaugguuccauugaaauggacccucuaaagccagcgggagugacuguaucccaggagguaauccaucggaggauaaagaaacagauaaauccacaaucauaguuugaauuuuuuauaagcuucucucagugauugauauuauaagcugauaaaaucauuagauauaaggaaaacuugaacagaaaauuaacaaacuugaccuaaauaauauauguggaacacuguaaaaacaacacagauagcagucuuuucaggucuacuaauguaaaaggcuauaaaguaaauuucaauaaacuucaaaagacacaaaucacauaaaauauauuuucuuaccaugauggaauuuaucuagaaaucaauuaacaaaagauacauagacaaauacccuaagaaccuagaauuuaaauaauauauuuugaaauaacccacagguuacauaagaacaaacaaaaauuagaaaacauuuugaacugaguaauaagauaugauauaacaaaaaugagggaugcagcuaaggucacacuaagagggaaacaaaauagucuuaaauauacacauaagcgaaaggguuggaaaggaugaucuaaauauccaucucaagaggcaguagaaagccaauuaaaaugggccgggugcaguggcucacaccuguaaucccagcaaggccuaggcaggcaaaucaccugaggucaggaguucgagaccagccugaccaacauggagaaacccugucucuacuaaaaauacaaaauuagcugggcgugguggcacaugccuguaaucccagcuacucaggaggcugaggcaggagaaucacuugaaccugggaggcagagguugaggugagccaagauugcaccauugcacuccugccugggcaacaagccugggcaacaagagugaaccuccucucaaaaacuaaaauaaauaaauaaaagcagaaauaauaaggauccuacagacauuaaaaugauaaaaggauauuaugaacaacuucaugccaaaacauuuucaaacuuuagaaaaacugacacaagauguaaugaaaaucuaaauagucuuauauauauuaacugucuuaaauccauaauuaaaaacauccccacacagaaaacucuuaagcccugacaacuucaucacugaauuuuuucugacauuuaaggaagaaacaacauaauucuuauacaauaaacucuuccagggaacauaaaaaacaggagaauauucuccaguucuuucuuuuuuuuuuucuuuuguugagacagagucucacucuugcucaggcuggaguacaguggcucggucuuggcucacuacaaccuccgccucccggguucaagcgacucuccugcuauagccucccaaguagcugggauuacaggcaugcgccaaccaugcccagcuaauuuuuguaguagagacggguuuucacuauguuggccaggcuagcauccaacuccugaccucaggugauccgucugccucggccucccaaaguguugggauuacaggcguaagccacugugcccagcccccaguuucuucuauaaggcagcauaaccuugauaccaaaauuugagaugcacuuaacaagaaaugaaaauuacaggucaggcuuucuuuugaacagaugcaaaaauccuaaacagaauauuagcaaauuguauauccaauuagauauaaaaacauuaauauaaaaguuaaguuuacuccaggaaagaaagacugguuuaauaacagaaaaccaacugauauaauucaaccacauuaacagaauagagaagaaaaaagucuagucuccucaacagauauggcaaaaguauuuaauaaaauucaaccagugcuaagggaacuaacuauugaaauaaaaggaaauuuucuuaaucugguaacugaggauauauagaaagcuuuccuccaccaacugaaacaagauggaaauuucaagguuauuucuauucaacauuguacuaaaaauuacagccugggcacuaaggcaugaaaaaaaaaguaaaagaaauaaaauugucaucauuuauagacaugauuauguguagaaaguaaaucauaaagaauuugcagaguuaacuauuagaauuaguaagugauuuuaggccaggcacgguggcucacaccuguaaucucagcacuuugggaggcggaggcagucggaucgccugaggucaggaauuugagaccagccugaccaacauggagaaaccccgucucuacaaaaaauacaaaaaauugggccaggugcaugggcucacgccuguaauuccagcacuuugggaggcugaggcgggcggaucacgaggucaggagaucaagacuauccuggcuaacacggugaaaccccgucucuacuaaaaauacaaaaaauuagcugggugugguggugggcgccuguagucccagcuacucaggagacugagacaggagaauugcuugaacccaggcggcagagauuacagugagccgagaucaugccauuggacuccagccuggacuacagagugagacuccaucaaaaaaaaaaaaaaaauuggccaggcgugguggugcacaucuguaaucccagcuacucgggaggcugaagcaggagaaucgcuugaaccugggaggcagagguugcaccgagcugagaucguaccacugcacuccagccugggcaacagagcgagacuccgucucaaaaaaaaaaaaaaaaaaaaaaaaaaaaaaagaauuaguaagugauuuaagcaagguagauacagagauauaaauaugauucaguuucucucauagacagacuacgcagguucuagaccaaaaagcagaaguggcaucauuauuauuccagauaaccugcucaaaaauauuugcuucuguguuccugugacuucuguuuguugguguuaguacacaggaaaaaaugcuuagaguaagaaacacaaccauggugcuaaugaauuggaaauuugaggcugcuaucuggccauuuuggaccccucaugccacagaacaagccaaaaagagaauuacauguaggcaggaguaaaugauccugguuaucaagggaaaccaugguuacuuuuucacaguccagggaagaagggguaugucugaaacccaggggauccuuuaaacuuuuaaaguuugaagugccuccugguaauguaugcccagugggaaaaguuaauggaagucuguaguaaccauaaacagagugaaauauccaggguucagaacucucagaaaucaagguuuggaucacuucaccagguaaagaacucuggacaacugagcaacauggauguggcgguggaggcagacagaacacuauauaacguacauaccucccccaacauucaaaacuacuguucacaauggaauugccugccccugagaaaaagugguaacucaggcaaucccaggacacgguaucauggcacauaccuauugagcucccggauagcccggagucugcggauauagcgacggcaacuaggcagaauagagagguggugagcaugcagggugagaaagaagcacuccguagggaauuucggcucagaaaauggaggcugaucgccaucuaggaaaaauaacaucauucccuaaauaaaaucuauuacaugucucaaucagagaaaaagcugaauucagaagagaaaauuacauuugaauuuuuaugaaguuuaaagauacuuuuuauuuguuuauuuauuuauuuauuuauuugagauggacuuuugcucucgucacccaggcagaagugcaauggcacgaucuuggcuuacugcaaauuccgccucccagguucaagugauucuccugccucagccucccuaguaagcugggauuacaggcgugugcuaccacaccuggcuacuuuugcauuuuuaggagagacgagguuucaccauguugcucagacuggucucgaacuccugaccucaggcaaucuacccuccuuggccucccaaagugcugggauuacaggcgugagccaccaugccccgccagaaguuuaaggauacuuuugcaauuauaaacuuaaacaauacuacaagaagaagagaauuccuguuagcuccauucaaggaccaccguauucuguccuaccucguuaaaugugcauacagauguccaucacaaucuuuuuuuuuuuuuuuuuuuaagagggucuuacucugucaccuagugucaccuaggcugcagugcagugcagugguaagaucacagaucacugcagccucaauuuccugggcucaggcaauccuccugccucagucuccuggguggcugggaacacaggcaugugccaccaugcugggcuaauuuuuuucuuuguagacaugggguuuccuuauuuugcccaggcuggucuugaacuccugggcucaagcucuccucccaccucagcuuccaaaagugcugggauuauggaugugagccaccauucccagcccaucaacaaucuuuggugauguuccuuacugauguauuguauaaaaucuccauuuuucaacacaauacagaaauauuuaaaucucgaaaugguauuaaauuauguuaauaaacuacugauuccagagccguuucccugcauauuucuuuuuucuaauuuuuuucuauuauaaauaauguuacuacugggaggauuuauguaaacaaaauuauuccuuuuuccuccaacuuugggaauauaaccugaaaaguagaauuauugagaacaacaguauuauauuuuuugcuaugaaucaccagaauucacuucagauagguuaaauaaauugauuaaauaucaccuacuucuucaaaaacuuacauucuauuuuaucacuuugguuuuggcuuuuuuauagauauauuaugauaacuugauuuuuuuuuucaauuuguaucuguuuuuuuuuuuuuuuugagacagagucucacucuguugcccaggcuggagugcagugccgugaucauggcucacugcaagcucagccuccuggguucacacaauucuccugccucagccuccugaguagcugggauuacaggugcgugccaccacacccgcuaauuuuuguauuuuuaguagagaugggguuucaccauggugaucaggcuggucaugaacuccggaccuuuugaucugcccaccucagccucccaaagugcugggauuacaggcgugugccaccaugcccagcuaauuuuuguauuuuuaguagagacgggguuucaccacgguggucaggcuggucuugaacuccugaccucgugauccaccugccucggccucccaaagugcugggauuauagguaugagucaccacgccaggccuacuguauuaauuuuuauuauguuucucuaucucuuaaguucauuuuauggugaggugguaacaaucugugaggaacuacuagcacacagacaagagggcaguguuuuaaugaccgagucacgaacacaguacucacagaguucagucagccagucauucacaucuuccaucguugcauucacacgcgucucaucauugggaagaguaauccgacaucuugggugaaaaauauacgugggaucaacuguuucuaacuugauuuuuguacuuagcugcugcaguacccaaaggaaauucagcauaaauccaucuguagacaccaaucuaucaucugucugugaaaguugaaaagaaaaaguauuuuuaaacauuaaaaaaaauuuuuuuugagauggggucucacucuguugcccaggcuggagcgaaggggugugaucuuggcugcaaccuccaccucccaggcucaagcaauccucccaccuuagccucccaaguagcugggaccuaaagugauccgcccaccucagcuucccaaagugcugggauuacaggugugagccacugugaccagccaagaaaaaguauuuaaaauaacaugaauagaaauuuuggcaaacuuuguaagaaagcagacugaacuuucaaacauaacuguauccuaaagucaaugagaagacauauaucucaucaccacugucauuccauuaauucuauauuagcaggugcuacuuguugaauaccgccuauuauauaauuauuauuuauauaagaggcauuuuauacauucuuuucuuuucuuuucuuuuuuuugagauggaguuccacucuuguugcccaggcuagaaugcaguggcacgauccucgcucacuacaaccuccgccucccggguucaagugauucucuugccucagccucccgaguagcugggauuacaggcacccgccaccacgcccggcaaauuuuuuguauuuuuaguagagaugggguuucaccauauuggccaggcuggucucgaacuccugaccucaggugauacgcccgucucggccucccaaauugcugggauuacaggcaugagccaccacgcuuggccauuuuauacauucuuuuacugaaccaucacgauaauucuuacaggucaguaauacugcuguuaacauuuuaugcaggaggaaauaaagacucagagacccugaagugauuugccugaggcucaaaauuaguaaguagaaacacaauaaauguuucuuucuuucuuucuuuuuuuuuuuugagacaggguuuuacucuguugcccaggcuguagugcaguggugcaaacauagcucacugcagccucaaccucccgggcuuaagugauccucccacuucagccuccugaauaacugggucuacaggucuaugccacuauacuggcuaauuuuuuauuuuuuuuguagagacagggucucccuauguugcccaggcuggucucgaccucccuggcucaagugauccucuugccucagccucccaaguagcugaaacuauaggcaugcaccagccaccaugcccagaugacuuuuguauauuuuguagagauggggucucauuaugucgccagggcuggucucaaaugccugggcucaagugauccucccaccucggccucccaaagugcugagauuacaggcgugagccaccaugcccggccucuuucuccucuuuauuucccucaagagcaucaaaacaaguugcuccacuucuuaucaugugacauuguuucucuaggugacagcaucagcaugcuccugcauuagcaauauaacaauguaacuugauuaccucuguuaagaaaaaaauaauaauacaacaaugauaagaaugauaguuaauauugguugagugaucacuguguaccaggcaccacucuaacagcuuuauauauaauaaacccaguaccaguaguaccgcagcuuagcagaugaggaaauggaggcacagaggagucacugucuaaggucccgcaguuaguaaacgguggaaccacgaucagaaaucacaagaucugugcucuucucucuacaugauuuuugcuucugaguauacacaucacaucauucauucauuauuuauuacuagucaaggaaggaugcccuuuucuccucuggcaaagcagcugcagccacuggccugucucacccggaccgaagcacucacgcccuugcagcugccuucuugggucuguuccuggcugcccccuugggucuguuccuggcugcccccuucuguuuugguccgucuacauagcagcuuuugugguuucccugcugaaaacccucccaugacaguucugaucacguaaaccuaacccgauggcgcccugccuauccacuaacuccaggacccgacauucccuccuguucacucuucuccagccacaaaagccugcgugcugggcuuguaccaaagcugcuucguuuccacauuggauagcucuuuucucagccacuacaauggcuggcuccuuccuaugaaacaaaugucaccuccucagggaggccuuuccugccacccaaucaaaaaucaccuucagaucuuccuucugguaccuacaguucuucucaugucauuuacuuugcucuauuuucuucacugauuauacaacugucuaaaaucauguauuuauaugucuacuuguuuauucuguggaacaugggcuccacaaaagcaggaagcucgucuaccuuguucaauacuguacccccacuccuagaacagugccugguaggugcugacuaaaucugggucagaugaaugaauuugacaaacagcgaaaagcagucuguaggaauccuaccugcaucugugcuuucuucauauuggcauugacgacagccgccauguaacugagagcagccucacggguuucgccauuuaacaaaauacuaugcagaaucuuaaaaagcucuugcugaaauuuauuuuuaaaaagaagaaacaaauuaaaacuauuuugcacaugauuccuuuuugacuucacgaacagcuagccuacuucccacguucucuccucucccacuucuacucauuuuagaagagccugagugaaagaauauaagaaauauccacauccaacuaugucaaaguaaugagcaugaaagcagaauauggagugggggagguaggcaguuacaguuuuuuguuuuuuuuugagacagagucuagcucuguugccaggcuggagugcaguggugcaaucucagcucacugcaaccugcgccucccagguucaagccauucuccugccucagccucccgaguaguugggauuacaggcacacgccgccacacccagcuaguuuuugcauuuuuguuguuuuuuuuuuugagacggaguuuugcucuuauugcccaggcuaaagugcaguggcacaucucggcucagugcaaccuccgccucccgguuucaagcgauucuccugccucagccucccaagucgcugggauuacaggcacccgccaccaugcccagcuaauuuuuuuuguauuuuaguagagaugggguuucaccauguuggucaggcuggucucaaacugcugaccucgugauccaccugccuuggccaauuuuuguauuuuuagcagugacgagguuucaccauguuggccaggaugacuuccugaccucgugaucagcccaucucagccucccaaaguguugggauuacaggcauuagccaacacgcccagccggcaguuacaguuuuaauaaaauaggcuuuguuacuucuuucccaugaucaaaauuaccuuaguuacccaagccuguaacuucuuugccuguuucuuuuuuuugagauggagucuugcucugucgcccaggcugaugugcaguggcgugaucuuggcucacugcaaccuccaccuccuggguucaagugauccuugugccucagccucccgaguagcuagguagcugggauuacaggcacgcgcugccaugccuggcuaauuuuuguauuuuuaguagagacgggguuucgucauguuggccaggcuguucucaaacuccugaccucaggugauccaccccacucggccucccaaaguguugggauuacaggcaugagccaucacacccggcccuucucugccuuuaaguuugagaauugaagacauauuaaucugcauuugggauaagcaagucagugagggugugugcaaacuaacaauccuugcucacccucacaguguaaaugccuaagggccagcuggaggaggagccgggccacuaagcuuaggaccaguucccagugaugcuacauacaaaggcagcauacugcuguuguuacaaccuguuauucaagacacaggcuacuuacuuauaguuuaucuuuuuuauguaagaucgaauuggcuuuuguuagccguuugucuacugggcauaguccagucuacaaaauaaaagcucuguaucuggagcucaucuuugauacuuccucuggauuuguuuucugaacacuuacccuuccgagcucuaaguaaugcugcaaugauuggcuaaccacacgaguguuuuccaggguaauggcaggcccugagaaguauuuuucaaccacuuuaaccuggaaagagaaggaaaaaaugcagucaacauauaaugcacauuugggaaagaaucugaauaaaagggcagcaaaguacaaguagccacuauacuuacaucaucuucugcaaagacugagaagcuaaagaaagccccuaaguaagagagucucugcagcucccgcccacagccaggacuuaaggauuucggcaaccacaaccgcaaagaagcaaccuaggcagaagauggaagagccagucaagccgcugaacaggccggugggguaaaaauguaaugaaaacucuccagcuccucuguauuuucacaagauauuauuaaaacuuuuauguuucagccaggcaugguggcucacgccuguaaucccagcacuuugggaggccagugugggugggggugggucaccugaggucaggaguccgagacaacccuggccaacauggagaaaccccgucucuacuaaaaauacaaaaauuagccgggcgugguggugugcgccuguaaucccagcuacuggggaggcugaggccaagagaaucgcuugaacccaggaggcagagguugcagugagcugagauugcgccacugcgcuccagccugggugacagagugagacucugucucaaaaaaaagaauguuuaaguuucaggauacuauuggaugaaguucaaaugaacucuucuuauaccaccaaaggacucgaauaacuuuuccauaccucuuguuaguuuaguuguacaauacuugucaagggaaaaaaaacaggcccggugcgguggcucacgccuguaacccaacacuuugggaggcugaggcggguggaucaccugaggucaguaguucgagaccagccuggccaacaugguaaaacuccaucucuacuaaaaauacaaaaaaauuagccucgcaugguaaugcaugccuguauucccagcuacuugggaggcugaggcacgagacucacuugaacccaggaggcguaggcugcagugugccaagaucccaccacugcacuccauccagccugggugacagagugagauucuuagaaaaaaaagggaaaaaaaucauagaaaugaacaacuguaaugcaggauauaacgugucuaacaaaaauguaacaguugagagccucccagacacguuaccuccgccuacaccuaaauguccuucaagagacauuuuccaggccaucucacuagaggaaugccuucuggguuaugauauauucacugaaaaugugcaagcccaucaggugagugcuuaccaaauugcacacagggugugucuucccaaacuugguuucacagagcucaccuagugccuagaaauaagaucagagucauuuaaaugcauuucaucuuaaacugacugucauuuguagcauaaagaaacaguuuuaacugcugcuauaaauucguucccucuaaaauggcacacaugcauucccucugaaauggcagcagcuucacuacuuuuucugauuaauaaacuaaaacacaugcaaugugaaaacuugaaauaaaacagaaauauaaaaugaaacuaaaaauuacucaagcuuuacccucaaagauaaccucuauugauauuuugagcaacaguuuucagauauauuuuuguguacuguaucuauauauguuuuuuacaaaaaaguuuuuccacuucauaucuuuccaugucaaaaagauuuauuucauaaacuuuagauggcuccucuugccaguguuaaacaugacuauaaauaauuacaauuuaauaagcuaucaaauucaaaacauauuuaaaaacauaacuugguuucaagauuucuaguacuuuuaagaauuccaacacuuuccuucagacauccaaccauccuaacauuagagaacgaugaaaaacacuuuuuagggacauaaacauaauuuagcaugcccaugguaacucaaucaaacauuauuuucaacaguuaauuuccucugugauucggacgcagcucuagaaguugcuacaugagccgaagagugcauuuaggcauugacacaacguugagaugccuuugagguucaggcagccucaacucagaaggaagcguucucacugccuagugcaggaguucacaaacguggcugcauauuaggaucacaugggaagccuuuggaaaccccaaugccaugccacaccccuggugaauuaaaucacaaggucugggguggggagccaggcagaaacaccuuuaaagauccccagcugauuccaaggugauuccaacguauggcacagcaggauccacugaccuagagaaugaucacaaugauuucugauuuuagcuucaacagucuuccgcuuccugccucucauuauuguacccucucacucacuguguccucguuauuaugcaagcaucaauaauggcacaaaaugaaaucacugucuaccacaauggaggccucugucuuuugaacaaaaggacauuuuggugauaucagaugcuaaaagcuccucacugaaacaucaagcuaauucacaccacaacccaaaagccaacagucccaugaaggaacaucuacauaauauggugauaauuaguguucacuaaaauauuucaucacugaacucaaacaaucagauuauuccacuuccuuuuaucugccacagggagaacaauacauaaggauucaaauaauuuuaccaggagccccaauaacauguacaauggaaagagcucuggcauaaauccacuuaaaauuauuuuuuaaaguaggaauucugguuucaccuucuaauuucccagcauucuuguagccuuuuagugccaugacagguuugaauuuuuuaaauagauaaauacacccuuuguguacagcucuguuuuaacauuuaucacaguaucuguucaacuguugcgcuguagcucuuauuuuugcaguagauuaugagugccuugaggagagggaccuugucuuccuagcuucuguaucaccagugucuagcacagaacagaucgucaguaaugaauucaugguauaauggaauccaaucaguggaauaaguaaaagaaauaaauacaguaagaaaaacaaccauggucucaauuuacauaagacuuaauuuauacauagaauaaacuaauuucauuuugauauuuuuuccuuuacacuucugcaacgaaaauauucaguaacacuucaaaauacuuuucucccaaaauuucaaauaagcgaauucagaacagaaaggagcuucuaauuuucauucuaguuucagcauuuucacaacauucaagccuccccaugggaaucuagcugaagcuucuguccacaauguaugccugcucuaagugcguuaaagagcuaagcagauuucuacuucccaaguaaauaugaccuuaggaaacagggagggugaacaagagagcuacacugagauuuucugcacaaaguaaacacauaaagauaaaauuguauucauuuucuuaguauguacagcuuugccuuuuuuauuugcauuuuuaauagguuuuuuuuuuuuaaguaacaaaauuucaucccaacuaugguaugcucauugcuaggagauaaguuaucuuuuucauaagcuauacaaaguacauuguaauaagugcauuuaacuccugucuaggacuuggauagguggaagauguaccaggcugcuaacugucuucacugaugcaucucacugcacaccaaacacucugcauggccaacacagugauuucauguuuuaaauuugaaaacaagguugaucucauggaccugaaagaaaaguauaugucaaaauaaucugaaagaaaaacaucuauugaaugaguuaaagaaaaagaacaaaguuuuaccaugaggggguauuuaaaguagucacugucgagggagcacucuuuggcagcaagagccaggccuuguaaaauggggauaaauaucuauaagaaaaaaaacaaaaucagaaauauaaguuuaagagaaucuaagagugggaaguaugucaaauaaggugcuagaacugaauguccaaauuucauuccuuccccagggaaaagcuuuuuugcauauaaaagucuagaauucagccagaguguugaccuguucuuugacaagucuaaccauaaaguaauacagcugaauucuccagaaguaagaggaguuuggugaacucuaauacucugacaggacccccaguaauucaacaaaacccaguaauucaacaaaacccauacauuuggagccuguugaagaacucuccaggagucguugcucuacucaauuaaauucugcacaucucagcaacuaauauguucuugauuaccaagcaucuauaaccuguuaaaaaauucaauuaaauguuccaauauuuccuccuuucuaucuaucuaucuaucuaucuaucuaucuaucuaucuaucuaucuaucuauauugagacggagucucgcucugucacccagacuggagugcaauggcacagucuuggcucacugcaaccugugccucugggguucaagugauucuccugccucagccucccgagccagcugggauuacaggcaugugccaccacaccuggcuaauuuuuguauuuuuaguagagacgggguuucacuuuguuggccacgcugguuucgaacuccugaccucgugauccacccgccucagccucccaaagugcugggaucacaggcaugagcuaccgcgcuuggcccucuaucaauauuuuuuaaaagcuuuuccccauuuauuuugaggaaaacaagauaaacaggccaacaaucaacauuauuacuacauuaaacuuaaauuagagcaaagagcuaguugguaaauguugaaauuuacaaagaaagcuuuaguuagaaagccuuaccuccacauauaguguaauuaauacauuaaccugcuauuggcacuuaaaggaacucaaaucugcuuuuauacauuuaugauuaauaccagguaacaccauguaagauuuacucagccuagcucaucuucaaauuucacaaugcaagcacugaucaacacauuuagggaguugguugggauucaaggcuaauaacauuaaauagaaauguuguaaacaacagcugacaaucugaaugccaacaaguuguaauaggaguauacuauguagccacuagaaaacuugaaaaauucccuuuccuacuaauuucauuccaugagcaccuuaauaauuuaaagagcacaguauaaaacacaggugcccuggaugacaaaguguccguggaguguugugagauaucaauacagcucuggaagagaucauucuaugguuucugcaauaccaacaaucaagguagauguaacuugcucucauaugccagauaaaaauggagaaguaacacucagguguggagcuggggaaugccaacauuguaaugaggaagaaaagacaaacagagguuccagaaucaccaaaaauuaguucauaacugguuguccugaaaaaucuccaaauuuuuuuagggaggcuacaaguaaaauauaauuacacuuucuuguauaguuauccuuuugugcauugcacagguaaaauauuacuaagcauaaucuuuuucuuuuucuuuuucuuuuuuccagacacaauuucacucugucgcacaggcuggagugcaguggcgcgaucucagcuaaaugcagccuccaucacucggguucaagagauucuccugccucagccucccaaguagcugggacuacaggcaugcacuucugcgccagcuaauuuuuuguauuuugaguagagaugggguuuugccauguugcccagccuggucucgaacuccugagcucaggcgauccaccugccucggccucccaaagugcuaggauuacaggcgugagccaccaugccuggccugaccuauauauuuuaaauaauucuucaauuuucaaaugaauaccuccuagcacugauuaaaaauacuguaaguauccaccuccaguccuaaauucuagcugcuauuuauuuaucugugaacauuucucaaacauuaaaaggagguagauauuucagucaaagauuuaauaauucacauuugccacucuuucaagacaaaaagguaaaaugcugcuuugcaguccaacagcuccaucccaguuaucauuccucucuagauaaaacacaugguagcacauaagaaaagacaaagaguauucaacacugaguggcugaaaagucagcagaauucugggauuaaaaacaaacaggucugggccaggcgcugugguucacacuuguaaucccagcauuuugggaggccgaggugggcggaccacuugaggccaagaguucaagaccagccuugaggccaagaguucaagaccagccuggccaacaugacaaaacuucaucucuacuaaaaauacaaaaauuagcugggcauggugguacgcuccuauaaucccagcuacuugggaggcugaggcaggagaaucgcucgaacccagaagguggaaguugcagugagcugagacggcgccacugcacuccagccuggguaacagagagagacucacccucaaaauuaauuaauuaauuaauagaauaaacaggucugugguggucguauaacacugugaauguaguaaaugccacugaauuguacacuucaaaaugauggcuugaggccaggugugcuggcucaugccuguaaucccagcacuuugggcggcugaggcggguggaucaccugacaucaggaauucaacaccagucuggccaacauggugaaaccccgucucuaauaaaaauacaaaaaauuagcugggugugguggcaggcgccuguaaucccagcuacuugggaggcuaaggcaggagaaucgcuugaacccgggaggcggagguugcagugagccgagaucaugccauugcacuuaggccugggcaacaagagcaaaauuccaucucaaaaaacaaaacaaaacaaaacaaaacaacaacggugguuugauguuauaugaauuucaucuuaauuuaaaaaaugcaggacuucucuguccaaagcuggugauggggaaacaaacaaacaaaaaacacccagaggucauuucauaaccucuuguguaaguuuguuuaugaauaaaguaggcucaauauaccccuuucagcuggucacugggcugauuuuauauagagagaacuacucgauuccucaaaugguaucuucuugaauaggaaaaguauucuaauuacuacccauuaccucuuuaauguagugcaucacucaaaccuuccaagacaguaauuuuuuuuuuuuuuuuuuuuuuuuuugagacagucuugcucugucacccaggcuggaaugcagugguguaaucucggcucacugcaaccucgucuccuugguucaagcaauucuccuaccucagccucccaaguagcugggauuacagacacccgucaccacacccaguuaauuuuugcauuuuuaguagagaccggguuucaccacgcuggccaggcuggucucgaacuccugaccucaggcgauccauccgccucagccucccaaaguguugagauuacaggcgugagccacugcgcccggccgacagugauuuauuuuccugagaguucacuuacccuucuagagaagaaaagcucacuauguugccauuaauauuuccauuagucaguaagaucaucaccuaagauaaacagcuagugaauuccagacagaauacacaacacuaacuggaauuuuuauucuuggauccuggcugcuucuuuuacaaauauuuugaagacugcugaaaacacaauucccaagaauucaaaggucuuaaaauuaacaguuauaaauaaucuuagguauaaaacagagugaaaggaaucauaccaauuauagcuauugccucuguuauucucuguagucacaaaaaaggaagugaugauacagcaaacuguaagaaaauuugauaaaagcccuuucaucagggaaaaaacuugugugacaguugcuaaaggcaaagugcuuacuuucccaaacagguccuucaaacagcaauguuaacaacaaaguuucaccuuggaagaaaccuucaagacuacguacacagcuuuauuuuuaagcacuacauaucugcauuuucaccuggcuuuacacaaugagauaccaaaacaauguauaaauaccaaaugaaauaauuaggaagauaugagacaucuuuccuagugggaagaagacaaagauucuauauggcaugcaggcugccaaugagcuaauauggucauuaaguuaaucuuacaaacucagagaaugaauuuuugacacuacuuaucuggcaaaugcauaucaugccuuaugccgucucuggguauucuuguuuuaaaagcuccuugaaaucaggaacggggccuuacauauuuuuuucauauugcccgaagcaccuagugcagaccuuguuuagaagauagauguuugacugauucguugaaaugggcacaugauuugaacaaugcagcugucaaucugauuuccucaaaagaauauuggguaggccuucucucuaauaacacauggauguucgaauucaggcaaaaguuuucaauggucagaaauuagccucgacauagaggcucucaggcuaaaauuugcaagagcaaacucauacgaccguaccugcuugaacacuucuucauccuggugagugguucucaccaguuccugaaugaagccauaugggagauuccuacacagcauauacggcacuaggaaggacggcugcugcaaggaccuguggacccaugaacauuagggacggugaugaagucaacucacuacagaggcacgugaaaugucaugucagcaacaacugcccagucaaaagucaaacuugacaucucccaaauauucugcaaaauaguuucaggcgaaagcuaacccuucuuaccaauaguaaucacuuuuuggucuuuuuaaugagacacuaugggaauuuucaaagaauucaucuuuuccuacauagagcccuuuaaaaaugaagcacugaaaaaaggaagcauggccaggcacgguggcucacgccugcaauaccagcacuuuggcaggcugaggugggaggaucacuugaggcccagaguugaagaccagucugggcaacacagcaagacucugucucuacaaaagaugaaaauaucaacugggcaagauggugugugccuggaguccuggcuacuuggaaggcugaggcaggaggacugccugagcccaggaguuugagguuauagugagcacuccagccuagacaacagagugagauucugucucuuaaaaauaaauaaauaaauaaaaauaaaaaagaaguauuauauguuuuuuuuguuguuguuuguuguuuuuuagagauggagucucgcucuguugcccaggcuggaguaugguggcgcaauuucggcucacugcaaccuccgccucccggguucaagugauucuccugcucagccucccaaguagcugggacuacaggcgccugccaccacgccuggcuaauuuuuguauuuuuaguagagaugggguuucaccauguuggucccaaacuccuaaccucaggugauccaccugccuuggccucccaaagugcugggauuacagauguaagccaccacgccuggccguauuauauguuucuuuaugccucaucuaaauugggggaaaaaauauuaguaguggcugagggcuuauuaauuuuaaucaaggaacguuuuuuaaaguuuugguacauguauauaauuuuccuucuuuuugaaaaguuucaaaaacauaugguuauggcauacaaaauaacauaagaacaccuagaauaaauaaauguaauguuauguuugugaauuuuuauuuauuuaguauuauuauuauuuuuugagacagucuugcucuguugcccaggcuggagugaaguggcgugaucucagcucacugcaaccuccaccucccggguucaagcaauucucgugccucagccuccccaguaguugggauuacaggugcgugccaccaugcccagcuaauuuuuuguauuuuuaguagagauaggguuucaccauguugcccaggcuggucaugaaguccugagcucaggcaauccaucugccuuggccucucaaagugauaggauuacaggcaugagccuggccuguaaacuuuuaauuuuuuauuauuuuauuaauuuuuauuuuuugagacagaguccugcucugucacucaggcuggagugcaguggcacgaucucggcugcaaccuccaccuccuggguucaaacgauucucuggccucagccucccagguggcugggauuacaggcacaugccacaaugcccagcuaagucuuuuguauuuuuaguagagacggaauuuugccauguuggccaggcuagucucaaacuccugaccucaggugauccgccagccucagccucccaaagugcugggauuacaggugugagccaccaugcucggccuaaacuuuuaaauguaagcuuuucccuuuagauauuuuuuauauaaaagaaaugaaauacacauccuuuuuaaaaacuugcuaccuuuagaagacugagaggcaaagaaaaaaaauuuuuaaaaacaaaauaaaaacaaaaauuugcaaccuuuauaggauucucagaagcaaauaauguagcacuuugguugauuccuaaacuauccauuccauuacuauuguuuauuacucaguaacagaaauugaccguguuauacauggaaggugaugaucuacacauuuuaucaaauaccuccaccaacuucaggcaguugcuguauagucaguuacuaauuuucugccaugcuuguccacauaguucaacaauggucuauuucaaaaagcaggcagaauucuuaaaacauaacuaauuucuuuuuaaaauaugcuuuguacuacuuuagaagaugaggaagaaaggaguguuuauuuucauaguauuuuagcgaaggaaagggaccuucauuuuacaggugaggaagggaguuaucuaagguggugcaagaauggccagagagccugauguccacugacggcuagggcucucugccugcuaaugucaagcacgucacgggucuucauaccugggcuguguuagggagccuuguaguacuaaagcaguaugggauaugcacugugagcggauguugcucagaagcuggcugacugcuggcuggcugcacaucugaaaaggaaagguggaagugaggacgacaagaaacaaacaauacaauuccaugcuguuaaaaauaagaguuaaaagggauggaccaucaguaaacagcgugcuuuccucuuccuuuauucuuagugaacgagcuacaguaacugugccuuccaaguguacugccucugcagaaacugaugucagagaagaaagaagcguaaguuugaggugaccaaacuuauacuuaagaaccuuagaggccaggcgcgguggcucacaccuguaauuccagcacucugggaggccaaggcaagcaaaucacuugaggucagaaguuuaagacuagccugggccgggcacgguggcucacgccuguaaucucagcacuuugggaggccaagaagggcggaucacaaggucaggagaucgacgccauccuggccaacauggugaaaccccaucucuacuaaaagacaaaaaauuagccagacaugguggugcacgccuguagucccagcuacucaggaggcugaggcaggggaaucacuugaacccaggaggcagagauugcagugagccaagauugcaccacugcacuccagccuggugacagagugagacuccaucucaaaaaaaaaaaaaaaaaaaaaaaaaaaaaaaaagaccagccuggccaacauggugaaaccccaucuccacuaaaaaaaacauaaaaauuagcugggugugccgggugcagugguucacacuuguaaucccagcacuuugggaggccaaggugggcagaucacaugaggucgggaguuagagaccagccugacuaauauggagaaaccccaucucuacuaaaaauacaaaauuagccgggcaugguggcucaugccuguaaucucagcuacucgggaggcugaggcaggagaaucacuugaacccaggaggcagagguugcggugagccgagauugugccauuguacuccagccugggcaacaagagugaaacuccgucucaaaagaaaaaaaaaaaauuagcugggugugguggcaggugccuguaaucccagcuacucaggaggcugaggcaggagaauugcuugaaccuaggagguggagguugcagugagcugagauagcgccacugcacuccagccugggugagagaacgagacuccaucucaaaaaacaaaaaaaacaaaaaaccuuggagacaugcccacucauuucgcuuccacuaaggcuaaguacaacaaagcccaaagaaggcccuuuacaaauaugaaacuaaccagugggcaacgagguucguuucuaacguaaaauuaaaaucagaaaaugaaauaggaauaaaaugagaaaacaaugaagccagucaagagaagugaugggaaaaggguagcuuacugaguuuaagcccagccuugcaacuuauuauuuacgugauucuggacaaguacuuaaucucucugagagucauuugcuuagucauacguugaaaaaagaaugccuauguuauaccggguuccacugcacuaacagagcaacugaggauacaagcuaaugucgaccuggcacaguccuuggcaaucuacagaggcucuauaauguugguuauuauaacaaagcaguagaauuaucagggccauaugagucacuggcgguaccgagcuacaguguggucaagagaggacucugaagccaggccaucuagguucaaaccuuggcucugucucuauuagaaugugaguuccacgagggcagggaucucuguuuuguucaucgacacauccuaaguuccuaguauugugccuggcacauggcaaaugcucaauaauugcuuuacugauugaauaaaucaaugaaugcuccagggguggggauaaucaaacaaauaacuaggcuuuuuuuuuuuuaaguuaauccauuucauauuaccuuuggugcuuuuuuuuccucuauuccaacucggucgaaacacucgaugagguaguucagcauaucugucucuuugcagguuucaauggugaaauggucacuguaggaaucccaauuacuugcuccaccagaggcucccaaacuucagagaagacaagaagaaauucugauucuuaucucuugauuauuuuuggcagaguuugcauuucugcagcagaaagccuguuaggaucccuguacacauaacaaagcacaaacacccaugcggccaagauccacccugacugcuuguuucaccugcuccaaagccaacaauaguaacuuuugguaacauuucagggaccuaagaagggcugcuucuuacugcagguggcaacuuagaaaaccagaagcacuaagaacugguaccaaguguuaagcauuggaagggacaucacagguacuuuaaccaaaaagaauggcaucacucagagggcuguagguuaaagccagacuaugcuacugcuguaaucaaacucuuugggggaaaaguuauaagggacugacaaaauagcccucaucuuugugacuucuaccauggaucucaaaagcccucaucuaacauuuggcaauagaaccaaagguuaagaaacucuccaguuaggaggagacaugaacauauuugcuaucgacauaaaaacucuaaaacuaucagugaaaaagguaaaguaguauaguaaaagacaaaacaaaaauauuguacuaggaguaaccagacguggguucuagucucaaccccacugcuuacuuguuaccugaagcuagaaccuccaucucuuuugcagugggguuuuaaugaaauaauguggaggugcuuuguaaaauaucagcagucuauacugugaagcacuguuauguuaguaguaacuauccucugagauaaaaaccaaacauaagcacaaggguuaaauuugaggacauuaaacaaaguuaaaaucaaccauugacaggccacauaacaaaucugguguuuaacucacaaacggauuugauauacauaaaagacacauacggauuaauuacgacaggaaaaaguaaggaguacugaaaugaagaaaaugagaaaacauaaacuuggcaaaaaaccuacauacagaagaugauaaaggaugguaauauggccggguaugguagcucaugccuguaaucccagcacuuucguacaccaaggcagguggaucacuugaggccaggaguucaagaccagccugaccaacagggcgaaacccuguuucuacuaaaaauacaaaaauuuguugggcgugguggcacacgucuguaaucccagccacucaggaggcugaggcacaagaaucacuugaccgugggaggagguuguugcagugauccgagaucaugccacugcacuccugccugggcgacaaagagagacgcuguccuaaaauaaaagaaaaaaaguaugggaacaucaggaaugugagagacacaucccuacuucaacccaggacacacaauuaaugucuagaaacuaacaggaccaagaggaauugacauguuuuacagacagauagauaugcauaacuaauuuuggaacacauuuguaacacaugcgccacauaacaacauuucacucugugauggaccaaauauacccuaguggucccacaagguuauaaugccauauuuuuacuguaucuuuucuauguuuagacauguuuagauacacaaauacucaccauaauuggcauaagcaucuaauugccuagaguguucaguacacuaacaugcaguacagguuuguagccuaagagaaacaggcuauauaucacauagccuagguguguaguaggcuguaugaucuagguuguguaaguauacucuaugauguucacacaaugaccaaucugccuaacgauccauuucucagaauguaucccucucguuaaaggacacaugucuguauggacaucauuguccuuagacuuuggaaaacuacacauaauugaccuuggaauacagguaugauauuggccaaacgcgguggcucaagccuguaaucccagcacuuugggaggcuaagguagguggaucacuugagguauaggaguuggagaccagccugaccaacauggugaaacccuaucucaacuaaaaauacaaaaaaauuagccaggcaugguggcgugugccuguaaucccagcuacuugggaggcugaggcaggagaaucucuuaaaucccgggaggcagaggcugcugugagcugagaucacacaacugcacuccagccugggcaagagagcgacuaugauauuugcugggcacgguggcucaugccuguaaucccagcacuuuugggaggccaaggcgggcagaucacuugaggucaggaguucgagaccagccuggccugcuauuaaaaaaaaaaaaaaaaaaaguaugguauuaaaguauuucaguaagaaggagaaacaaugcuacuuugaaauucaaggcguucagcccagagucuaguaaauuugaacuccaacaaccuauaacauaggccugacaggugaaagcaaagggagacaaugaggcugagaagcagucaaaggaacaaggcagccaacucccugccgacugaguagguaacuaagccaccuacaaagcccucgccagagucaugacaaggcugggcagguccgugugggaucccuuaacaaacaaaggcaauuaauuauugugucuuuuuuuuugagauggagucucgcucugucauccagguuggagagcaguggugugaucucugcucagugcaaacuccgccuucuggguucaagcaauucuugugccucagccucccaaguagcugggacuacaggcgcucgccaccauguacagcuaauuuuuguauuuuuaguagagacaguguuuuaccauguuggccgggauagucucaaacuccugaccucaaaugauccaucugccucagccucacaaagugcugggauuacaggugugagccacagcaccuggccaauuauugugucuuuauagcaacuaauuuuuugguauacuuuauuaauuaauggcaggaucugguaucugcugacuggcuugauaacugaaaagugaguacuguaauaaagcacaggaaaaacacacacuagaacaaacagaaaaagccaucaaccaaugagagaagugcagggaaccccccgaaaggaaaaaauaaauaucuaucuuugcuuguagcaauuuuaguuaguuucaagaccugcgaucccuccucugcugcuaacauucauaacucagugacuauauucacugcacuuugcaaggaugaacuuugcuaaaacaggcuuguaccuacacacaauugaggguaauuuuccuaugaacagcucuugcagaugacaaugaaaauagaucuucuucauguuuaaaaugaaaauaugaaacucuauuucuugauaauaagccccauucuucucacaucuuuacauuucugggaagaaacgcaucuuuuuuuuuuuuuuucuuuuuuuuuuuuuugagacggagucucgcucugucacccaggcuggagugcaguggcacaaucucggcucacugcaaccucugcaucccagguucaagcgauucuccugccucagccuccugagcagcugggacuacaggcacacgccaccaugccuggcuaauuuuuguauuuuuaguagagacgggguuucaccauguuggccaggaugaucucgaucuccugaccucaugaucuacccauuucggccucccaaagggcuaggauuacaggcgugagccacugcguccggccgaaaagcaucuuauguuugaugucaauagguccuugccagcugccaggccucagucugaugcagcacccccagccagcaugugagcgugccugugaacucagcaggcuuagauggcgcuggcucaugcaacugccacugaaauuacucccauuccuagcaauacauccgacuucauuuuaacuuaaauuugaaacccucacugccacuugaaauauuuucacaaaccgugcacucacacaugaaaagugacaauguauguagaagacuauguagacgauugcuuuucuugugccaggcaaugcaaggaaaggcacucaggaucuaugagagaauguucaaagcuaaaagagcucaguguguuuuggugauugauaugguugggauguuuguccaaaucucacauugaaaugcaguccccaguguuggagcacgggccuagugggaggugacuggaucaugggggcagaucccucaccaaugccuuagcaacaucccccuggugaugagugaguucucacucagugaguucacgugagaucugguuguuuaaaagagucugggacauccuccuccucucuguugcuccugcucucgccaugugaccugccugcuccccuuucaccuccugccaugacuggaagcuuucugaggcccucacaagaagcagaugcuggugucaugcuucuugaacagccugagguaccaugagccaauuaaaccucuuuucauuauaaauuacccuuucuguauggcaaugcaaauggacuaacacagugaucaccagccaggcaccaaacaagcugacuugcaaggcggcagauggggggaguuaaacaaagcuuuaaccaaacaggaaauguagcaucaaccucaguauuugucaauguguuucaaaauuauaauauuaauccuaaaggugccagaguaaaucaugaucacaaguaagaaaaguggccaguuucacuaauacaagcguuaagugucaauggucaaaaacugauuuacaagaauuuuuagauucaaacugaaagagguagauucaaauuuugagugugauacugaaggagaaagcggaauauaguacaugcauaaauuuaugcuauggagaaauauuucuacacuuugggaggcugaggggggcagaucacuugaggucaggcgugcaagaccagccuggccaaugugauaaaauccugucucuacuaaaaauacaaaaauuagccaggcaugguggcgggugccuguaaucccagcuaccugggaggcugaggcaggugaaucacuugaaccugggagauggagguuacagugagcugagaucgcgccacugcacuccagcccgggagacagagcgagacuccgucuaaaacaagacaaaacaaaacaaaaaagaaauauuucuaaauauuuaaaguaguauuuaauauuuucccucagcuguacaaaauucaugaugcuuuuacaacugugacauccuaaaaucuuggaaauaugucauauugaaguccuaagagcaucuagaaaauuauaccucccucugggagaauaugcaaaccacuuucugauaacuacauuagcaguccaauguaaccaaguaauuacuucacauaauagaaacagagcugcauccuucugaaaacacaauguaaaugugccuagggauuacacgugcauccgaucugugcagacugaaucccauuuuaaaugcacuaacaaaacuugcucuuaaagcgacucuguuucaguuucuucuauaauuacucucccauuuacugacuucucaaaugcagccuuuggaauuugcauuuucuuucuuuuuuuuuuuuugagacagagucuugcuguguugcccaggcuggagugcaguggugugaucuuggcucacugcaaccucugccucccggauucaagugauucuccugccucagccucucuaguagcugggauuauaggcacaugccaucaugccuagcuaauuuuuguauuuuuaguaaagaagagguuucgccauguuggccaggcuugucuugaacuccugaccucaagugauccgcccaccucggccucucaaagugcugggauuacaggugugagccaccgcgccuggccuugcauuuucuaauagcaaggcaaagucagaguugugcagguuuaggcacuauaaauucauuaaacaaauguugcuaauggauguucuguguucuaggcacugcuguagguccuggaauagugcacggaaccaggcggaugaagaacgacggugugcgugcaugggugcguguguguucuauauaauguuugagacaaugaggucaguggccacccucugauagaccugaggagagugagggagccggccauacagcugucuaguggggagagugguccgaaggggagaaacaaguacaaaggccuaaggcaggagggaguauuacgugcaaagaacaggaguccaguacaugaguuaggggaaguagacaaguagagggagauuaaguuagaauggggcacguaugugcauguaugcuugguguggggguguguguguagcgcgugguguguguguguguaguauguggaguguacgugagaugcagggccuuguagaccauggucagaggcuuuggauuuuacucugugugagaagggaaaucacugggggaucuuagggauagauaugguggaaagacugugugugugugugugugugugugugugugugugugugugugugugugucagagacagagaaagacagagagagacagagagagacagagagaagagagggacaggguuucacucuaucacccaggcuggagugcaguggcaugaucacgacucacugcagccucuaacucgugggcucagacaagccucccaccucggccuccaaagugauaggauuaccugugcuugccacugugcccagccagaaugauuucuuuuccacuguuucuauguuucaaccccaagcagugacaaucagcaaaaacaggagagucaaugucaacguuuuucacuauucacuaauuuucccuuucucuacucauauaaggcuugugacauucaagauuugaccuccuucacugaaauauuuacaguuaaaaaacaaacacaaaaccaccaaauuucuuucuagucaucaacuuccuaggaaacaauuagaaacauuuuccuccggauaacuucugcgguaccuuuaccaugggguaauuuuuuuuuucagaucaacuuccagcuuuuauuuauugauuuauugauuuuuauuaacuuuuauuuuagguuuggggguacauaugaaggucuguuacaggagguuugcuguacagauuauuucaucacccaugcauuaagcccaccacccaacaguuaucuuuucacacacgguaauucucacuucacucauuuaugccacucgcgcaaaaagcaguucuuuauaucucaaacaguucuuuucucagaagucugcaaaacauuacagaaggaauguuuuaccuuuuuaaaauuaauccuuaucaucaccccuauaaauacuuaacauauaaauguaugucccaacuacuuccaaaaagauuuauaagacaucgaauccacugggccagcagauggagagagcgauccaaccccugaugauucuuucuucuaugacauuagucuuaccaggcaagaagugaguguuaaaauugcuuacuucagaguaaaaaaauucugggaagaucaaugagaaagggggaaggauaaaguacuauuucuuugcugacugcucaaaguaacaagguuuuggcuggacgcaguggcucacgccuguaaucccagcaauuugggaggccgaggugggcggaccaccugaggucagaaguuugagacucugggaggccgaggugggcagaucaccugagguguggaguuugagaccacucuggccaacauggugaaauccugucucugcuaaaaauacaaaaauuagccaggugugguggcaugcaccuguaaucccagcuacuugggaggcugaggcacgagaauugcuuaaacccaggagguggagguugcagugagccgagaucgcuccacugcacuccagcuugggugacaaagcaagacuccgucucaaaaaaaaaaaaguaacaagguuuuuugcuagcucaucuuggcucugacccuacuuagaagaacccuaaguucuucuacuuguuuacauaguuaugucauguauuuuuacccaugcuuuggcauucuuuuuuauaucaacuaagaaccuauaagcugccaaaaucuggaugaucacaguucacuguaacggccaacaagggacauaucaacugacugggauggcauuuuguaauuaaggagugaaaugcuggcacuucccugccaaaggaaccgaguagaugcacagacucucggcagcaaaaacaguaguaaggaacaagaacaaacaagaccuauuugggcagaaauggaaaaguggguggcagcacggugcgguggugaacaugagucuggauucaggaugcucaagucugaaugcauuucuaugauuuugacccucuugucuguccccccggcccccccguucccccugccacuuccucacagcaggcuacagcgaggaguaaaggggcugauacauggacagagcugacaccacaucuggcgcacaaugcuccaugaguauuugcagcuauuuuuauacacuugguacauuuuauuccuccuaguagggagagaauuuagaucugaggcaaggcugggguguuagaaguccagaaagagagguauuaguaaaagcagcacacaaucugauacgguuguuagagaaagucacaacuaaauaggccagggagagagaauuucucccacagaaaauuuacaguaaaacagguaacacagcacuuuuaccauguggaaacugguuccuaggaaggaugccugcuuuauuacuauaaucaugcaauaggauuuuaucuacgugaaaaagacacuuucaccuuugggaaauuuacuugagaaauggugauaaaauguucagcguaauacaaauaucaaccuuccugaaucaauauucaaccuugcaucaacauuccucugucucuuuacguauucucuaaugauucuucugaacaccaucgaauugaaugaaguguaccuaacuccuacugcagucucuauuuauagccuggaguuauuuuugaacagugcugggcacaaacaccaacucaguccacaggaaacuucaauuuaagagcaaaauuguaagacaaugagucagaggauuagaaagaaggugcuauuauauucucuugcucaaagucaccuacacaacccaaguagugcuuuucacucgguuuccagggguaaacauucagcaacauccggaacuauguuucagccucugcggucauuucaaaggcucuuuaaacaaauggggucuggcuucacugagguccaggaggugcuaagagaaauuuaaggcuagacaugaaagcaaagucacaguuaugcagaugguaugaccucauauguucuucgauggauugcccagacugagcucaaugggggugaacaggggggcgguggaggcugggagggggugggaagggagcacgcacgcacacacacacacacacacaccucccccaaaucccagccccucucccguuacuaaauagcagcaauucaugcaacuguacuuaagaaaacaugccucagagaguacaaguugucacaucugguaguucacaauaacauucucgcaauagauaaaugaagggucccucauuuuagaucuaaagguggauaaacuugaugacugaucuuuaaucuguuuucaugcuuuugaaaaaugauuauacauaaaguuuuccuccaaacuugccaggcgacaacucugaaaauucuggggccagacacagugacucacuccuguaaucccaacauuuugggaggccaagacgggcagaucacuugaggucaggaguucgagaccagccuggccaaccuggcaaaacccugucucuacuaaaaauacaaaaauuagccgggcaugguggcgggugccuguaaucccagcuacuugggagucugaggcaggagaaucacuugaacccaggaggaggaaguugccgugagccgagauugcgccauugcacuccggccugggcaacaagagcagaacucugccucaaaaaaaaaaaaaaaaaagaaagaaagaaagaaaaaaagaaaauucuccuaugugcuacuuuaucccaugagaaggucugaacacaucaauauacucuggagcccaccucauuugacccuauccugccuggauucaaagcacgccccuuguuagagcuuauagaaguuaguuccuaagcaucuacgcacaugcagggguaagacuccauuccucugauaccuggacccaaacuggacacaagaaaaaucaucaccaccaccaccaccuucaucaucaccaucaccaucaucaucaucuucuucuucaucuucuucaucacuacuguccccagaaagugcgaggaagaggaaggagaaaggauugucguacauacuaccacaacaaaagcaaaaaaggccaucagagaacaaagaaaaaacaagacggggagaagcuuuugcaacugcuguccuuuuaaauaaaccauacacuaaaacuuuuggccacugacaugcagaaacauaauucaccuaaauuauagaaacacauacagguacauuugagagaaggggccacuggauuaguggaauucugauacugcuuccuucuaagagacugaacuuacauauaacuaaaacucaacacgucaggacaugaaccgacccaccccacucaccagaaguaaaaaacaccaggcccagauuugcucccacaccugcuuggucugauagcauuucaacuaccacuggcaacaggacaaaaggccaaaaaggguuccugugugccccaacucucaaagggaagaaagggauucacaauagaauagagcaacccaaacuuuccagcaugauuagagccuggcagaagcauggacucagaguacgugccuaccaaacuaguuagccacacagguuaauaacccaaaacaacaauuuaacagagucagugucacacagcacuucuuccaaaccguguuaaucuccuuucccugcaccgcaaacacacaugcaacucuccugugggauaaauaccuaggagagauccucagggaggaggggcgucugcucguggcacugggugaggcgggugguagggguggacccgugcugcugggccucugucuggaacugcuggcgggcacugcuugggggcuacuggcgagggcagggggacuuggggagcucgacagaauggagacgccugaggacgcccaugggugagugacaguguaggggcgauaccgcggggaugaaggcuggcuucccgcagcaguuccagaggcugcacugugaggacugaggggaguggaaggcacagccaacuggcuggcugcacgggaaggugaggcaagagacgggcccaucacgggaacagagcuccagaaacugggagugggagccggacuacuuucauagaggcuaaauuaguugagaaagggaggaaagaagagaaaaaucaaagaaaaacuugagauaacuaacuaaaacagaaaauaucaagcuuuuaaaggagaaucauuucaguucaaguauaucuagcagauaaacaucuaaauaauuauaaucuaauugcccuauugaucuagaggcuauacuuacaagacgauaaaguccccauucgaagaaugauguaguauacacagccaacugcuucuaaaauuucaucuagcaauaucuuaaccauagagagccaaaaaauaauaaucuagaaaagagaauuccacuuccaaugacuaaauccaccuccccaaauaugauauaugccauacccuguaugacacugauuaacacugucaacaaacauucccuucuccuacguaguucacaguuauuuuacuaccaguaagaugugcaaagagaaccacacugaccuagacaaagagcuggcaccaaaggaagccacgcugcagaacauggggcuuguuccuggauuggagccaguguuuagcaagagauuucugucuggugaccgugcugcugcagcaauuggcugugauguggcugucagacuggcaaauggguuuucaucucuggucugaguggacaucauuagcacuuccauuaaaaucuggccaaucaaguccuuaaaaucggagaauacuguuggaaaggcagaacaaagaacagguuacacacaguucgaacacagguuacacagcccuugaauaagccagcugaccccaaaugguucgaugcaguauccuggauuagauucuggaaugguaaaaggauauuaguggaaaaccuaaauaaagccuuguguuuaguuaguaguaauuucuuaguuuugacaaauguaccaugguuauauaagauauuaacgucaggggaaacuggguaaaguauauauaggaacucccugcacuaacugaaacuauuccaaaauuaaaaguuuauuaaaaagaaaguugggguacagucauugagaguuaccgcugauguauauuaauuguaaaaagaagcuacucccaacuauagagguuacuuuauuauacuacaaaugcaacuggguuaauauuucuuagucuagauauguuuuauagauaguaauaaaacuauuaaguccaagguucaaaagauuuuaugaaggguccaacaucuagucaccauguggcuuucaggagcaaaugcuacauucuagcuuccuucuuauucuuugcagcucccaguugauuuacuguuggucuuuagauacauuuuaaauaccacuaaacaaaaguuuuaacucauggaaauuuuaucugauuugguuauuuaaaauugccacuuacauguguaagacagaguugccacuuaacauguguaagacacuuguuuuaacaaaaguuuuaacucauggaaauuuuaucugauuugguuauuuaaaauugccacuuacauguguaagacagauuugccacuuacauguguaagacagagaaucuuaagauuuauaauaagaauaacaaguagcagaguuucaaauacauggucugcuccauuagcagaguuaauaaguaaaaucagaaauagucuuaucuauccuccagaaauacaaaggacuuuuuuuuucccuccucagaagauaggcagcauagaaaagagaaaggugaucuccuugauauucacgcauccauuuaaaaucuaucuauugagggacuauuuugugcaagauauccuucuagggauacaucaaugaguaaaacagacaaaaaucccuaccaugagggaaguuacauuccagugauaggccaaaaaaaccacuccagcacaccucccauaccucuucugcguuccaaaugacuacuguaaagaaaaaggauagugcccuaugaugcugauaucuugcuaagaguuuuauuauuuuguuacaagcuuggccucuuaaaguggaauaucagaaacacagcaaaaugucauuauguucuaucuugcuaagcaauuuaaccaaauagaccaauuccaccgucuauacauggcuucauaggcacuuaaagcagguauagcucauacagaacacuucucucaggaucccuggagaccacccacuauaucuauacuucauaagaggagguaaggccaggcucgguggcucaagccuguaaucccagcacuuugggaggccgaggcaggcagaucacgaggucaagagaucgagaccauccuggccaacauggugaaauccugucucuacuaaaacuacaaaaaugaggccaggcacgguggcucaugccuguaaucccagcacuuugggaggccaaggcgggcggaucacgagaucaggagaucgagaccguccuggccaacauggugaaacccugucucuacuaaaaauacaagaauuagcugggugugguggcgcaugccuguaaucccaacucgggaggcugaggcuggagaauugcuugaacccaggaggugggaguugcagugagccaagacugcgccacugcacuccagccuggugccagagcaagacucugucucaaaaaaaaaaaaaaaaacaaaaacaaaacaaacaaaaaaaacuacaaaaauuagcugggcgugguggugcacgccuguagucccagcuacuccaguggccgaggcagaagaaucacuugaacucgggaggcagaaguugcagucagcugagaucaugccacugcacuccagccuggugauagggugagauuccaucucaaaauaaauaaauaaauaaauaaauaaauaaauaaauaaauaaauaaauaaagaggagguaaugcucuaagcaccuucuuacuacaaagagaaaaacuucaacccugagaaaauggagaccauuaaccuauuuacauaguauuauagaaaucauggaaaugaaaaauaaguuaucgauaagaucaguggaaagggaagaaaguggcuaaacaauuguguccucaucaagaaguaucccugucaucaaaaauacaacccaagagcaagauggagugaauguggauaacagagggcaaagaucucacaucuuauuuucuugucgaguacucugcaguaagacugcugagcuagauuccuaccuucuuuuggguucugcuuaaacugugcagaaagagaagaaagaaagaugacaucucugucccgguccuuccaagagacacggaagaucuuacagaccagcuguaaggccugcucuucagacacuucagggcccgaggaaggcuccuggugaagaagaagauuugcagguuaauuucaaauaagagguaugaguuagguguuucaauaggaauacguuauucugauuuaauucauuauuagugaugauauuuuaaaaaugcaugaaaccauucacccacugauuaggggaaaaguaagccuauuccuauaacaucaaaguuacaacaucuaagucucaugagcuuacaauacaaucuauggggagcauaaaagagcaaagauggccgggcgugguggcucacaccuguaaucccagcauucuggaaggccgaggccaguggaucaccugaggucaggagcucaagaccagccuggccaacauggugaaacccugucucuacuaaaaauacaaaaauuagccaggcgcgguugcgggccuggcuacucggagcuacuugggaggcugaggcaggagaaucgcuugaacccaggaggcggagguuguggugaaccaagaucacgccauugcacuccagccugggcaacagagugaggcccugucucaaaaaaaaaaaaaaaaaaaaaaaaaaaaaaaaaaaaagagcaaagucauuaucaaaagucaccaaggaaaaauaugugacagaggauguacauauccuaucuauuuacuuuucugaauuccauaggaccagguuaacacuccaggugcaugaccaauuuuccuccaggaauuuuucaaaauuguaacauuucucauuacauaccaccacagauaaaacagcauauaaaaaagaauuuuguaaacauuaaagaacuauacaaaauaaagcacugcaccacuaggaggcuacagugcaacuucuuauuuuuuccuuuguuugucuuuauuuuuguuuacagugcaacuuccaauaaucauuaacauguguugcuaaaggauuccuaauaauuuacuaaacagaaagugauguaauuaucuauauuaauacacacacacacacacacacacacacccuaaaugcagagcacuaagcucaggugauauucaaauauaaaggcuucauguuuuccaaaaccuucuacuugcgacuagauucuacauauucuugcuucaauucccagucauuuuccucagaauacugcuaaagaugugaugaucuacuugcuuaaaagcaaaagaccaggccaggcgcaguggcucacgccuguaaucccacacuuugggaagccaaggcagguggaucauaaggucaauagaucaagaccauccuggcuaacacggugaaaacccaucucuacuaaaaauacaaaaaauuagcugggcgugguggcgggcgccuguagucccagcuacuugggaagcugaggcaggagaauggugugaaccugggaggcggagcuugcagugagccgagaucgcaccacugcacuccagccugggcgacagagcgagacucugucucaaaaaaaaaaaaaaaaaaaaaaaaaaaagcaaaagaccaacagaaagaauucuaauuugcucuaaauuaguuccuauuacaaccuaaauuuacugauaaaaucauggcccugaaccaaaaacagauggauauuaucagaucaaaggacugaguuacacuuucaugaauaaggguaaucuagguuauucauuuuuccucaaaagaauaaaaauaaucaccugccuaggacuuccugauuucggguggccccaaucuaacagacucuacagauacaagacaugaaauguguuuauuucuauuaccuguaccaagggcuucaucgcuuaccaaccuuaucacugaggcuccgcuuuucucuucgaucauuuucaucaaccuccauguuuucaauuccugaauccacauccaccugggacaugcuuaaaguacaaaagacaaacaagccuuuuaccuuuuauaaauccgcacaaugucacuguagcugcugggugagaaaauguuuuaaaauaucaguuaaucaggaaaggaaaaugauaaugguccaucuuuuuucuuauuaauuuuuaagaguucuucauaaauuaggaucuaaacaauuugucucuuauacauguuggaaauauuuuuccuaaguugucauuuucuugggcuuacuuuuuaaaaguauaucauuggccgagugcaguggcucacgccuguaaucccagcacuuugggaggccaaggcagguggaucaccugaggucaggaguucgagaucagccugaccaacauggagaaaccccaucucuacuaaaaauauaaaauuagucaggcgugguggcacaugccuguaaucccagcuacucggcaggcugaugcagcagaaucacuugaacucaggacacagagguugcgguaagccgagaucgcaccauugcacuccagccugggcaacaagagcgaaacuccgucucaaauaaauaaauaaauaaaaguauaucauuaaaguagguuaccuauauauaguauuuuaaaaugacauaaaauucaaccaggccagguauauuggcaugcgccuaugguccgagcuaccuaggaggcugaagcuggaggaucacuuuagcccagaaguuugaggcuguaugcacuauuacugugccugugaauaaccacuguaucccagccugggcagcauagcaagacucuggcucuaaaaaaaauuaaauaaacauuuuuaaaaauuuaauugagaaaauaggccaggcacgauggcucacaccuguaaucccagcacuuugggaggccgaggugggcggaucacaaggucaggaaaucgagaccauccuggcuaacauggugaaacccgucucuacuaaaaaauacaaaaaauuagccgggcaugguggugggcaccuguaggcccagcuacucaggaggccgaggcgggagaauggccugaacccgggaggcagagcucgcagugagccaagacugcgccacugcacuccagccugggcgacagagcgagacuccaucucaaaaaaauaaaaaauaaaaauaaaaaauuuaauuaagaaaauaaaaaacucaacugaagucuuauuauaaaaacugguuaaguacauaucauuuauccccgauugaacaauugcccuagcaccauuuacuggaaagaucauccuuuuuacauuaauaugaaagcuccuaugucacguguccaauuuucauuaacgagugggucuauuucuggagacucauuacuguucuguuagacaauuugucugucccuggccaauaccacuuugucuuaauuacuaaaacuucacaaaucuugauaucugcuaggucaaugucuccacuuuauucuucuccuuuaagagguuuugcuauccuuggcucuuuccucuucuacacauacuuaggaaucagccugaggaauuccuuaaaaacccucccgggauuuugaccaaaauuuuuuucacucuuagagaucaacuuggggagaaguaauauauuacugaguuuucauuacucuccaaguauuaagaucuucuuuaaggucuaucaauaagcuuuaguaauuuucucuauaaaaauuuuauacuucuuuugcuaaauuuauuccuagguaccauauguuaauacuuuuuaaugaaauugugaauggcaccuuuuuaaaaauuacguuuucuaacuuuuuguugcuggcagacaggaaugcaacugauuuuaaauauacacuucuuauaagcaacuuauuuauuuauacauagaaaguuuacauguaaauaauuuuuucuuuuuuagacagagucuugcucugucacccaggcuguagugcaguggugcaaucuuggcucacugcaaccccugccucccagguucaagcaauucuccugccucagccucccaaauaacugggauuacaggcacgcaccaccaugcccggcuaauuuuuuuuguauuuuuaguggaaacaggguuuuaccauguuggcuaggcuugucucgaacuccugaccucaagugaucugucugcuucggccucccaaaagugcugggauuacaggugugagccacugugcccagccaacauguaaauaauuuaucugcaaauuauuacuguuguuucuuccauuccaauccuuacuuguuuuacugcacugcuaaauacaagaagaaauagcagucauccuuguucuuauugcugauuuuacagaaaaugaugcuaacuucucaccacugaauaggagaguugcuguaguuuuuugguagaugcccuuuauauuaguuagaguaagacaggcuauacuguaguaacacauacacucugaaaucuuaagaggcuuaacacuguaaggauuuaguucuugcuuacacaaagucugaugagagugaagcauccuuacuccaucuuuaaucuaugccaucugcaauacacagccuccaaggucacuggagcaagagaagagagggacggaggaggaacauuggcucaacugccuucaucuaaaagugacacgucacucuaguucauagucuacaggacagaacuagucauuggccccaaucuaacuguaaaagagaaugggaaauucuggggagccuguggaauauuuggugaacuuugucugugccacacugugaguuuaaagauacuccuuucuguuccucauuuucuuauuaccaugaauuaauguggaauuuuaucaaacucuugcagcuaccaacauuauaaggauuuucuuuuuaacaugcaauaugguagaugauauuuauagauuuucuaauaucaaugcauccuugcauuccuaaaguaagccuaaauugaucaugauauacuauauuuauauuauauuguauuauuuuaaagcaaacuuaauugaaauauaagacgccuguaaucccagcacuuugcgaggcugaggcggguggaucacuugaagucaggaguuuuaggccagccuggccaauauggugaaaccccaucucaacuaaaaauucaaaaauuagccaugcgugguggcccaugucuguaaucccagcuacucgggaggcugaggcaggagaauugcuugaacccaggaggcggagguugcagugagccgagauugugccacggcauuccaguaugggagacagagugagacuccgucuccaaaaaaaauaaggacaaaugcuugaggaaauggacacccaauuuuccaugauguguuuauuuauuuauuacuuuuuuugagacaaagucucacucuguugcccaagcuggagugcagcggugcgaucucaggucacagcaaccuccaccucccaaguucaagcgacucuccugccucagccuccaaaguagcugggacuacagguacaugccaccaugccccgcuaauuuuuguauuuuuaguagauacgggguuucaacauguuggccaggcuggucucgaacuccugaccucaagugaacaccugcgucggccucccaaagugaugggauuacaggcguaagccacugcuccuggccugauuuuuuaaaauaauaucuuucaaaugcuccuggccugauuuuuuaaaauaauaucuuucaaaccaguagagaaaaaaauguggaauaagagugagcagaaggaaaucucuccaacucucuauucucccuuuuugauguuuagauauauccuggaccccuguugucuuuuuuuucuuuuuuaaagcugaacaucugcauucacuacaauuuuaauuuucuacccagaaauuucaauccuagauacauuucaggagaaaccaaggacucuguccucuguaucucuaaauaucuuuuauauuuuucaucugcuuuguucuuugugguacguucuggguaauuuccucagcucuuucaguuugucaauucuuucuucagcuaugucuaaccccuauuuaacucuuacagcaaguucucaauguaaauuaccuuuucauuucuagauauucuauuugguuauuauuauuauuauuauuuuuuuuuuuuuuuugaugcagagucuuacucugucacccaggcuggagggcaguggugugaucucaguucacuguagccuacaccucccagguucaagugauucuccugccuuagccucccaaguagcugguacuacaggcaugcaacaccacacccagcuaauuuuuguauuuuuaguagagacggaguuucacgauguuggacagguuggucuugaacuccuggccucaagugauccaugucucuguuucccaaagugcugggauuacaggcgugagccaccacgcccagccccuuauucauauuuuuaauucuccuuuuucuuuuuuugagauggagucucacucuaucggccaggcuggagugcaguggcacaaucuugguucacugcaaccuccaccuccuggguucaagugauucuccugccucagccuccccaguagcugagauuacaggcgccugccaccaggcccagcuaaguuuuuguauuuuuaguagcaacaggguuuccagguuggucuugaacuucugaccucaagugauccaccugccucggccucccaaagugcuaggauuacaggcaugagccaucgagcccggacuuaauuccccucuucaucuguuuagcccacugacacaaaccgaggccacugcuugaggggagaggagccagguccaaggagucugacuugcucaaccaugaaaggagucaauaccucagccacucuuaccacccauuuuuggcacauaugcaacacaggagggcucuuucaagacaccuugauccguacgaagcaaauaggguauuuauuuggcuuaccuguaugaaauauuccaaacuuuuaaauuucacuaauuaguaaaaguuuuagggagaggcauaugcuugccaacuuuauauuuacaaaaugagaacaauagauuuuuuuuaacugacuacaccauuauuucauaaaagacauuuaauaugcaaguauagugggccacgcacaguggcucauaccuguaaucccaguccuuugggaggccaaggcaggaagaucucuugaggccaggaguuugagaccagccuggccaacagcugaaacccugucucuacuaaaaauacaaaaauuagccaggcaugguggcacacaccuguaaucccagcuacucagguggcugaggcaggagaaucacuugaaccugggaggcggaaauugcagugagccaugaucgcaccacugcacuccagccugggcgacagagugaaacucugucucaacagcaacaaaaguaugaagaauauuucugaauaauacaaaaucuuuaaauuuaauacauuugacacuaauuugcuaaggacuggcaugggucucuagcuggcauuucugacuauggacuagaggcuaaagugaauggaucuuucucuuucccuaaauaaaagagcauauuagaaaacuggcuucauuuuaccuuuucucacaugagacaccaucgauauccaugcucugggaacgugagagagacugagauugcguuucaaggcuauuagagggcgagcugcugagagaacugacuccuucacugcucuggcuucgaugggcuacuccuaaacagaaaacacaggaaggaugaagccccaugugaaauaauguucaaguuauuuguaauagcgacaguaaacacgcacaaucugcagucacccaucaugacauugcagcaaccgaggaauuucuaucagaagauuauauaaaaagcuggaaacaauaauaaaaucauaggaacauuacuaagaaaucauaaguuaucaauauacuucauaugaggucaguaacagagcuacaucuaaugccuaaaacucaccccucaucaccucucuugcaccaauucaaacuauggcccacaaauacaaauuagaaauacaaauuaacuuccaugauaguccagaaaaauccuugaaaugcgcccaaaagaagauauauuaauaaaccaggccgaugcaguggcucaugccuggaaucccagcacuuugggaggccaaggcagguggaccaccugagguuuggaguucaagauuagccuggccaacauggugaaaccucaugucuauuaaaaauacaaaaauuagcugggcaccuguaaucccagcuacucaggaagcugaggcaggagaauccuuugaaucugggaggaagacguugcagugagccaagaucacaccaccgcacuccagccuaggugacagagcgagacuccaucucaaaaacaauaaaaggauauauuaauaaaccuauagaaaaauaugugauaaagcgaguauaauaaaauguuaaugaggcugggugugguggcucacaccuguaaucccaccauuuugggaggucgaggcgggugaaucacaaggucaggagauugagaccauccuggcuaacauggugaaaccccgucucuacuaaaaauacaaaaaaauuagcugggcgugguggcgggcgccuguagucccagcuacucaggaggcugaggcaggagaauugcuugaacccgggaggcggagguugcagugagccaagauugcgccauugcacuccagccugggcaacagagcaagacuccgucuaaaaaaaaaaaaaaaaaguuaaugauagaaucuagauggugaguauacggguguucccugcaaaauucucucaacuuuacuguauguuuacaauuuuuauaguaaaauauugaaaaaaaaauucaaguggacucaacaauguccuuugauauagaucgauccauuuauugauugaacaccuuaguggaaauuaaaaaccugacacuuuguugcccucacagagcugacaguacagugaaacuguagucacuaguacagggacagaugauuucucacagcaauuucccaucaaugucuuuaaaaucauguuuuacauugaaauuuuaaaaauuacuuuaacucuaugaauaucuuccuaugaaaaaagaagaauguuuacccaggcauuugcaaauacuuuaaaauauauauaccuauggugcugaaaaggaaaaugacacauguuuaaaaaaaccauuggcugggcacgauggcucacgccuguaaucucagcacuuugaggggccgaggaaggcagaucauuugaggucaggaguucgagaccagcauggccaauguggugaaacccuguuucuaguuaaaauacaaaaauuagcugggcgugguggcccacuccuauaaucccagcuacuugggagguucaggcaggagaaucgcauuaacuugggaggcggagguugcagugagccaagaucgccccacugcccugcagccugggugacagagcaagacuccgucucaaaaaaaaaagaaaaaaaaaaguaugaaaaaagaaaacagagaaacuugaguuacccguuguagugaaaacaaucacugaauaaauacaauuuuaacccuuccagcauucuaugacaguaaacuugccacuuuuuaauguuucucuucauugaagaauauuauaaaacauuuauccauuccugaaagcaguucuucacauguacuaauuuauuaaaacuucugcaggauuuaugaaggaaauaagaaacuaaauuuucucucuuccuaggacucaaguaaaauacacaaagcaucuaccguagugagaauucugaaacaaguucacagaauacaguaaaacuuuugauucauuaauuucaggaaauauaacccaaaguaagcccugaaaaaauacuuauugaaggaauaaauaauacaccaucacaagguucuuaggagaauauuauuuuaccuaucacaauuaaaggccaaguaacuuuuuaguuaaaauuaaucaauaauaaacuucaaugaucauuaugguaguaaauaagcaggcuuuaaaauuucuacccuacaaaacaaguuauaaaauuaaacacauaauuacaaauuguuuuaaaaacuguaucuguaguauaguauaguauguguacaauaauacuguagcaauauagcuccaguguauaucacauaguguaacauacugcauuuguaauauuuuuauaaggcaucaaagagaucaucugaauucauuuuuuccugcaucuuccacaugaucuucacauuucggaucaaguggggcaauucugcaacaauuuauuauguauacaagugcuccucaaucucuaaacaccaggggacuccauuccuucuuuucuuuucuuucuucuuuuuuuuuuuugagauagaguuucacucuuauugcccaggcuggggugcaauggcacgaucucggcucaaagcaaccuccaucucccagguucaagcaacucucuugccucagccucccgaguagcuaggauuacaggcaugcgccaccaugcccagcuaauuuuuguacuuuuaguagagaugggguuuaaccauguuugucaggcuggucuugaacuccugaccucaggugauucaccugccucagucucccaaaguguuaggauuacaggcauaagccacggugccuggccuccuuauuuuaagaaaugggucucagccaggcacaguggcucacgccuguaaucccagcacuuugggagcugaggcgggcggaucaugaggucaggaguucgagaccagccuggccaauauggugaaacucugucucuacuaaaaauacaaacauuagcugggcguggcggcaugcaccuguagucccagcuacucgggaaucugaggcagaagaaucgcuuuaaccugggaggcggagguugcagugagccaagaucgugccacggcacuccggccugggugacagagcaagauucugucucaaaaacaaaacaaaacaaaagagaugggucucacuauguuggccagggcuggagugcaggggugugauccuagggcacuguagccucaaccuucugggcucaagggauccuccugccucagcuucugaguagcugaaacaaagaacauaugccaccauaacccauuucucuccuuucuuaaauuuaaaauacugauggucagucgugccucacaucuguaaucccagcacuuuuggggagucaaggagagaggaucacuugaggccaggaguuugagaccagccugggcaacacagagacccugucucuacaaaauacuuaaaaaauuagucagguaguccgggcgcaguggcucacaccuguaaucucagcacuuuugagaggccaagacggguggaucacuugaggucaggaguuagagaccagccugaccaacauagugaaacccuguuucuacuaaaauacaaaaauuagccuggcgcagaggcgggagccuguaaucccagcuacuagggaggcugagucagaagaaucguuugaacccaggugguggaaguugcagugggccaagaucgcaccacugcacugcggccugggugacacagcaauacuccaucuuaaaaaaaaaauaaaaauuaggcaugguggcaugcaccuguaaucuuagcuacuugagagggugagguggaaggauugcuugagcccaggaauuagaagcugcagugggcuauaaucauaccacugcacuccagcaugggcaacagaugggucuuuuuuaagacccugugucaaaaaaaaaaggacacacacaaaaaccugauggugucuuugauuuuauuuagaaaucaaugugaauuaaauauugcgacuaaaaacacaucaaaucaauaguacaaaauaucacuguuuucaaaccucacacacucccuugucuucaugcccucucccaccccaaacuugaggaaucauggucaggaagccaagucucaaggaauacagguuuuuucuuccuucaucuucacaaagccagauauuaaagaauuaaaaaaugaacauaaucugcuguaacccucuuuuagaagaugaauaaacuccccacauaucaacuauagaacaaaccuuccacaagugagguguguaacacagaauggagaaagcuaugucugcuucaggaaacaggaauuagcaaccuucuaggcggcaguauccaacuucuauaacugagaagaguuugcuaaaggaaauuaugcauucuaugugggaagaucagaacaucaaaggacauaaaaauuucaugucuguaagacuuucuccuaguauuguaauauuuccugaaugauguucccuuucaaguacaaacuagaccaaauaucuaccuuuaacuuguaacauuaggccuguuccaguauuacacacacacacacacacacacacacacacacacacacaaaugcauaggcuucuaaauuccaccguaaaaagagcacagaauugucaaaagcguccuugaaaccucaauaaaaggucaagugugguggcucauaccuguucuuccaacagauugggcggucgaggcaagaggaucgcuugaucaagaccagcuuaaacaacauagugagacaucaucucuacaacauauuuuuuaaaaaaccaaaacgccucaauaaaucuguuuuguugggggcauuggucuuaaagguaauggccaaccaucuucccuccucuuuuacagauaagaauaucuaggucuacagagucuaaaaacuucccuuaggaccuccucgccuguuagaaacagagcaaagaguaaaacacaggucucagccaggcaugguggcucacgccuauaauuccagaacuuuuggaggccaagguggaguagaucgcuucaguccaggaauucaagaccagccugcgugacacagggagaccccgucucuaugaaaaauacaaaaaugagccaagcgugaugguaugcgccuguagucccaccuacucaggaagcugaggggggugggucaccugagcccaggaggcugaggcugcagugagccacaauggcaccucugcacuucggccugggcaacaaagugaaaccaugccuaaaaaaaaaaacacacacacacacaggcugccugauuccuaacauaaugcuguaauuccuuuaccccagacugcugaacaguccuuuggaucaaauauuuuaaaacaaaguuaccuauuuuauacacucaaaaauuacaaaagcaaccaggcaugguggcucaugccuguaaucccagcacuuugggaggccgaggugggcggaucaaggaguucgagaccagccuggccaccauggugaaacccugucucuacuaaaaauacaaaaaaaaauuagccagacaugcuggugcacgccuguaaucccagcuacucaggaggcugaggcaggagaauugcuugaaccuugcaggcagagguugcagugagccgagauugagccacugcccuccaggauggaagacagagugagacuccgucucaaaaaaaaaaaaaaaauuacaaaaguaaaacuuaaaaauaauuagguuuauaaaaggagucauuaauucuauuaaucaaaauccuaaagcuuauuuauauagcucuugacaaugaauuaagcuaaagcguuaauauucacggaaaauacaaaguauacuugcacuuuauuugguuaacaccaagucucaccccugaaaacuuuuuuuuuuuuuucagagacauguucucagugauaccugggcugcgguacaguggcaagaugauaguucaaggcagccuggaacuugggcucaaaugauccuccugcuucagacuucugccucaaugcugauuauaauaaacauauucuauuucauagagcagacugacauuuucuuagcagcuaauuuccugauaaaaacauuuuguucuuggcugagcacgguggcucaugccuguagucccagcacuuugggaggcuaaggugggcagauuacgaggucaagagaucgaaaccauccuggccaauauggugaaacccugucucuacuaaaaauacaaaaauuagcuggaugcaguggcacaugccugcaguuucagcuacuagggaggcugaggcagcagaaucacuggaaccugggaggcagagguugcagugagcugagaucgcgccacugcacuccagccugggccauagagcgagacuuuaucucaaaaaaagaaaacauuuuguucuugugacuaaacaaaaauaaagugggcugggugugguggcucacgccuguaaucccgacacauugagagguugaggugggaggaucgcuugagcccaggagguuaagaccaaccugggcaaaauagagagaccccaucucuacaaauaauaaaaaaauuaguugggcaugguggugcaagccuguagucccagcuacucaggaggcugagguaggaggaucacuugagcccagaggucaagcuugcagugagccaugauugcgucacugucccccagccugggugacagagggagaaccugucucaaaaauaauaauaaaauaauaaaauacggucaggcgugguggcucacaccuguaaucccaacacuuugggaggacaaggcagguggaucagcugaggaguucaagaccaaccuggccaacauggugaaaccccgucucuacuaaaaauacaaaaauuagcugggcaugguggcgggcaccugugaucccagcuacucaggaggcugaggcaggagaauuucuugaacccgggaggcggaaguugcagugagauugcgccacugcacgccagccugggcaacagagugagacuccaucucaaaaaaaaauaaaauaaauuuaaaaaacaaauaaaauaaaaugacauuucaagucugugaagaacaacaaugguaucuuaaauacugggauaagaaaaccaacagccggaauuagaaaaucacuuugaucuucauauuuacaagacagaauauuccucuccuuagugucaaaaggcagaaucaugcauagaaucauacaucuggagucaguagaccaggacugcuccuuggagaacuggcugauuucuagggcuggggcaggaaaaauccaagauaagucuagagcaucauacggugcuagaaagacagugcucaaaaauauaaaagaagaggcaugucaaauggaccaaggauccaacuugaaagagcucccauggucaaagcuggaauaauuccuguaaaauaaguaauguugcuacugaaaucauaacccaaaguauaaaauaaaugugugugaguucauacugaucuaagagauuaaauacauagcaggggagaagggacaaguuuuccucauagaauuccagauuacauauguacuuccccacuccaguaggugaaguuuaauucccaccccuuaagugugggauggacuuaggaacucgauaccaaagaacugaauauggaaagggaaaaauacuaaguuuaaguggagaaacacggccagcacuaacucaagcaugugaugauguuuaacagcaccagggacaucauguggauauuauauaccccugauacgaugugaugggaagggcacuucaccugugugacauaaucuuccccaaaacccacaaccccagucuuaucaugagcaaaacaccagacaaagccaaauuaagggacauucuacaaaguaaugacuaguauucuucaaaacugugaagaucaugaaaacagaacugagauacuguuguagaccaauggagacuaaggagacucauguuuaguuuagucaaaaucauauccaggcuaaucccuuaguuuugacaaaugaaccagacauuaacauuaggggagacuggaugaaggguacacaggaauccuguauacuaucuucauaacuuuucuguacauugaaaguuaguccaaaauaaauguucauuuuacaaagaaacuaggacuggaacccaguuccaucauuucuaguuuugugaucuuaagucuucuuacuuaauauuuuuaccuaugcucugguaauacuggcaucugugcagccuacuucauaguucuacuuugaggagccaaugaaaaaaaccaaugugaacguguuuacaaguucuauagauacaccuguaugcgucagacgagaacagaaugagaaaucagggcaaacuccacuguaaagaacagauuugccuuguuaccacaacaucugcucuggucuuguccacuuuuagcauaccuaaguacuaaaaaagagacggggaggccaggcgcgguggcucaagccuauaaucccagcacuuugggaggccgagaucaggaguuugacaccagccuggccaacauggugaaacccugugucuacuaaaauuacaaaaauuagccgggcgugguggcacaugccuauagucccagcuacuugggaggcugaggcacgagaauugcuugaaccugggaggcagaggcugcagugagaucaugccacugcacuccauccugggugacagugagacuacaucucaaaaaaaaaagagaaaagagagagggaaccuuaucccaccacuguugaaugacuuuucucucucaaccuaucauuucaaauaaucacacaaguguaauuccuauggauccacugacgcuucuauauugacauuacuuguuaaaaacaacucacaaugaacaaacaaauguaaauuauaauccaccuaacucuuguagcuaaaaaggauauaugcauauaacgggauuuugaguccccccauaccucauuuaucucuacauccaaggucacuuccucuccccugcaaccccucccugauaacuaagaauacauuucacagugcauauuuaauagucacugaacacuuugggaggccaaggcggguggaucaccugaggucaggaguucaacacaagccugaccaacauggcgaaacccugucucugcuaaaaaauacaaaaaauuggccaggcgcaguggcucaugccuguaaucccagcacuuugggaggccgaggcagauagaucacgaggucaggagaucgagaccauccuggcuaacacggugaaaccccaucucuacuaaaaauacaaaaaauuagccuggcgugguggcgggcgccuguagucccagcuacucgggaggcugaagcaggagaauggcgugaaccagggagguggagcuugcaguaagcggagauugugccacugcacuccagccugggagacagagcgagacucugucucaaaaaagaaauaaaaaauaaaaaauaaaaaaaauuagcugggcgugguggugggugccuguaaucccagcuacucaggaggcugaggcaggagaauugcuugaauccaggaggcagacguugcagugaggcaaaaucgcgccacuguacuccagccuggggaacagggcgagacucugucucaaagaaaaaaaaaagucacugaauacaggagggcuuugaggauauuuucugaauuuaugguggcugcaucaaaugcacgcuguuagugaacucuguacuuguucuuacuaccucaguuucucuguaaaaugauagaacugauguuaaaaaaaaaccuauaacccuuuacaguugcauuaaaguuauaaagauguguuguuguuuuuugaaaaccaugcugcauaguuuacaauaacaaauccaaauacuccauuaugcauccccuaucaaaacagugacaaaucuuaucaacaaaagagaaacugaaccacacaaccuuggcuggugaacaucuccugacccuucacaaaggcuuuccccucaggucaggguugaacuagucucuuucaucugccacauucagggagccucgggaagaugucacuugauuaaacagaaccgccugaagucaagaggccugaggccacgaggugacaagcuauuuucauucuuuaggaucacaauauuuccugucacuaggagaaggagaagggaacaaaggaguuuugcuucacuaaggauaggggauggguauggugacaggccaggguguggcucucaguccacuucaggggacgaauccugccaaaccugaccaauguccacuugcuggaggcuggcuagggcuuaauguuaaggcucuccagguaugaacguucaacucuagguguuaaaggugacaaauucuucugaauccaaagauuucaaaaucguaacuuuaucuuaaacuuacuucccuuggauuccaacuggaaacuggagagaggccggguacaguggcucaugccuguaauccuaacacucugggaggcugaggcagggggaucgcuaggccccaggagucugagaccagcaucaccaacauggugaaacccugucucaacuaaaaauacaaaaaaaaaaauuagccaggaaugguggcgggugcuuguaaucccagcuacucgggaggcuaaggcaguagaauugcuugaaccugggagguggaggcuacagugagccaagaucgcaccacugcacuccagccugggggacugagcaagacgacaucucaaaaaaaaaaagaaaaaaaagaaaagaaagaaagaaaaaaaggaaaacuaaagggagauggcgaagaaaacucccaguguagucccaaaucaaugcagucaacccuacuacuuccuggauaccuacuaugagcucaacagauagaaacacaagauaguuuuuuuuuucagagcuuucaaucuaguuuggaagaccagacaaaugcacccaaaacuaagagugguuuguguggcacgaucucuacugguuauaggccuuuuggggugaauauguugacugggacagcaacagggaacaugcucugaaaaucaagauagugaauuacaugaagaggguggaacaugaugauacagcaccuugcaagcccucggauuagauuauaauuggaaauaaggagacgaggaaggcuuucaagcaggugagugacauguauuaucucuccuacuaagccauaagauccuuaagggacaggaacacaugguauagaaaucacucucacacacaguauuugccccugugccuuugcuaggcuugggcacaugacaaaggccaugcaguaccguggcacaguucacaucccacuguguggggagagugcuacugggcaguuuggagucagaagcaggcaguugguaaaacuacaagcacagcagagguugcaggaccagguuagcaaaaauggggcagggggugggggcugcggauagggaaaagugcaagaaucaaccccaagucaaaacaggaaguguauugauucccagcacugcacacgucucaagaacaagauaucaugagcacuuuaaccagauucacaaaguaauuaguaugacccuaggaauaaugcuguaagauaaagcccagaacuaauaaaacauaccccuuugggggcccgaaggccaguccaauucgaggaaguacccaugccagcauaggacacaccuguuccaacucauaauuaaaaugaauaagcaaaaagcaaaggauuucaaccucuucuaggagccuccugaacucaguagccuuuuaggguuccugcugcagcccucaggccuuggggcuucugucugagccucugccucuagccagcugcuuaaccacccucgaauucuuucucccaagcucuggaccaaguagaagaggaaaaaaagaaaaaaggauuuuaauauagcaaucaaugauaggaccaaaguuagaauuucauugucauuguggauagcauucuuagccaaagacaacuuaccauaaaagaauggcuuugaucuuguugacauuccuacagauguacuaauaagcaaucauaauguucauuaaagacucaaaauuggagaaggaaaaugaggggaaauugaagaugacugcucuagcccugccuugcaucaaucacuggcaaguccauucuugccccaggaccuuugcaucuguuuuccuucugucugcaaagauugccccacagauauccacuugguuugcuuacucacuucauucaggccucugcuaaaaaugucacauucuucuagaaccagaaauaccauuugacccagcaaucucauuacuggguauauacacccaaaggaauauaaaucauucuaccauaaagacacauguacacgauagcacuauuuacaauagcaaagacauggaaccaacccaaaugcccaucgaugauagauuaaaaaaagugugguacauauacaccaugcaauacuaugcagccguaaaaaagaaugagaucauguccuuugcagggacauggaugaagguggaagccaccauccucaguaaacuaacacagaaacagaaaaccaaacacugcacauucucacucauaaaugggaguugaacaaugagaacacagggacacagggaggggagcaacacacuggggccuaauagggggaggguggggucaaggggagggagagcauuaggacaaauaccuaaugcaugagaggcuuaaaaucuagaugaugaguugauaggugcagcaaaccaccauggcacauguguaccuauguaacaaaccugcacguucugcacauguaucccagaacuuaaaguaaaaaaaaaaaaaaaaaaaaaaaaagucgccuucuuaauaggaccuacagugauuauguacacacccccagugguacuuaugccaacauacugcucucuuuuccucuauaauuaccaucaucugaaagauuuugugguuuuguuuguuuuuguuuuuugagacagagucucacucuguuguccaggcuggagugcauggcacaauuucggcucacugcuaccucuacuucccagguucaagugauucucaugccucagccuccccaguagcugggccuacaggugcgcacuaccaugccuggcuaauuuguguauuuuuuuuguagagguaacgucucgcuauguuguccaggcuagucuuaaaccccuggguucaagcgauccucccaccuagaccucccaaagcacuaggaugacgggcaugagccaccaugcccagcuggguauuuaaauuguuuucucucacuaaaauauaagccacauagccuacaacagaaccuacugcauagggagauuuaaauaaauauguauuaagugaagccuacgugaauuuagagcauucaauaaaucaauguaacaaccaacauaaacaaacauauaaaauagauaaaacauaucaagcaaauuuggagggauaagaauaggccaggaacaguggcucacgccuguagucccaacacauugggaggccaaggugggaagaucacuugagcccaggaguucaaaaccaaacuggguaacauagugagaacuugucugcacaaauaauuuaaaaauuaggaugggcaugguggcaaucccagcacuuugggaggccgaagcgggcagcccaccugaggucaggaguucgagaccagccuggccaacauggugaaaccucgucucuacuaaaaauacaaaaauuaauugggcgugguggccagugccuguaaucccagcuacuugggaggcugaggcaggagaauugcuugaauccaggaggcggagguugcagcgagccaagauuacgccauuacacuccagccuaggugacaagagcgaaacuccaacucaaacaaaaaaaaaauuagccaggcaugguggcacgugccaggagucccagcuacuugggaggcugagguaaaaggaucacuugagccugggagguugaggcagcagugauucgagauuccauugcugcacuccagccugggugacagagugggaccaucucaaaauaaaacauaaaaaaaccaauuauaauaggauauggaaggauguuguucccuauauuauauaaaguaauaauacuguuguuuugccaggcaugguggcucacaccuguaaucccagcacuuugggagaccgaggugggcagaucaucugacaucgggaguuggagaccagccugaccaacauagagaaagccugucucuaccaaaaauaaaauuagccaggcaugguggcacaggccuguaaucccagcuacucaggaggcugaggcaggagaaucguuugaacccaggagguagagguugcggugagccaagaucgugccauuguaugccagccugggcaacaagagcgaaacuucgucucaauaauaauaauaauauuguuguuuuuaaaaaguagaauuuuaaaaaauauauaaaacguuauuauuuaugacagucaacauccuguacaauagaucacuaaagcuuuuuccucugaucuaacugaaauuuuguacccuucgaucaacaucuccuucuucauccacccccauuccccagccucugguaaccaccaucuacugucuauuuguaugaguucaacuuuuuaagcucccacguaugagugaaaacaugcaauauuugccuuucugugccuggcuuauuucacuuagcauggugucuuccaaguucauccauguugccacaaaugacagaauuucuuucuuuuugaaggcugaauaauauuccauuguggauacauaccacaguuucuuuucccauucaucugaagauggauuauuuagguugcuuccauaucuuggcuauuuggaauaaugcugcaaugaacaugaguagagguaucucuucagcauaugaaucuuaauuucuuuggauauauacucagugggacugccagaucauaugguagcucuguuuuuaguuuucugagggaccuccauauuguuuuguaaaauggcuauauaaauuuacacucucaccaacauagaauuuucuuucuuucuuucuuucuuuuuuuuuuuuugagauggauucucacucucaccacacuggagugcaguggugggaucuuggcucacugcaaccucugccuccuggguucaagcgauucuccugccucagcuuccagaguagcuaggauuacaggcacccgccaccaugcccagcuaauuuuuguauuuuuaguagagacaggguuucaccauguuggccaggcuggucucaaucuccugaccucaugaucccuccaucucggccucccaaagugcugggauuacaggcgugagccaccacacccagccaguagaauuuucaaucagauaaaugccugugugaaaaugcuccaaaaaaaucuacaaugcauagccgggagccugagaaagugacuauuuguggcuguucucugucaaguacaggacaccagcaucugcaccucuucacaaguucaugcccucaugcuaaacagugagccccuggaggccccugagacuuauccauccugcaucccuagcucucaauacagugcccaacagacagaagccauuuauuaacuauucaagugcaugaauggaagcaggaugaagaccauuugagucaacauguuaaagaauaauuuuaaguuaaauaaucauuaaguagguuaaaaacuagcagccaaagaaaagaaacaaauucuguuucugauccagaccccagaacuagcccagaggccaaauauaucaucuggcuucucacuaguuccaaagaggccccacuguucauuucugcucccagagcagaggaucuuuaccugugguccacagauggaaacagaugucaaggggcugaagcaguuugacuaguugcuaagucuuucauuuaaaucauuaauaaagaagcauauaaauaacuguauuacaaucuuuaaaaauauguugauaauuauauuccuauauaauuguguaauccuauuuuauuauacacauuuaaaaguaaauuuugaggucgggugcgguggcucacaccuguaaucccagcacuuugggaggccaauggaggaggaucacuugaggucagaaguucaagaccagccuggucaacauggugaaacuccgucucuacuaaaaauacaaaaaauuagccgggcgugguggcgcaugccuguaaucccagcuacucaggagguugaggcaggaaaaucacuugagcccgggaggcagacuacgucacugcccuccagccugggcgacagagcgggacuccaucucaaaaaauaauaauaaaaguauauuuugagaagccaaucaaaggcuuccccaguuugccaaagggaaccauggaaugaaaacaauggagaacuccaugccuguaaucccaauacuuugagagauugaggcaggaagaucgcuugaggccaggaguucaaaaccagccuaggcaacacaguaaaacuucaucucuacaaaaaaaauuaaaaaauuagccaggcaugguggcgcgcaccuguagucucagcuacuucugaggcugaagcaggaggaccacuuaagcucaggaguuuguggccgcaaugagcuauggucgcaccacuguacuccagccugacuuugucuuagaaaaacaaaaaugaaaccugccagcucuagagaguauacaggcagaccuauuccacuggaagaccuauuccacuagaccuaauaauccugucaagaugaaaaugguugauaaaggaucuguugggggacucuugagcaaucaugaccuccucuucagaggucacaacagcgaggaagguuaaggccuucguuggauauacucaagauguuugauaggcaaacaucaaagagaagacaagcauaauuccaaaacaaggcuguaaaauaaaauaacccgagacaguuaagaaguucugaagauuaagcaaucacaaaucaucuaaagauaggggaagaaacuaagaaaacuagacuguccuccaaagaauuuaauaaacacagauauuaaacaggaaaugaaagaacauuuccuccccaacuaggcuaaaagcucuuuaaggaaagaaacugagucucacucaucuuugcauucccaugaccaaguacugugucugaccugcaguaagcccuacauuuuaaauauaaaaguagcauaaucagccaggcacgguggcucacaucuguaaucccagcacuuugggaggcugagacagguggaucaccugaggucaggaguuugagaccagccuggccaacauggugaaacccugucucuacuaaaaauacaaaaauuagccaggugugguggcacgcaccuguaaccccagcuacucggaggcugaggugggagaaucacuugaacccgggugacggagguugcagugagccaagaucgugccacugcauuccagauugggugacagagagagacuccgucucaaaaaaaaaaaaacuagcauaaucaguguuaacuauaaaaaaguggcauucaucuguaggaaaagcaucacccauauauauaaaguucuaagagagccaagagcagugccacauaacaaugcaguaaaacaugaagaaauaucuggaauggcaagucuggaacagcaaugaccuguggacuugguuccauaggcacuaguuauguuaucauguacauuugaaauauuuuauauaauaacuuuuuuucuaauuuuagaagaaaaugaauagacugaggauuuuuaaaauucugcucagcacucagcacaucaggaaaaacagacaauccagcugguuguggugagaggaacaaugucagccagcuguuuuucaaaagaacucaaaucuuacuucgcuucuaacauuuccaacaagaaauauuucuuucauucauuuagccacauaacacuuggcauuuccagacugcuugccaugugcuaagcacggugcuggggguaaggggaugagcaacacuggcaaggcuccugccuaaccuuacauucaaagggaagaggagaugcagaucaaaaacaaagaaauaauacuccuguuugcaaggagggucuuagcagacguaagcaaguuaaaauaagcucauacucaauuacgguggucccuaauccaguggcugucauaagagggaaauuuggacacagacacacacagaacgaagauggccaugugaagacggacgugaagacuggaguuauguugccacaagccaagaaaugccaaggacugccagcaacuaucggaaggcagaagaaaggauucuccccuuauugggaggcaucgcccuaccaacaccuuggcuuuggacuucuagccucuagaacugugagaaaauaauacugcugcuguaagccuucaaaaguuuuugauagguuguuacagcagcccuaggaaacuacagaagcagauggcacugcaagaagcugggacuaggcuggguguggcagcucacaccuguaaucccaacacuuugggaggcugaggcgggaggaucaugaggucaggaguucgagaccagccuggccaacguggugaaacccagucuauacuaaaaauacaaaaauuagccaggcgugguggcaggcgccuguaaucccagcuaaucgggaggcugagguaggagaauagcuugaaaccagaagguggagguuacagagagucgagaucaugccauugcacuccagccugggugacaagagcgaaacuccaucucaaaaaaaaaaaaaaaaaaaaaaggcugggacugcagaugggagaagcaacuggaaguggaaggacccccuacagcuucucaauccuugcuuuaguuacuugcaacugaaaacagcccaacuaagagggccaccaaaugacugcugccaagcacuccuggaugaaggacuuuuuaccauggguggcaccccacccaguguuugucucuguuagcacuucuuggccaggcgugguagcucacguguguaaucucagcauuuugggaggccgaggcagguggaucaccugaggucaggaguucgagaccagccuggccaacauggcgaaaccccaucucuacuaaaaauacaaaaauuagcuaggcaugguggugggcaccuguaauccagcuacuuaggaggcugaggcaggagaguugcuuaaaaccaggagacaaagguuacagugagccaagaucacgucauugcacuccagccuaggcaacagagugagacugucucaaaaaaaaaaaaaaaaagaaagaaagaaagaagcacuuuuugagucuggaacaaaaaucucucaaucacauucgguggauaauaaaucuacccauuagaccuaugucuaacuuccaggaccacagaaaauaaacacaagccaucaccuuccucaugccagcuuuuuaaacucuuuaacggacagcuaucauauuuucuugaaauuucuuuuucucuuuuuugagacagggucuugcucuguugcccaggcuggaaugcaguggugugaucacagcucacggcaaccuccaccuccugggcucaagcaaucgucccaccucagccucccgaguaacugggacuacaugugugcaccaucacgccccgcuaauuuuuuguagagacgggguuuugcuaugucgcccaggcuggucucgaacuccuaggcucaagggauccucccaccuuggcuucccaaaguauuaugauuacaggcaugagccacugcaccuggccugaacagagaauagauguaaccugucuuaagagagauuuucuguuuguuuuuucacuuauuuaggaaaucaugaaaaucuguuuauucaacccaccaaaguauggcuaauaauauccaacuguuugugauuaugaauaaugaugacuaugugagaaacauaaucaggacuacuuagcauagagguacccgggcaagaacuaaccguuuagggaaugcccaagccuuucuguuaguuugugauaacagcauaugggcuguuacacaguguugcacuuaugcuuuaguggggccccucuggcucuacacugagaacagacucaagugaagcaagggugggcaugagaugaccaguuaggaggcuguuccagaaauccaggcaagagaugcuggugccuuggaccuggguaauagcgguggaggugaugagaagaaacagguggugagaaucuggucugcuucuaguuuucugacaggucuagagcagggccaagcaagcucuaguccacaggccaaaucugggcuacugccuguuuuuguaagugaaguuuuacuggaacacaguuacacuugcucauuuacauauguucuauggcugcuuuugugcuacagaagcagagauaaacaguucuaaccucacagccuccaaagccaaaaauauuuacuaucuggcccuuaacagaaagaguuugccaauccaggucuagaaaacaugaauugucauuuauugagauggaaaccugggagaagauaaaaugugaggcaacagcaaagcuugauuuggggcaugcuagcugugacaugccuguuagacauccaagcagagaugucagguaaagcgcuggaugugucaaucugagguucaaggagcagguccacguuggagauaaaagcuuaggaaucaucaaaugaggguaauuaaagccaggacacuggaugacaacaguaagagaauaaagcuggauggaaaggacaagagguuaaauauugagcccuugaauccuaacauuuagaagucagggaaaugaaaaggaaccaggcaaagagugaagaaggaacagauacagagaaugcaugaaaaccaggagaaugugcuguucuggaagccaaaagaaaaacguguuuccaggagaagugggugaaagccaugucuaaugaggcugaugggucagaccagacagugacucagagcaaccacagagcaaccacgggaacccucgccugacugcaguugauucagcaaagagugcaagggcagaaggggauggagaggacaggcaacucauuccggaaguucugcugcaaagguuuuggugcagagaugugggggagaagcuggcagggggaauuagaucaagagaguuccuuuuguucauucccaugaugggaaaaguaauggcauuauauaggcuguuaaaaaaaaaaaggccauaugagauggaaaaucugaugaagcaagagagagaaaggaacugcuggagugaaggcugaguaacugaagggagaugggaucuaggguccaagcuucaacagcagcagggacaauuugugcauaacaagaaccaggcgcacauacagguaggcagauggaugugaugacugaggcugauggagguucccugccuagguucugccugcaucuguuuucucaaugaaauaugaggccagaguuaggugugguggcacaugccuauagucccagcuacaugagagacugaagcagacggaucaucugagccugggaguuuuaagcuguagugcacuaggaucacgccuaugaacagccaccaugcuccagccugggcaacccagugagaccucaucuccaaaaaaaaaaaaaaaaaaaaaaaauagaaagaaagaaaugggaagccaggccacuagcugagagagugagcauggagaaugagguacugcacacucgagaagguaugaaacagaucagcagagugagugaacugggaagcauggugcaacagccugccaguaucaagggucuacccgaguuugugaucaugaauuugauguuguuguuguuguuguuguuguuuuugagacagaaucucacgccaucaccagguuggagugcaguagcgcaaucuuggcucauugcaaccuccaccucccggguuuaagcaauucucaugccucagccucucuuguaguuggaauuacaggcagguagcaccacacccggcuuuuuguauuuuuuuugugagacgggcuuucaccauguuggcuaggcugaucucaaacuccugaccucaacugauccacccaccuuggcuucccaaagugcugggauuacaggcaugagcaaccacacccagccauguaaucaugaauucgaaaugagacagacauuucaaaaguuuucaauuaguucaaaugguucugaguuuuucuauagccuuauuccaguguagguggggaaugggauuuaaccaagauccugguuuaaauaagcaaguaagacaaagugagagagguucucuccaggacagauuccagcauuccagguauggccugaccagggugaggcaaagagcacuguugucaguacuguguccaaggaaaaucacauuuggaauccugaacccaucaauccuaccagaagaccaucagagcuucucagagacauacagaggaaacauuauaggcaaggaucuucuuuauuacuaacagauguuuugguugaaccacauuagguauaaacauuuauauauaucuauagucuacacugauaccuaacgagaaguacagcaacaaaaacucugcaaauacuuuuaauugacacgauucuagaucaagaagacagaugauucagaaggcuaucaaauuauuagaugauauuaugaucaaugcaguucucuuagcacccccuuuacgcaacuagaauccuaauuauaaaauaguaauuauuauuauaugacaauaauacuauauuugauagaaaaguucacagacaaaagagagauauuuucaaauacacaguaugagaaauaucauuucccaacaaagacaguccuggauaucaagcaucagcucauuuauuauaaagaaauaaacuuuuacuuuuuaaugagauaguucuaaacauccuaucagguaguuuuauccucugaaaaguuaaagaaaaaguucugugccaaugcagaaugaagacgaggaaaucugcaauuagagguguucauuuugaccauuauuuuaaucuugcauuuucagauuauuuuaucuuaaaaccaucaaccaaauucauaaaaucagcagaaccaaauucagucuuaaucaucuugucaucagagauaauaccuaaaccuguuugaaaaaaaaaaagauggaaguuauggaaagaaaagcaauugguuuaacagauugcaauaaaaaaaaaagcgauaacacaacacauugcaaugauauuuaaacuacugcuuggaggauuuuaaagagcugaugucugcuucauuuuaaucuguucuggaaacaucacaaccaucagcuuaacaaaaagcuaagaagaauuacaaaagagucccagguaugaagcuugggcuuaccugaugcaccuauuggggagguagcuggggucauguuguggacauugagaccaagacucugagaggguccuggggcugaugccgcuaugggaggccccggaggguucucccucuggggagaggugaguggggugguuggcugagaggucuguccaccagcaagucgugcaaggcgccuccgucgaaucuacaacaugaggggaaaagggcauucuauaacuaaucagcagaaacacaauucugccagagaaugacauuauucauaaccaaaccagaguuuaacaacucaauaugccuucagcaaaaguacucuucugagagaauaacucgcucuaccaguauuccuacaagcucuaucacuugaguuuuuaacaacuguauuuuggccagguucagcggugccugccuauagucucagcuacuugggagggugagguggggguaaucgcuugagccuaggaguucaagaccagccugagcaaagcagugacaacccaccucuaauucauacauacauaaauacauacauaaauacguauauacuguauguuaguucccuuaccaucucuguuuaucacaccuccuuggcugacauggcgaauuuacgguaagcauauuacacuucauuuuagagagagucucucugucacccaagcuggagugcaguauuucaaucauagcucacugcagccuugaacuccugggcucaaguaaucuucccaccucggccuccuaaguaucuaacacuacaggugcaaaccaccauguccagcuaauuaauuuuuuuuaauuuuugacagagacgaggucucacuauguugcccaggcuggucucaaccuccuggccccaagugauccucccaccuuggccucccagaguacuaggauuaugggcaugaagcaccaugcccagccuaugcuuguaacacacuaaagcuuguuguuauuuuaauaaaaugaccuaacuuggucauuucaaauagguaagauuuaaaaauaaauagccaauuggccaggugugguggcucacgccuguaaucccagcacucugggaggcugaggcaggaggaucacgaggucaggaguucgagaacagccugaccaacauggugaaauccugucucuacuaaaaauacaaaaauuagccagguguggugaugcgugccuguaaucccagcuacugaggcaggagaaucacuugaacucgggagguggagggcaauugcagugagcugagauggcaccacugcacucuagccugggcaacagagggagacuccaccuccaaaauaaauuaaugaauaaauagccaauuuaauucacuaaaacaaugagaaacaaaaguuacacuaagacacaaauuuaaccaucacuuguaggagcaaaaugaucagauuuucuuuuuuuacuugauucaauaaaaauacaaucugccacuucuuccuuuuaacauauaauuaaagagcaacaucuuauugaaagagaaaaauuaauccauucauucaaaauguguuuguugaacuccuacuaacagcagggcaucuccaaaagcuuccuaacagauuuacccauguccccugagcaaaagaagccagauguaaaaaaaacagaguggaugauuccauuucuauaaaauuugaaaauaagaaaaacuaaacuauaccauuaguuuggauaaugguuauccuuggugggaaaggggcaggaagcagcucgggagaggcaggagugagauucuagggaucugguaaugguuuuuuuuuuuuuuuuuuaauuuuaacuggauacuaaugucacagcuauguccacuuuaugaaaacucacuggguuguauacuuacaacuaugaguaaucaguucauggguauucaucuuauucuucuucauaguuuauauguuaaauauagucuucuguguagcauguaauuuuuuuuuuuuucugagacggaguuucgcucuugucacccaggcuggaguacaauggcaccaucucggcucacugcaaccucccccucccagguucaugcgauucuccugucucagccucccaaguagcugggacuacaggcaugcaccaccacacccaccuaauuuuuaauuuuuuguagacauggcaucucaccauguugcccaggcuggucucaaauuccugggcucaaacaauccuuccaccucggccccccaaagugcugggauuacaagugugagccaccaugccgggccaaguuucauuaucuuacagacagcuaaauuuaggaguucaugcuugauuucuaauucaaauucaaccuuuauuacugacuacuuuacuuaucuggagccuauccagauaagucacuuaacagcucucugcuucaguuucugcacaauggacauccguacacugcacaucuguacaauggggaugaaaucaucggccgaggggaguccgaggcgguggaucauuugaggucuggaguucgagaccagccuggccaacacggcaaaacccugucucuacuaaaaauacaaagaucagccaggcauggugccacacaccugcaaucccagcuacuugggaggcugaggcaggagaaucgcuugaaccugggaggcggagguugcagugagccaauaucgcaccgcugcacuccagccugggcgaugaagugagacuccgucucaaaaaaauaagaaaaaaaccaguaucuuccuuacaggguugugagaaaaccaccacccugucccuuucccuacuuauuuuuucuccguggcucugaucugcccuaugacaugugugauauauuuauuuguguauugcuuaguuaccaucccccuaauugaaguuucuuaaaagcaagaacuuccguugcaccagugccuagaacagugucugacacaugguagguacucucuaaauaucugcugaauaaaugagaaauacuagaaaaaugcacugaacauaaaauugacuaauuuauuaguugacguuaucauuaucauuggaagagcauacccacuauuguuggaaaaaauaugaagucaccuuaaaccucaaugccaaguucagcccaagauguuaaauucagauguucuacucagugauauaaacagagaauaaauguucugacucacuauaauaugcgguugaagaaagaaaggauucuaagguuucaaaaaagguugaagaaucaagacuuugugaagcauguugcagacuauuaagcaggaagaaagaguuaagagacagaggcagguccauacaugacagaaggaguaggagaagauugggagaauacauuuugccccaucuuaaagauccgcuggaaaauuuaggaagagccaugcagggggcagcguucugggcugcccacagcagggcucucaguagaggauaaugcccuuggguggucugaaugccuucuacacugguguuaacuuugaacugguuuagcaaccugaggcccugggaauaucuggauaggggacucacaagagaauggcuuugugcaaucacagguauaaagguuuaccuccagccugggcaacauggagaaacaccggcucuacuaaaaauacaaaaacuggccgggcacaguggcucaugccuguaaucccagcacuuugggaggccaaggcaggcagauggcccgaggucaggaguucgagaccagcccgacuaacacggggaaaccccaucucuacuaaaaauaccaaaaauuagccagguaugguggcacgcgcccauaaucccagcuacugaggaggccgcggcaggagaaucacuucaacccgggaggaggaggucacagugagcugagaucgcaccacugcacuccagccugggcaacagagcgagacuccugcucaaaaaaaaaaaagaaaaagaaaaaagaaaagaaaacugugccaggugcaguggcucaugcucguaaucccagcauuuugggaggccaagguaggugggaucacuucaugucaggaguuugagaccggccuggccagcauacugaaaccucaucucuacuaaaaauacaaaaauuagccagguguggugguaggcaccuguaaucccagguacuugggaggcugaggcaggagaaucacuugaacccaggaggcggagguugcagugagccaagauugugccacugcacuccaaccugggcaacagagcaagacuccaucuuaaaaaaaaaaaaaaaaacuggccaggcaugauggcucaccccuguaaucccagcacuuugggaggcugaggugggcggaucacaaggucaggagaucgagaccauccugguuaacacggugaaacccugucucuacuaaaaauacaaaaaaauuagccaggcauggugguggccaccuguaguccaagcuacucgggaagcugaggcaggagaauggcgugaacccaggaggcggagcuugcagugagcugagaucacgccauugcacuccagccugggccauagagugagacuccaucucaacaacaacaacaacaaauacugagaugggaggaucaccugagucugggaaggucaaggcugcagagagccauaaaauccagucugugcaacccggugagagccgggucucaaaaaaaaaaaaaaguguaucuaauuaauuugacuacuaagagaugcaaccucacuuuuuaucacaaacagaacauaugagauacacaccaaaaaauagucacaacacaccaaaauaugauuaaacauuuuucucauuguuuacuugacuuuuuuaacauuaacccaaaggacuggcauaaucuccuuuaaguuaaacaaaaguccuuuuuuaagagaauuuuguuuuccccuaucucacagagaaaaaaaaaaguauaaagaacuuccaauuccucaauuuguguccuaaaccacaacucaaagccacacauacuaaucaugaaaucucauuccuagaguuuuucuugucuguuucaguucuuauuucacaaacgacauuaaaauagggcuuucuccuaaucuguuauaugacgcagcacuucccacccucacguuccugaugaacuaaaaauagauucaaaacagugaaggccauugugauugcaggcagaagcuaagacaggaugggccaaacuguuccucuuauuuuuagcaguuuguggggaaaaacacccacaaaacacuguuauaaguuuaauaaacagucauucuacaaaagugucuuacuuuucuacuuuaaaaaaaagugaauuccaauauaaagaaaaauaauuggaaauacuuucucuuugggguagucuccuuggaaagaugacaauaacuccuaguucuguuuugguuuuuuuuugagacggagucuugcucugucacccagguuggagugcgguagcgugaucuuggcucacugcaaccucugccucccggguucaugccauucuccugucucagccucccgaguagcugggacuacaggcgccugccaaaaugccuggcuaauuuuuguauuuuuaguagagucgagguuucaccuuguuggucaggcuggucucaaacuccugaccucagguuaucuaccugccucagccucccaaagugcugggauuacaagcgugagccaccugccuggccaauaacuccuaguauuauuauugguuuuauuuucuuuuuucacagcuggccauguuugaaacuuauuaaaugcuaugacaauuucacaguaggccuaaucuaagcccaacaauguuucuccaaaaaaugcauuuacauccaaacaucacagcucugugaucuaaaauucaucaguuuccuuaaaaaaaaaauucauggucagaugugguggcucacaccuguaaucucagcacucugggaggcugaggcagggggaucacuugagcccacaaguucaaaaccagccuggggaacauggcaagacccccuccccccccaaucccacaaaaaauaaaaaauuagcugggcaugguggcacacacgauguguagugccagcuacuagggagacugaggcaggaggucaaggcugaagcgagcuaugauuauaccacugcacuccagccggggugucagagugagacccugccucuaaauagaaacaaaagggaaggaagguaggaagggagagagggagggagguacaaagggagggagguacgaagguagagagggagagagggaaggagugggggagggaaggagggggggagggagggaggggaacaaugauauauguuauauucacuucgauaucuacugcuuuuaaaaugaggcauauuuuuauguuauguguauuuuccauuuuuuaaaaaauugaauugaaaaagccgguugcaaaaggguacacauaaugauuccauuuauuuuuuaaaaggauguagauuuacauuauaaugaacauuauuauuagugcaaauuauacauaaaugcaaauggcaaugacacaguaaauuuccauuuuuccucaucuuucuucuuucacagaauuucugaugaaaagaaugaaaaccauuauuauuucccacuacaucuaccgugggaaaacauucagaugaaaguguagcccugcuccauaacgucuucacuccaagacccagggugaaagagcagccucuaaugggaacacuagcaaucgcccaggcaaagggcaagaggcagagcaaacuccacacuggcccagcggugacacauucaauuguguucacauuuaacuggccaaaacagucacagggccgaaacuaccccugcagcguggggaaauagaaccuuccccagacagggguggugaauauguggacaacaauacagugaaguacagcggucuccucuuccuucaacacacagcugggcacuggugguugcuuauuguggagcugugccuuccucccccgcaugcuccucccgccacuugccccauaacugcucuauauccugcucccugaccuggaucuuugcucaaauguuaccuucucaaugaagccuucccuuccuuccuccuaguucccaucugcuuuagugguucuccauacuuucaaauaguucagccaaaaccaacaaguauguguggguguauagauguauauacacacauuuauauacagacaaagugaauguaacaaaaaauaaacugaugaaucuaggugagucauucaaauuuucugcagauuuaaaaauuuuuagggccaggcgcgguggcucacaccuuuaaucccagcacuuugggaggccaggcggguggaucacuugaggucaggaguucaagaccagucuggucaacauggugaaaccucaccucuaucaaaaauacaaaaauuagcugggcauggcagcgggcaccuguaaccccagcuacucaggaggcugaggcaggagaauugcuugaacccgggagguggaggcugcagugagcagagauugcaccauugcacuccagccugggcaacacagugagacucuaucuaaaaaaaaaaaaaaaaguccagaauagaaaguugagggaaaaguuagacccaccagcauggcuuuuguuuuuuucucuagccauguacagcaguacacaguaggcacagagauggacuagccagggcuguugagagaggaaaaggaagugacaaagagacgaggugauagagaguggaacugaaggguaaugauaaugaugcagacacaggaagcccuggcagcaccuggauucuugauuccagucucuuccugugacccagcuaucuuucuaucccuagguucagaaagaagacuccuguauccuuaaaauaaaucccauuuuuggcuuaagcucaauaagauguucuauuacuuacugcacguaugcauagaaauacuacaauuccucggagaugcgaucagcaguuugcuugugcauagaguaucaccuuuuuuucaccaucuuauauuagguuuucaggauucaaauucauuuacacuaacuguauauucauguaauaacugaaucaucccagagagcaauuuugaaaaucgaaccacauacaaaugcuaugugcuuacuacuugacuuaaguuucuuuuucaggacagguagggguuaggcagacgaggaacaaaggagcgccggcagagauugggaggcuuugugagcacacacacuguuuagggaacgcugaguaguugguaagaaugaguguguauggacauggugaggcacagacaagaaagacaagcugcaacaagcucaugacgagcugugaauaccauccuaagacacugaacuuguucgugaaggcaagaaagacaucuuuugaaggauuuaagcaggggaauaaccagguaagauguacuuuucuuuuuuuuuuuuuucauugagacaguuucauuuuuguugcccaggcugaagugcaauggcauggucucggcucauugcaaccucugccucccugguucaagcgauucuccugccucagccuccugaguggcugggauuacaggcacccgccaccacacccagcuaauuuuuguauuuuuaguagagacgggguuucaccauguuggccaggcuggucucaaacuccugacgaccucaagugauccgccugacuuggccucccaaaguguuggaauuacaggcauuagccaccucacccggcccagauguaccuuuuaaaacaaaucacucuagcuacuguguggagaacgaauggaggcaggccacaagcaagccugcgcaaugggcauaggaaagggacagcucuggagauacuugaucuguguucccaacagaacuuggcuguuauuuggaaguaaaaagugaggaagaagaauaaucuagauuucaggccuggauaccuaaaugaaugguaaaauacccuaaaauugaaaauacagaaggagauuuuaagaagauggguuaugauuagauuacugagugugagguaccuggaagaauacccaaccaaaaauguccuacagguugccgacaucuguuuuguuuuuguuuuuuugagauagggucucacucucuaucacccaggcgggagugcagaggcacgguuucagcucacugcaaccucugccuccuggguucaagcgauccuccugccucagccuccccaguggcugggacuacaggcaugcgccaccacacccagcuaauuuuuguauuuuuauuagagacgggguuucaccauguuggccaggcugguuucgaauuccugaccucaggugaucccccugccuuggccucccaaaguaugcccagccccaacaucuguuuuauucgccaucacuauuuucuuuuucuuuuuuuuuuuuuuugagacggaguuucacucuuguuucccaggcuggagugcaauggugcaaucucggaucacugcaaccuccgccucccagguacaagccauucuccugccucagccucccgagucgcugggauuacaggcaugugccaccacacccggcuaauuuuguauuuuuaguaaagaugggguuuggccauguuggucaggcuggucuugaacuccugaccucaggugauccacuugccucacucacccaaaaugcugggauuacaggcgugagccaccgcaccuggccucacuaucauuauuuucuuguucuaggaaagauuuaaagugauuaacaaaaaaugcauuaaggcggccgguacagcggcuuacgccugcagccccaacacuuugggagccaaggugggcagaccuccugaggucaggaguucgagaccagccucgccaaaauggcaaaaccucgucucuacuaaaaauacaaaaauuagcuggguaugguggcucaugccuauaaucccagcuacucgggaggcugaggaagaaaaaucccuuaaacccaggaggugaagguugcagugagccaggaucgugccauggcacuccagccugggcgacagagcgagacuccaccucaaaagaaacaaacaaaaaaacacacaucgaauguauuuuuaauuuaacuuaauuaaauuaacaaguuuaauucaaagagauaaggaaauuaggacacaagcaaaaugaugguagaaaaaauagggccgggugugguggcucaggccuguaaucccaacacuuugggaggccgagguggguggaucacgaggucaagaaaucgagaccauccuggccaacauggugaaacaccgucucuacuaaaaauacaaaaauuagcugggugugguggugcccgccuguaaucccagauacucaggaagcugaggcagaagaaaagcuuuaacccaggaggcggagguugcagugagccaagaucgcgccacugcacuccagccuggcaacagagcgagaccucgucucaaaaaaaaaaaaaaaagaaaaaagaagauaaagccaggagugagaucagcacacacuacacacguauagcaacacaguaaguaacugacaacacuccucaacaucagcagaugcuuaauggcaaaacaagauucaaaggaaaaaguuugagaguagcccaaaugaagagauccaagcaucagcuuugcuggugcggcuugauuucuggguagaguugagaauaccuggggcagggguccaaauccugggacccaugaaggccaggaggaccuucaauucccucaagauuuucaaggagaucccuuaccccaaaaaaucuuaaaagaugacucucccaggcaaugcccuucacucaauccuccauaaaaacuugcucagggccaagugcgguggcucaccccuguaauaccagcacuuugggaagcaggcggauuaccugaggccaggaguuccagacuagucuggucaagauggugaaaccccgucucuaauaaaaaauauaaaagauuagcugggcgugguggugcaugccuguaaucccagcuacuugguaggcugaggcaggagaauugcuuaaacccaggaaacggagguuguagugggccaaaaucaugccacuugcacuccagccugggugacagggacucugucucacaaaaaaacaaacaaacuuguuuugcacaauuacagaaauguggccaguugucuguuccucucuucugauagcucccuuuuacaccucguuauuaaaggguggauuccaguacuacaaauucuacaaguaaguaugccguagguuugcaguaugcugcauuaaugcaucucauuuauaucuuguugucuuuugagauaaaaaaaaaaacagaaaacagaagguggaaacaaacucuugcgguggcuuacaccuguaauccuagcauuuugggaagccaaggugggaggaucauuugaggccaggagcucaagaccggccugagcagcauaguaagaugacuucucuacaaaaaaauuuuaaaaauuagcugggcaugguggcacgugccuguagucguaacuacucaggaggcugaggcaggaggaucacuugagccuagugagcuacaauugcaccacugcacucuagccuaggcaacagagugagacuggcuccaaaaaaaaaaaaauuguccagaaucucacuagcucacuagggauucuaaaauacacagcaaaaugaaccucuaccguuagaagucaagguguuaaagaauggcuuauuuucugaugaccacacuuaggaguacuucaauggcuacuagaaccccagaaagguuuuuauuuucuuuuguuuuguuuugguaaaggaaaaugccauacauaaacauucaggacucauccgaaccuucuggaaccagcucuccuggggaagucagagaggaaauacagucaugggcugcauaacgacauuucagucaaugucagaucaccagaucuuacuggugguccgguaagauuauaauaccauauuuuuacuguuccuuuucuauguuuagauacacaaaaacucacuguuauuguacaacugcccacaggauucaguauaguuacaugcaguacagguuuguagcccaggagcaauaccuaggccauaccguaaguauccaaggaguuauacuauagagccuacguguggaauaggcuaugccaucuaaguuuguguaacuauacccuauaguguucacauaaugaugcguuucucagaacguaucccugucauuaagugaugcaugacuguaguugcuuguuuuaaaucaccauguagguuacauucaucuacccccaaccuuucccaacccccuccacacacacacagggaccugacgacugaauagaacaggacuggcucccaggaauacaaacaggcucucuugcuucuccucauuggucaugccuuagcaugguuccuccacauccccuacucaagcagggucuuaguaaacaaguaaacaaagcacuagcaaagaccccagaguugccaccccucagcucuccuggguagaagaagccuucccuuggcuugggcugaagaccuaugccccagaggugccauucugauugugugaaaggaguggaaaaaaaaaugccuaaaauuaaaaugggagccuccagauacgcucaacaacuucggaugccuacagcuguggucacugugacacguggaggugagaggcauagaggaauggggcagacugggaggguguugucaggauagggaucggcugccgcccuucacgccucggccuugcccuaagcagccacgcuuccauggcuuuaugcacagccucuucgucuccugggaacugcaugagcucaaugggcuucaagcuccuccuguucaauucauagacaaugggaauaccagugggcaggcucagcuccaugauggccccuuccgggagagccucccaaggcucgacugugccagaaaagcugcugccaggagccucaaccaacaccuguuuccccuccuggaucuggggaauuauuucuucauuccaaaagggcagagcucugacaauaguguccuucagacucuuacagaagagcaggugcccuacaguguagucugcccaccagcaauccuugcugcuguugcuguauaauaaauguucagcuccaucagaggcaucaagaucuuuuuguuguugcuguuguuuuuaagacggagucucgcucugucccccagggcuggaaugcaauggcgcaaucuuggcucaccacaagcuccaccucccauguucacgccauucuccugccucagccucccaaguagcugggacuacaggcgcccaccgccacaccuggcuaacuuuuugcauuuuaguagagaggggguuucaccauguuggccaggugauccgugauccgcccgccccggccucccaaagugcugggauuacaggcacaagcuaccgcgcccagccggcaugcagaucuuuaucuggcccucaugguucuugacaacagcuucugcuuuguugaggccagucagacccuuauagugccacuccaggaggugcaccaagucaucacuacugggagccacaucuggucaguggcauccaauacuguccagggggucggcauugcugucuuccgcccugaggugacacagaugucaaaaucacagccagcauuucucagugccucccagaaggcucaggucagugucacaccagccgcugaagugcuucuccaggugccaggcacccuugcccaccugcaggcggcagcuggugggcucaggaugcagcacugacuguggucacugugauuccagaguccccacugccuggcucccagugcacaccacucccccagcucuguaccccaugcccagcuucuagugccccuggcccaccacccagcaccccaugccucacugccuggcuccugugcacuuucuccagcacaaguuuuaacacauauaaaccuaacagcucagugaggccagcuucccuaagucugcacuaacaaguaaaguaccaaggcuuccaagcaauagagaaauguuacaggaugaauaugacagaguggaaacagacggggguagaauggcacggucacccugcaaucucauuuuuccaaucauuuucugcuucacuuuccagguuacuuauccaacucaaaaaauguuuacucaacaguuacaaaaagcuugauugauuaaccacauuucuucuccaaagaauaucaugacuauguccaggacuuacucccaaaucaaaacccuaaaguaucuagugcuuuuacccaagcacuccgcuacagcucaaacacgucaccucuagaaggggaucauccaugucggcuccuggccucagcccaggguacuccuggcacucccacuuuaauuguaacagagacccuuuuacucucacaagaguccuuguguggacaugaccugagaaggucaccccacauccgacaguccagcuguuccuucuccucucuuuaccuacauacccuccacugccucccaugcuugcuucccugccaccggaaugcaggcaaggcaagucaccuuccuccuccuugagaacuuucccaggugaguaaauaucucaaaaauaaagcacaaaauacuuacaaaggccaacuucuagcaauuacuagcaaaauacauuuuucuuuuuucuuucuuuuuuuuuuuuuucugugagacagggucuuguucugucagccagguuggaguacaguaacacgauuucaacucacugcagccucaaccucccuggggaggacugcuugagcucagcaguuagaaaccagccuggggaacacagcaagacuccaucucuaaaaaaaaaucaaaaaauuagccuggcaugguggugugugccuacucaggaggcucaggcaggagaagcgcuugagugcaguaguuuggggcugcagugagucaugaucacgccacugcacuccagccugggcaacagacacucugucucaaaaaaaaaaaaaaaaaagagaaaagacuguaaaugguauuuucucagggagaaaaaaaagguugcgacccuuuaauucuccaaagccaggcaguaauuauaucuuuuuuaaaauacaaggaauuuuauaaacuguaacaaaaauuguuaauuguguuuuuugcaucuaauugauaacaugaagaacguuaaacacgccuaaccccauucugccagcuggugagaacuaaggaccaaaggcauaaaacugccuaauuaaaguguuuucuuaagucacccauaauacuuaaaauauuaauauuauuacuucaaauuagaauaauaaggggccaggugugguggcucacaccuguaaucccagcauuuuggaaggcugaggcgggccaaucaccagagcccaggaauucaagaucaguguggcaaaaccccaucucuacagaaaaaaaaaaauacaaaaaugagccaggugugguggcacaugccuguagucccagcuacucaggaggcugaggugggcuggggaggcugaggcugcagugagccaugaaugugccacugcacuccagccuggguggcagagugaggccuugucucaugaauaaaugaaugaagcaguccaccugaaagugaaacagagaccagaccaugugcaaugggugagugaagugcuaccccaggccccaucuucucaagcccucuacacaaugagcaaucgcguagcuagcgcuggccaggaucccagcugcaccuguuuccagcuggguuaucucucugagccucgauuuccccauuuauaagaaagugacaaaauauuucuuaucuuauaaaauagucaucagaaauaaagguaauauaacaaacaacuagaauuaguauguauuuaucagcuuauaguuuauccccacccaguacaauacaagcuccaagagagcagggauuuggucuaguuuauucaccgcuguauucccagcaacuaugacaguaccuaacucccagagagcacucgguaaauauuugcugaacaaaugaaaaguguuuacuugacacacaguaaauagucuuuuuuaaaaaaauaauuucagccuagcaguuuucuccaucccuuugcucuuuuaaucuuccucuuaggcucaguuuccccuuuguguaggguucugcuuuaucuaaauaauacgaguguguacaaaagcacuaaaaagcaucucacgugucaucuaauugugaaauuaggagcaagagaaaccaaaaagaucaagagccuaaaacugccaaacauuacauggcagagaaacaugcugaguguagaauaauuuuaacugcauucuguuauuuaaagaagguuuccugcugcagaaacuuuaugcccuuuauaaccaaaaacaucccaggggauagaaguggaugguauggucuccauucucaucuuugauccuacuugguucaacagacaagauuaacguagaugacuaagcaucuacuacuucuacuucugguuuuguuuuguuuuguuuuguuuuuuugagacagagucuuacucugucauccaggcuggaaugcagugaugcaaucucagcucacugcaaccuccauccccagcuucaagugauucuccugccucagccucccaaguagcugggacuacgggcacgugcuaccacacccagcuaauuuuuguauuuuuaguaaagacaggguuucaccauguugaccaggcuggucucaaacuccucaucucaagugaucugcccaccuuggccucccaaagugcugggauuacaggcaugagccacugcgccuggccagcauucacuacuucuaacacuauuccauaaaacugauucugguaacuuuugccccauguuggcugggugugguggaggaaggcuugaagccaggaguuggaaaccagcuugggcaacauaacgagaccccaucgcuacaaaaaaaauuuuuuaaauuagcuggguguggcagcacacgccuguaguccuagcuacucaggaggcuaagacaggaggaucaccggagcccaggaguucaaggcuacagugagcuaugaugcugccagugcacuccagccugggaaacagugagaucuugucucagaauaaagaaaggaaagaaaagaaaaagaaggaaagaaaagaaaagaaaagaaaagaaaaaaugaugaaaagguggccuacgagacauuuucacaagcauuuguuccaauuggcauucauuaaaauucucccacucacaacccauucuaaucauaacauuucaagccaaaagaugcuuuauucauguuucccuaaacuagaaaucaccaaaccuuuuggcacaaggacaucuguucaaaguaaaaacacgccgggugcgguggcucacaccuguaaucucagcacuuugggaggccgaggcagguggauccccugagguccggaguucaagcccagccugaccaacauggagaaaccccaucucuauuaaaaauacaaaaauuagcugggcaugguggugcaugccuguaaucccagcuacucgggaggcugaggcaggagaaucgcuugaacccgggagguggagcuugcagugagccaagauuacaccacugcacuccagccugggcaacaagagcaaaacuccaucucaaaaaaaaaaaaaaaaaaaggagaaagauaauauuacagacaccaagggaauggguacuguuccaaaaaaaaugccccgcaaguguuaccauggcuagacuggaagagucuacaauguuacccagcaugcugcuggcauuguaguaaaugaacaauggcaacagucuugccaagagaauuaauaugcauauugagcacauuaagcgcucuaaaggccagcaucauuuccuaaaacucaugaaggaaaaugaucagaaaaagaagaaagccaaagagaaagguaccagagaagcacacugugugagaaccaaugggaagaagccugagcugcuggaaccuauuaccuaugaauucauggcauaagaggugugaaaaaaauaaaagaccucugaacugucaaaauguuucucuucauugaguagaagugugguguccccucgcccaaagaacuauuuaaagcaaauuuuaauuguguccuaauucauuaugccaugucuuuacuauucaaauuuaauguauuucuugcugaaagaugugagguggcuuacugugcaacaaauuacucaauugguuagaaaacagccagauauuacuuacaaaauauuuguauugguuugaagauagucccucuaaaucaucauggaagaaauaaaauagcuuacaaaaauaaaaauuaaaaaaagaauauggaaauaaauguuuaugugucaaaaauccugucuuuuuuuuuaaaaaaaaucuaauauuucuaauuacuaccccaacaacaaaaaaagauuugaugaaggaaaaugaguuaucuaaagauucaauaucagauggacauggugguucacaccuguaaucccagcacuuugggaggccaaggcaggaggaucacuugaacccaggaauucaagaccagccugggcaacauagcgaggccuugucuacaaauaauaaaagaauuagccaggcaugguggcaacaccuguggucacagauacuuagaaggcugaggugggaggaucacuugagcccgaaaggucgaggcugcaagugagccgugaucacgccacugcacuccugcacucuagccugggugacauagcaagaccuugucucaaaaaaaaaaaguuuucaaaaucagccaugcagcggguagggagagcauuaagaaaaauagcuaaugcaugcuggacucaguuacuaagugauggguugauaggugcagcaaaccaccacgguacacgcuuaccuauguaacaaacuuacacauccagcccauauaccccagaacuugauugugccacugcacuccagccugggcgacgagcaaaauuccaucucaaaaaaauuaaauaaaaaauaaauaggccaggcgcaguggcucacgccuguaaucccaggacuuugggaggcugaggcggguggaucacgaggucaggagaucgagacuacccuggcuaccacagugaaaccccgucucuacuaaaaauacaaaaaaauuagccgggcaugguggugcaugccuguagucccagcuacuugggaggcugaggcaggagaauggcgugaaccugggagguggagcuugcagcgagccgagaucgcgccacugcacuccagccugggcaacagagagagacuccgacucaaaauaaauaaauaaauaaauaaauaaaagccaugcacgguuguaaacaccuguggucccaguuacucgggaggcugaggugggagggucgcugaugaaauuaggagauggggccuuugggaugugaugagguccugagggcggaaccccugaugaccugcggauuaaugcccuuauaaaagaaagcccagggggcuccuuugcuccuuccuccaagugaggacacagugagaaaacagguaucuaugaaccaagaaguuggcucucaagaaacuaaaucucuuagcaccuugaucuuggaacuucucagccuccagaaugcagaacggugaauaacaaauugcugcuguguacaagccacccacuuuauggcauuuuguuauaauaguccaaaugaacuacgacaucuacccaggcauauauccacccacacagaaaaagucaaugacaaccaagaccagcuacagaauguucagggccccaugacaaaugaauaugcaggcuaccuuguucaaauguauuaagaauuucaagacagcaacagcagagcauuaaaccaagcguggggcaccucugccugcagucacaugccugugaagcuggcccuggugacaaguauagacacaggucuaacaaaagaccaugaucacagacaugauuccugaggagugccuggcacgaugggugcucaauaugaucuacccggacaucuuagaaguucaauucccaaaaacguccauuaaagcagugugcuaccucaucuagucagaaaaucuaacuaauuaaaucaccacugaccaggcccaguggcucaugccuauaaucccagcauuuugggaggcuaaggccggaggaucauuugagcccaggaguucaagaccagccugggcaacauagugagacccugucucuacaaaaaaaaaaauuaaaaaaucagccagguaugguggcaugcaccuauagucccagcuacucgggaggcugagguggaaggauugcuugaacccaggaggcggagguugcagugagccaagauggcaccacuacacuccagccugggugacagagcaagaccccgucucaaaaaaaaaaaaaaaugacacuauuagacaucuagaauuuauaccaagcacugacagggaacaaagaagcaauaugcauugaaugugucauguuuaauuagaaagguaaagucacuucucaaucuaggacccaaaagauaccucuuuucccagucuugacacugcugccaaagaacuggacaagaugccaaagauuuagcagcuguugaguaguuaauacaaugacauccaauucagagauuuucucccccugcugggagggguacaauucuuucagaagacaaaaauaagucaucugaugggaguaaagugugucaccucaggcuguauucuuuaguccugauaugcagaacauuucuccugggacuccucgaguccccuuucugcacacucuucuuucccuuucaaagcucuacacuccaccuucacccucuuaguacauucaggccaccaaucacuccacguuuuagaaaaagugguagcaguguggcucaauacaaaagauggccccugggugagaagagauuuuuggaacuaaugggucgggggagaggauuccaacccaaccuuucacauaagccacggucuauuugcuaccuuaacuaguaagauaccacuauuuaugcuguuggcauuauuauaugcaaaagauuuguuagauguuauauggacaccaacuaaaacuccaauuauacacaauucaaucuuacuuugagaacuaacuugucccaagaauccacucggccaggucacuacaccaugcacacuucacaucacuccaauuaaucugaagaacagugcuacgagaugguauuccauacccccauuuuauaagugaggaaacugaggcucagaaagauuaaguacuuuccccagaaucauccaauuuguugcuccaaauaaaauccagguaagagccaggaacaguggcaugccuguagucccagcuauucaggaggcugaggcgggaaaaucaucugagcccaggaguuugaggcugcagugagcuaugauaaugccacugcacuccagccugggccauagagcaaguccugucucaaaacaaaaagcaaacaaccaaaaaagccugcaaguaugucugacucugaauuagaacucugauaaugaggcuuuuuucaucaagugccuaccuuaaccuaauuaacacaacuuaaugcagcaaacaaauaaacuauugcaauacuagaauugggaggcaggccgguugugguggcucacgccuauaaucucaacacuuugggaggccgaggagggaagauggcuugaggccaggaguuggaaaccagccugggcaacauggcaacauagugaaacuccaccucuauaaaaaaaaaaaaaaaaagaauaggaguccugaaaagacauguuguaucacugcauucauucaugcauugaacaaguauuuguucugagccacucugugccaagcccugugccagaacuuggauaaaaagcaguaaacaagaauagccaggaguucauaucccaguaggagcuacaccaagugaauaaauaauucaaugcagugugguuaauguuaggagagaagugauuuuaaugaaaccccuuucccguuccuccaacuucucccuaucaccuacuccuucagcugcugcagacccuuagugguuuuggagagcuuggggucacacauuuggcuaugccugauauaucucaaaaccuuucagaucaggccaggcacacuggcucacaccuguaaucccaacacuuugggaggccaaggcaggcggaucaccugaggucaggaguucaagaccagccugaccaacauggcaaaaccuggucucuacuaaacauacgaaaauuagccaagugugguggugcaugccuguaaucccagcuacucgggaggcugaggcaggagaauugcuugaaccccagaaguggagguugcagugagccaagagcgccacugcacuccagccugggugacaagagcaagacucugucucaaaaaaaaccagccuuucagaucagcaagcagcuaccaauaucccauauuugccaucuucaguuuuucuccaauguucucauauuucuaucaucaauuucaaaagaaugaauguaacagaauuugcccagaguaagaaguaaaugaaacauuucucuucaccacagacuuauuuuucuaacuuuuuuuuuuuuuuuuugagacagggucuuuugcucucucgcccagacuagagggcagugacauggaucauggcucacugcacccuggaccugccgggcucaagugauucucccaucucagccucccgaguagcugggaccacaggugcaugccaccacacccagccauuuuggacauauggggucucccuauguuguccaaguuggucucaaacuccuggacucaagugaucugcccaccuuggccucccaaauugcugggguuacaggcaugagacacuaugcccagccaacauuguuuccuaauuuaaaaaaauuuuuuuuuuuuuuagagaaaaggucuuaugauauugcccaggcugcccucaaacuccugggcucaagugauccuccugccuuggccucccaaguagcagggauugcaggcaugcaucauugcgucuggcuacaguguucuaauugucaaaauccuagucaucuuuaaagacuaauucaaaucuucccaguccccucccuacauuccccaucagaauuaacugccccaucaaccguacccccuuuacugaaaugucuauuuagcacuugaagucuagcugguugcguuccuguguccccagcugcagccugaggucacugaagguaaagaccaggucuucgucauauucgagcagcaucuccacauagucagcccucaguaccuggcacaaagcccaaaaauauuuguugaaauuaagcaaacaaauuaaauaauauucaagucuccuacucugaaauauuugccacucaacuauuuuuuuaagcucuaaaaacuauaauaugauccaauguuccccauauuaugucucaaaauuuauuauuuggaacucuucaggcccaaaaccucaugcuaggaaugauauacaaauauaucucuaccucuuuacuuccucccuuggggaaagagagagaaacagaguguugaaugaauaaagaaaguagugauuauagcagagaaugggaaaaguuaaaacagaaaaagauaagcucaccacauuuuccugucaccucuaaaacccauggcuucugccaacuacagauggcuucccagugcaccccuggagccuacgccucacuccugagcucccuccccucuccucccauucucucuugaacuugcuccagucagcaaugaaaucagucuugucaagguaaccaagggccuccaugucgccaaaucccauagucacgucuugguccuccucuaauuuuaucaacauuagacacaguugagcauucccccacaucaugaaauacuuucuuccccuggacaccagauuccaugcucucuagacuguccuccaaccucaguggcuguuccuuaucagucuccuuuucugaguccuccugaucucccaaccuuuaauugcuggaauggauggaggcucaguccucuugucuuccgcauuuaugcucacucucuagguaaaaucuguccauucucaugauuuuaaauacaaugacaacuuccagauuaguaucccuaaccccaaccucccccaagaacugcaaacuccuauacaaccuauuucacaucuccauauggacaaagaacaggcagcauauucauaauauguucaaaccagaugauaacgucucccucccaaucuucucuuucaauuuuccccaucucaguaaaugacaauuccauuuuuugagcugcuuaagccaaaauuccugguaucccugugguagaaaagcuaguugccucccaaaacgcauucaggacggaugcaguggcucaugcuuauaaucccagggccuugggaagccaaggaaggaggauuguuugaagucaggaguucaagaccagccuaggcaacacagggagacccucgucucuaauaaaaauuuaaaaauuagcugggcacaguggcacacaccucccaguuacucaggagacuaaggcagaaggaucacuugaacccaggaguuagaggcugcacuguacucuagccugggugacaaaaaauaccuugucucuaaaaaaguaaaauaaauaaaaugcauucaaccauguuugcauuugaguguggccaggagacuaagcucuagccaaggagauguaaguaaugacauaugggccaagggcgguggcucaagccuguaaucccagcacucugggaggccgaggcgggugggucaugaggucaggagaucgagaccauccuagcuaacguggugaaaccccaucucuacuaaaaauagaaaaaauuagccaggugugguggcgggcaccugcagucccagcuacucgggaggcugaggcaggagaauggcgugaaccugggaggcggagcuugcggugagccgagaucacgccacuacacuccagccugggcaaagagugagacuccaucucaaaaaaaaaaaaaaaaaaaaaaagauauaugaagcuuucuggccaugcucuuaugggauagaacaugcccucuccucccacuugagucccuuccuaaggacugggaugcagauuuccucaaagaagcuggagcagcccuccuggccuauaagcuagaggaugacagugcacaaaacagcaugagucuggcccccuagcaggcauggaguuacuaagccagcucucagccaccuacccagauuuucacuugaaauagaaaaaaaucaacaucuuguucaagccauuauuauuuccgaccucugccacagcagucaaaucaauauccuaacuaauacacagaaucuggaagcuggaaguaaucaaccuuaacaauacaaauaugcagcauuggcuuaggggucagcaugggcacagauacuguaggauggaagaauggcaacccucagagaucacaauaaaacauuuggcaaaacccgugauaucuuagaaaacagccugcaugccaacauggccuguaauucuaggggaacuggucgaacaauacaaaauuuggugcuuacuggcuaagaaguccugcaaacaugaagcagacucaagccaaagcuugccaauucgcaugcaaagaugaaagggaauacagucugccugaggaauguccgcggucuacaaucaaaguuuucagagucugguaauuuggggcuaaguaggguugaaaaagccuacuccuucaauauccacaagaagcaagcuggagaaacuguuuagcccuacaaaaaggauagccuccaauguccacuucagaucugaccccagaggaaaagaaacacagaaaaacucuccagaaaauaaagucagaggcuacagagggccaggcacaagggagcuccuucaagagaccagaaucaagguugccagaaaggcgaggucagaaccucacaguacugccaggggaggaagcgcucacagcucagccuggcaggagcugacaauggcuauggaccagcgcagaguauuacuccccauucuucccuuuuccaaacaggacuuucuacuuccauuauccuaaccucuccaccacuguaugggggacagcagagccccugauaacuuuguuuuaaacuaaagauuccuggaauguacaucacccagggauucuggacucugaaguugauccgggguugucucccucgggagaaggguuuggaaagaaaggcauagacugcucucccuuucugaugugagagaacguauagcugaacacauggcugcccaagaaaaacuauuucucagccuucccagcaaguagcuguggccaugugacuuggguuccagccagugagagguaaacaggagugaucugugcaacuuucaagcugugccaugaagaggcacaugaccuccccuccccucucuggccagaaugcagacauacaagggccaaaagauggaagccauaugguaggaaaguagguacaagacagaaggcaccugggcuccuaaugagcgcagagcugccauaccagccccggccuccuacccagacuucuauuuagagagaaauaaacaucuaucuggcuuaagcagcugccacuucaugucucucuguuacaacaaucaacucgaugauaaccuaacucaucccugcaccuuggacuccacucuuucauacuccacaugcaacucacuacccaauccuauuggcucuacccacaaaauguaucugaccaucuaguguuugacccuuucucccccucucaaccacuaaccccaguugguggcccccacaucaucucucccugggacuccuucgauggccgccuuucucucugcuuuugcucuuuccuccuuaucuauucucuucacagcagccagaaugcccaggagggcagagauuucuguuuuguccacagguguacccucauggucuagaacaaugcuggacauagaccauauuucaucaaauaugucagacuguagacuguaccauuauuuuucaccaccaagagaaacaaaauauggcacauuaaaccacaacaaaaugccugaacaacagacaaggacagaguugucaucaguuacaccaggcucucauagcccugaaauuucuuucugaggaauguggagugucucugaccuaagguugcauugccugagugugaaaugcaauccuccuaacuguauguucaguuacaaaaugugacauggcuucacacacuuauggauuucggccucucugaagcucccuaaugcggggguccccaaccccugggccacagaccaguaccaagcaagcacgcgagugagggagugaagcuccaucuguauuugcagccacuccccaucacucgcauuacuaccugagcuccgccuccugcaagaucagcaguggcauuagauucgaaugggagcaugaacccuacauugaguucugcacgcgagggaucuacauugcacccuccuuaggagaauccaaugccugaugaucugucacuuucucccaucaccccuagauggaccgucuacuuacagaaaaacaaggucagggcucccacugauucuacauuaugguggguuguaaaauuauuucauucuauauuacaauauaauaauaauagaaauaaagggcacaggccaggcgcgguggcucaugccuguaaucccagcacuuugagaggcugagguggguggacugcuugagcucaggaguucaagaacagccuggccaacauaguaaaacucuaucucuaucaaaaauacaaaaaauuagccgggcaugauggcgugcgccuauggucccaaguacucaggaggcugaggugggaggaucgcuugagcccaagcgguggaguuacagugagcugagaucaugccacuguacucuagccugggugacaaagcgagacaggcgggcgguggaaggagggaaggagagagggagggaaggaaggaaggaaggaagaguaaggaaggaaggguaaggaaggaaggagcacaacaaauguaauaugcuugaaucaucucaaaaccaucccuuccccucccaccaccaccacccauggaaaaagugucuucuacgaaaccagucccuggugccaaaaagguuggggaccacugcccuaauucacuuggugguguuuggcaauuaaauauggaacugggccaggcgcgguggcucccaccuguaauccuagcacuuugggaggccgaggcaagccgaucauuugaggucaggaguucaagaucagccuggacaacaagaguaaaaccccgucuccgcuaaaaauacaaaaauuagccgggcaugguggcacgcaccuauacaccuauaaucccagcuacucgggaggcugagacacgagaaucgcuugaaccuggcaccuggcagguggagguugcagugagcugagauccugccacugcacuccagcgugaguaacagagcaagacucugucuccaaaaaaaaaagaaaagaaaagaaacguggaauuguggucacucccccaacaacaaacauuuucuuuagaaacagcaaauggacaccccaccuccuguuuccauuccucucuguauacaaaguaacacuugcuuucauugcugaaucuaaguguaauuguuuggaaggcauuuaaaauggcaacuaauuuuaacacuguagcacucaacugaaggggugauuacaugaacagguauaaccagguucacaccuaaacaggaaaugacaacuaugucacaacugccaccuggccaacggugauuacaccaucuauuuauaagaagcaucccggcccagcgcguuggaucacgccuguaaucccagcacuuugggaggcugaggcggguggaucacgaggucaggagcucgagaccauccuggcuaacacggugaaaccccgucucuacuaaaaauacaaaaaaaauuagucaggcuugguggugggcgccuguagucccagcuacuugggaggcugaggcaggaaaauggugugaacccagguggcggagcuugcagugagccgagaucgcgccacugcacuccagccugggugacaagagugagacuccaucucaaaaaaaaaaaaaaaaaaaaaagcagcaucucaauuucaaagauauuaaaaugugaugaaaacaagggggaggagaguacaucucagaaaugauugaaaaacaguugagaucucaguaaguuuuuacugaaaguuggccgggugcgguggcucacaccuguaaucccggcacuuugggaggcugaggccggcagaucaccugaggucaggaguucaagaccagccuggucaacaugguaaaacuccaacugugcuaagaauacaaaauuagccgggcaugguggugcaugccuguaaucccagcuacuugggaagcugagacaggagaauugcuugaacccccgaggcggagguugcagugagcugacauugagccacugcaguccagccugagugacagaguaaaacucugucucaaaaaauuaaaaaaaaaaaaaaagaaugaaugacuuuaccuccugccacugugccccuugcacagaaggcucuaaccaugcuuggcauccuugcuauuccuggaacagcucaagaaugaguuuaccucaaggccuucugaaccugcuguucccuuuaccugggaacauucuuccccgagcaagcucccagccaucccugaaauucuuuucaagaccaccuccucaaagugcacacguuacacauaucugauuguucucuguaccuguaggccacagaaauacucuguaacaauacuccaucccuaaguauuucucuucacagcacuucucaucaaaugacaccuuaugugaacauguuuguuuguuuguuucuuugcuuuugagacacagucucacucugucgcccaggcuagagugcaguggugcaaucucagcucacuguaaccccugccucccggguucaagcuauucuccugccucagccuccugaguugcuaggauuacaggcgugcaccaccacgcccggcuaauuuuuguauuuuuaguagagacaggguuucaccauguuggucaggcuggucucgaacuccugaccucgugauccacccgccucagcaucccaaagugcugggauuacaggcgugagccaccacgcccggccaugcuuguuuuuuaucccucuccucccacuaggacgaagcuccauacagcaacguuugucuguuaucagggaugcagcuagucaacuguaagcgcuguugaaugaaccguuuacaggaagacauuuccacuagauacuacaagugccgugugagaaaaugcacuuugcacagagaagucuuucugccuucuuucccuacaagagcuuggggcuacuugaugagcuccacucucagcaauaacaaacgggaaugaaaguccacuggagggcugggccuggcggcgggcgccuguaaucccagauacucgaggggcugacccaggagaaucgcuugaauucaggagucagagguuguagugagccaagauagcaccacugcacuccagcaucaugccuguaaucccacaacuuugggaggcugagguggguggaucauuugaggucaggaguuugagaccagccuggccaacauggugaaaccccucuacuaaaaauacaaaaauuagccgggcaguaguggcaugugccuguaaccccagcuacucgggaggcugaggcaggagaaucacuugaacucgggaggcggagguugcagugagcagagaucgugccacugcacuccagcauggggacacagcgaggcucugucuuaaaaaacaaacaaacaaacaaaaaguccacuggggcuuccacuuccuaucucagaagggaccguaagaaugcuauaaauguggccgggcacagucguucacgcuuguaaucccagcacuuuggaaggccgaggcggggggaucgccugaggucagaaguucgagaccagccuggccaacuuggagaaaccccaucucuacuaaaaauacaaaaauuagcugggcaugcuggcgggagccuguaaucaaagcuacuugggaggcuuaggcaggagaauugcuugaacccaggaggcagagguugcagugagccgagaucaggccauugcacucaagccugagugacgagagcgaaacuccaucaaaaaaaaaaaaaaaaaagaaugccaaaaagguuacaguuggcugagguuaagucuuguuuuagagguaguaaagcgauagaaaacucuggagucagaaccuggauuagaguccagguucuaccacuuacuaguugugugccuuucaauaaauuaauuucuauuagccuccauuuucuuaucuguaaaacaggggauaaggaugccaaccuugugaagcaaguuuauauccuuauuaucauucucugucucuugucuacaaugaacaaaaggagaggaaagggccuggcaggauacaucccacuguccucccaggcuuaagaaagaguccugguuauaaagugaaugguagcaacuaucuucugaggaaaaaagggaccucagguccucaggccuguuacaagggaagaaauggucaaagagguggggauguuaggcugggugcgguggcucacgccgguaaucccagcacuuugggaggcugaggcaggcagaucaccuaaggucaagaguuugagacccgccaagccaacauggagaaaucccgucucuaauaaaaauacaaaaaaauuagccaggcauggugguacaugcuuguaaucccagcuacucgggaggcugaggcaggagaaucgcuugaaccugggaggcagagguugcagcgagcugagaucgcgccauugcacuccagccugggcaacaagagcgaaacuccaucucaaaaaaaaaaaaagaaaaaagaagaaagaaauggagauguuagagcaccaaggccagagugggggucuacauguggacucaucuuuuuggugguccaaaauuaaacuugcaaucucagcacucugggaggcugaggugggcagaucacuugagcccaggaguuugagaccagccugggcaacauggcaagacccugucucuacaaaauauacaaaaauuagccggaggccuggcgugguagcugacaccuguaaucccagcacuuugggaggccauggcaggcggaucaccaaggucuggaguucaagaccagccuggccaauauggugaaacaccgucucuacuaaaaauuaaaaaauuagcugggcauggcuggcagcuacuuggaaggcugaggcaggagaaucacuugaacccagggggcagagguugcagugagcugagguugcgccacugcacuccagccugggcgacagagggagacccugucucaaaagacgaaaaaaaaaaaaagaaacaugugcuuucuccaaaaucugcugcuucucuggaauuccuuauucaacccuuaucuauccuucuccauagcuagaaaccaaggugucauuucuccaucucuccuccccuccccuccuucacagcuaacugaucaucaaaacuggguuaaucacaguccuugguauuuuuggugucugucugcuccccuccauucccacaggcaaugccuuaguucccuuggacuccacugccucgcuccuauacagcaacaacagccuccuaauaugucuugcagucugcagccaccuucucccaaacuacccuuuacucccuugccacccaucuuucuaaucucuuaaaaucccuaaaaggcauuuuacagagaaaguucaaacucagccacgugcaguggcucacgccuguaaucccagcacuuuggcaggcagaggcaggugggccacuugaggucaggaguuugaaaccagccuagucaacaugguaaaaccccaucuuuacuaaaaauacaaaaaaaaaaaaaaaucagcagggcaugguggcaugcaccuguaaucccagcuacuugggaggcugaggcaggagaaucacuugaacccgggaaccagaggcugcagugagccgagaucaugccacuucacuccagccugggcaacagagagagauucugucccaaaaaacaacaacaaaaagaaaguucaaacuccuaaacguuucugacagcccuccaagaucagguaccugccacacacccgagguaaaacccaccucuccagucacacuacuugcugcuguuucuugagcuccccaauuucgagccaguucccagggcaacugcuacucagcguuaaguaucacuuuuucuugaaagucuucacuaagacccugccucucccggggucccuucucauguuucuuaagugaguugugcauaccuccaccauagcaccuggcacuauucuauaacuguuggauuccuaucuaucuccucuacucaaauuuaauuauaauugcuuuuuuguuuguuuuucuguguguguguuuuuuuguuuguuuguuuuuuugauggagucuugcucugccucccaggcuagaguacaguggcgcaaucucggcucacugcaaccucugucuccugaguuuaagcaauucuccuacuucagccuccugaguagcugggauuacaggugcguaccaucacacccagcaaauuuuuguauuuuuaguagagacgggguuucacgugauccgccugccucgaccucccgaagugcugggauuacaggcgugagccaccgcgcccggccccaacucccaaauuuuuaacgcgacaggcauuuaaaaaaaaaauugggagugggaggaccaguaccaaaagcccugaucacaucaugaaugcauucaugcaaaacagcacuucuacagaaaaacuauguauaucaaaacagagugggucaguguuacguaggauguugauacaaaagcuguggugaauuuaugucaguuguugagcaguagaauaaagaggacuuucgaguccagagcacuggguuugaauuccaaccccaucacuucuaagccaggucgcuauggacaaguuacuuaaccugaaucccaguuuccugacuuguaaaauuaggaaaacaguaccugcuugauuauaauguuuucucuaaugagaaacagcuaucaagugccuggcacagaagaggcuccuaaggcuguuguuuaaugucaauuuucuuccacuuacagaaccuugcuaaaaaguccaaggucacauauucugcauuuggaaaggaauacuuaaaacacuuucuaaaucuuuuuuuuuuuuuuuugagauggaguuucacucuuguugcccaggcuggaguguaguggugugaucucggcccacugcaaccuccgccucccggguucaagcaauucuccugccucagccuccugaguaccucggaucacaggcaugugccaccacgcccagcuaauuuuguauuuuuaguagagaugggguuucuccauguuggacaggcuggucuugaacucccgaacucaggugauccacccaccucggccucccaaagcgcugggauuacaggcgugggccacugcgcccggccaacacuuucuaaaaucuugaccacacccggaaucccagccaaccaucuugcagaugaacuaggucauaaagaagaguuaggagagaaaaaucacuuaugcaaucucauuaccauugucgaaaaacaguuuaaaacaccuacuuggcugggcaugguggcucaugccuguaaucucagcacuuugggaggccaaggcggguggaucacuugagcccaggaguuugagaccagccugggcaacauggugaaacccugucucuagaaaaaaauacaaaaauuggccaggugugguggcaugagccuguagucucagcuugggaggcugaggugggaggaucacuugagcccaggaggcagagguugcagugagccaagaucaugccauugcauuccagacugggcgauagagccagacccuaucucaaaaauaaacacaccaccuacucacagcaccaccuugagauacgaaaaacaacacaugaguagauuauagaauuaauauaauguaaauaaugaugccuuggaauguagguuccugaagagaaugaacuuagucaugguucugcaaugaaccuauaggcagugaacuauagggcaaugaacucacuguaauacacuauauaaauaacaaacaacagugaaguuaaaguacucuacuuaaaagcacaagacuaccgggcacaguggcucaugccuguaaucccagcacuuugggaggccgaggcaggcagaucaccugaggucaggaguucaagaccagccugaccaacauggagaaaccccgucgcuacuaaaaauacaaaauuagccggguaugguggcgcaugccuguaauuccagcuacuugggaggcugacgcaggaaaaucgcuugaacccgggaggcagagguugcaaugagccaagaucgcgccauugcacuccagccugggcaacaagagcgaaacucugucucacaaaaaaauuuaaaaagcacaagaauucuaggugaucuaugacagggaccaaaaagugcacauaauuuaaaaguuccuaaagcuaccagucugguuauaccagccuuuuucacggacuguauaaucauacauuuucauuuuguuaaaauaugaaacucugccuuaccuaauuuccuaaauuagauuaaaagaucaccgccuugccuguuuuaacccugaaauauaagcuugaaguuucaauaauauaaguguauuauuuuguaaucaaaucaaugucaccuaccauaucugacacaaguuuucaacuacagaguaacaauacaaaggcaaaagcuuuggaaaugucucaugagaacugcuuaccuaaccucaaaaauuuuuaauugaauuaaaaagaaaaacuucaaagauauuuuucccaaaauaacuauuugucuggcucccacuuugggaggcugaagugggaggaucgcuugaggucaggaguuugagaccauccugggaaacauggcaagacccccgucucuacaaaaaaaaaaaagauuuuuuaaauuaaaaacaaacgaauauuauuuguucuagguucugcugagaguaaaauuaacaguuauugaaccagcccuuuguguucuggacaacuaauuuguugaagauaauuuuacauugauccuguauuagugaauuuaauuuuuuucauuuauuuuaauauucuguugaccuugaaaaaaguuuauucuauuucuuccacaaagguuacauguguuccucauauggucacaaaaaaaaguuacaccuuccucaaggacugaugaaagugaagagacacauuuuagauuauacaauaucuucacuggucuguaaugccucacugguuugaaaagaauuuuuuggugaaaacucaaguaugcaaaagccucuaaaccaaggacuauuaacagaucaucaaaaaaaaaaaaaaaaaguaauuuauaggaguaaaggacuacuaaaaaacuaccucggccgggcgcgguggcucacaccuguaaucccagcacuuuggaaggccgaggcgggcggaucacgaggucaggagauugagaccauccugggcuaacacggugaaaccccgucucuacuaaaaacacaaaaaauuagccgggcgugguggcgggcgccuguagucccagcuacucgggaggcugaggcaggagaauggcgugaacccgggaagcggagcuuugcagugagcugagaucgcgccacugcacucuagccugggcaacagagcgaggcuccgucucaaaaaaaauaaaauaaaauaaauaaaaaauaaaaaaaaauaaaaaaacuaucucuggccggucacgguggcucacgccuguaaucccagcacuuugggaggccgaggcgggcagaucacaaggucaggaaaucgagaccauccuggcuaacacagugaaaccccgucucuacuaaaaacacaaaaaaauacaaaaaacuagccgggagugguggcgggcgcuuguagucccagcuacuccggagucugaggcaggagaauggcgugaacccgggaggcagagcuugcagugagcugagauagcgccacugcacuccagccugggcgacagagcgagacuccgccucaaaaaaaaaaaaaaaaaaaaaaaaacaguaucucugccuuaagagaaauuacucacuagaauuaacauuaaugaaaaacgggggagguagagaaacuuuuaaaaaaccacauaaaacaggccaggcgcgguggcucacgccuguaaucccagcacuuugggaggcugaggcgggugcaucacgaggucaagagauggagaccauccuggccaacauggugaaaccccaucucuacuaaaaauacaaaaaauagccgggcgugguagcgggcgccuguagucccagcuacucagggggcugaggcaggagaauggugugaacccgggaggcggagcuugcagugagacgagaucgcgccacugcacugcagccugggcgacagagcaagacuccgucucaaaaaaacaaacaaacaaaaaaaaacccacauaaaauaaagcgauucuaaggagauuuccuaccgaaugaaagaaacuguguaauauucucuucacuuaagauuacauuucugcuguauucgaaaaaaacaaaguaacgccgaaugggcaguccugauuuuccaaaccaaguauccaaguaucacaaucaacaaaaucauuugcuuccuuuccuaccugacccuuaacacaccacugcguguccuaucccaggagaauuucagucccuaaguaaacacacuaaguacucuguagcuaaaacuggagcauggaagucuuguaguacaaucaacuugauggaugacugcuuuccuaauacuguagggaaguuuacaugaugaaccagugaagaaauguggagguaggcuaaagaggguauggccaguagggguccugaaagggaagcuccuaauuugcaaaaaggaagagaaaaggcaguagaaucauaggaaauuccuuguacccuaauugccacugcuuuuugguuguuuuuuuuuuuacaacaaccuaauuuauuaaacaaucuuuaaaacaucaagaaguagaucuguauaacuccuuuaagaaaugagaacaggagagaguuuagaaagucauuugcuuccacuugcuucccguucagucucugcuacagcaaaacacaaguuugaaagauucaagaaguaggaaaagauagaauguaacagaagaaugccagaagucauuaguggucuauuaaguaccagaauauaacuggaauucucuaaacuguggagaagauacauauuuuguuaaauaucaaagaaucugucuguaaaccaccccucaagcaaaaauauauguuuaaucaagcuuauacagugcaauaaccacacauaucuggaauuucaaaugcuuucuuuaaaaauauucacccaccauacauucucauuccauccaaaauuguucuuuaaauuccugaagacacagacacacacacacuuuaacuucauguaaaucucgcccuucuuguucgcauacccugaagaaaagaauaaacaccucaagaugcucucuccucuuguucauacccuaaaagaacacucggaaagaagcaaauggaguucagaaugaagaaagaaggcaacagaauaaaggagaacaaaaccagagacccuaucggggagucacguuauucuuggaaaauaucaucuccguuccuucuccaagcccaaaggccagacagcacuggcgcaauaccaucccuguccaaagcgcuaacgaguugccaacuaaucccucaaggugucccccaaccuccucaccucaucagcgcucagcuccuccaucgcuuuccucuuaauggugaaaggcguuaaggagagauccuucuguucucgagaccacggcgggaggaaggagaguggaaggugucuaucaggcugucuggucccccgaaugggggagguuucagaauugcauagucagagguuaaaaaauaagaacacgagaggcacuaaacugccuuggcuucggucacuccagucgccccacagacuacuacagccgcuuguucccugagcagccuccuuuggccgccacugcugcugcuacaggguugucuuaaggcgccacuuauuacccucugcuucccagguuacccagcuaggcagcgcggucuccaguucgucucgugccccgagccugcuguuucuucgugauaguggcgcgguagcugcguuccuacagcagauccugcucuccuuccuacccuuugcuccuggcgggaacuggucgacugcagaguggauaccccgagguaaggcgaccccacagccguccuggcagagcccagcacuguaagggaagccccuccccucccaaagcaggccggccacgccccgccuccacgccggagcccggguaggggggagggggaggaugggaugcgcguagcucucgcuggaagaguaaauccuccuaccccuccaccccuacucuuucccccucgccccaccaaguauuauucaucaaaac

SEQ ID NO: 191434 - RNA, 42071 nt, Homo sapiens
uguuguugaaagcuuuauuuguccucacuuaggguaaaugaaaaauuucaagauuuggcuacaacuucauucuuugaaaaguaauauuuuacagaaagagagauuagggguacuggcucugaagacaaagcuuagauucaagcucagcucaccauuuauaccaguccccugauuuugccguuuccuuaugauauaaggcacucaggagcacaagccaagcacacaguaaguguucaggaagugcugacauuaugaaguucaaacagcaccacugguaaacgaaguucagauuucagagguggagacuguguacgcagccucacagcugaguggaugccguggugaaauguuuagaucauaggccuuugagaaaaauuaugagaauguuagaggaaugggccuccguuggcacccagaaauaaacguuaaaggaggcuauuucaucauauaacaacuucuggacuucuagaaaagugaaaagagaggcuuggguaaggaagaugaaagcccucccaccacccugcaugcugaccuagggcauccuuccuucuacucuguuguuagauccucaugauggccaaaaaaaagcauucuuuaaccuaaaccauccccauggcucaaucucuaccccuucaucaccaaggaaaagccacuucucuuaucugaaaggccugcuguucacauaagcaaacacuaccacaaaggcucuccaucauccgaaugaagaugccaaucaaggacuuuuacugcagguuuguuugccacuuucaaauuacacaauguaagggguaaaggguacaacacauaaaacccccagcaucaaacaaacaggccaaacaaaacaccagcaucacacauuuccucuaaauugacaguacaaaagcaaauuauggaaaugaugcaggagggaauaaacaauggcauauuuucuucacgucagucauuaauauuuauuccccugugaaauucauuguucuaacuuccauuauucaaaguggaaguucuguccuugaggacacccaaaauuaugcuauuacguggcagcaucaacagcauccucggcguugggagaaaaagccaagcuuguucucuguacaaagcuuguucuuuguacaaaguuguugcuccauaaauagugcaacaauaggaucaggcugggugcaguggcucaugccuguaaucccagcacuuuggaaggccgaggugggcagaucaccugaggucaggaguucaagaccagccugucuaacauggcgaaaccccaucucuacuaaaaauacaaaauuagccggacaugguagugggugccuguaaucccagcuacucagcaggcugaggcaggagaauugcuugaacccgggaggcggagguugcagugagcggagaucgcaccacugcacuccagccugggagacagagugagacuccaucucaaaaacaaaaaacaauaggaucauuguacccuuaccagggcuccugcaaggguccccacaugccuuguccagugagguccugaggucaguagucacagcugagcagggcacaggcacuucugaguaggaaggcacgauaguaugagagaaguuuccagcauuggaaacuuucugcaguuuacgugacacuucagaugaacuagguguaguuucccagaggaaguccaaauucaguucugauagcuucaucuugcucuaucauuacuuuucaggacuccuucaacucuuaaacuccaagaagcuaaggaggagaaaaugacccucaucuguaugauuugaggcuccagccuuucacuaacuuggcagauggauccugaaaccugcuagcugucaggcuuuuuuuuuuuuuugagauggagucucgcucugucacccaggcuggagugcaauggcacgaucuuggcuuacugcaaccucugccucccagguucaagcgauucuccugccucagccucccaaguagcugggacuacaggagcccaccaccaugcucagcuaauuuuuuguauucuuaguagagaugggguuucaccauauuggccaggcuggucuugaacucuugaccucacgugauccacccacuuaggccucccaaagugcugggauuacaggugugagccaccacacccggucuuuuuuuuuuuucucuuugagauggaguuuugcuuuuuugcccaggcuggagugcaguggcacaaccuuggcucacuggaaccugugccucccggguucaagcgauucuccugccucagccucccaaguagcugggauuauaguuaugcggcaccaugccuggcuaauuuuuuguauuuuuaguagagacuccaucucaaaaacaaauaaacaaacaaaaacuuauuuuagcuuaccauugauuuuuacuaaauuuuuuuuuuuuuuugagacagagucuugcucugucgccaggcuggagugcaauggugcaaucuuggcucacugcaaccuccaccaccuggggucaagugauucuccugccucagccucccaaguagcugggacuacaggcacgugccaccacacacagcuaauuuuuguauuuuuaguagagaugggguuucaccauauuggccaggauggucucgaucucuugaccccgugauccaccugccucagccucccaaagugcugggauuacaggcgugagccacugugcccagacgauuuuuacuaaacuuuuaagcuuuaguuuaggcaacagaucacaacuucuuuccccaguuauuaacucccagauuguuucagauccccaaaugggaagucugaaauaucaugcuguagaauuccuaugucuuagcuucugcaguguuucucugcaaaggggccaggaugaccccagcauuccugucuucacucucagagcuguacaaauuaugcuuuucaauguauucuuggacaagaucugguaccaaguagcgaaugcucuggccccuucugagggcucuccggauuuuuguggaugagaugucauuagcgauccauucauucaccacgugaauguugcuccgguguuuccacagcacauccgauucauagauaaacuucugagcaucauuuccagcccgaguaacacauaugagcccauaguuggccacgauuugggugaugucuucacucuuccacaaauugggaacagcaaaggacuccaauaaaucugccccacacagcagcuugaccuuuggcacagcugggaagaauaaaacagagcuuugggguaugcuuuuucuuccccucuaccuccuccaaguggaaagggguuuacuuuucuaauaacccacuguaucaaaaugaagauacguaugugcuuuucaaggaugagggcuuaggccgagugcgguggcucuagccuguaaucccagcacucugggaggccgaggcggguagaucacuugaggucaggaguuugagaccagccugaccaacauggugaaauaccguuucuacuaaaaauacaaaauuagccgggugugguggcgcacgccuguaaccccagauacuugagaggcugaggcaggagaaucacuugaacucgggaggcagagguugcaguaagccgagauugugccaucgcacuccagccugggcaacaagagcaaaacucugucucaaaaaaaaaaaaagaaugacaguucacaguuuuuaugagcuuuuauuuuaugagaaucagauucccaaaagagacccaggacaccucaaagauuagagaccacugcaggagaaauaagcuccaagugccuuuuauucuccuucacuucaugcaacuaacaaggggcauuuuccagacacccacaaguaugcaauauaaaaugaaaauaaaggccaggcauaguggcugacaccuguaauccuaacacuuugggaggccaaggcaggaggacugcuuggggccaggaguucaagaccaaccuggccaaaauagugagaccccaucucuauaaaacaaaaaaaauaaggcccaggcgcuguggcucacgccuguaaucccagcacuuugggaggccgaggugggcggaucaugaggucaggagaucaagaccauccuggcuaacauggugcaaccccgucucuacuaaaaauacaaacaaauuagacaggcgugguggcaggcaccuguagucccagcugcucaggaggcugaggcaggagaauggcaugaacccaggaggcagagcuugcagugagcugagaucaugccacugcacuccagccugggugauagagcgagacuccaucuaaaaaaaaaaaaauacacagggguuugcucagcuacagaaucuuaucaacucuaguccguggguccugcuaaaacauacaaaccuuuuguuuuuggcucuagggauuucuuuugacuagaaucuuguguuucaguccacuuccucuuccuuccaggccuuucuagaguaggugaguucugcuggugaucacagucacuagccuccaauuucucuugauggugucuauaaaacaacaaaacaauagaauauuucucuuucucacaugcuccauuagaauauaucauuaacauuauuuauagcugggcacaguggcucacaccuguaaucccagcacuuugggaggccgaggugggcggaucacgaggucagaagaucgagaccauccuggcuaacacggugaaaccccgucucuacuaaaaauacaaaaaauuagccgggugugguggcgggcaccuguaaucccagcuacucgggaggcugaggcaggagaaucacuugaaccugggaggcagagguugcagugagccaagaccgcaccacugcacuccaaccugggcgacagagugagacuccaucucaaaaaaagaaaaaaaaaagaauaucauuaacauuauuuauuuauuuauuauuuugagauggugucuugcucugacgcccaggcugagugcagugugugaucucagcucacuguaaccucuggcuccuggguucaaacaauucucuugccucagccucccgagcagcugggauuacaggggcgcaccaccacgcucagccaauuuuuuuuuguauuuuuaguagugacgggguuucaucauguuggccaggcuggucuugaacuucugaccucaagcgaucugcccgccucagccucccaaagugcugggauuauaggugccuggccaacauuauuuaucauaugccacacauuacacugaauccuuuacauggauuaucugauuaagucuucucaacauaagaugacuguuguggaagacuaaaaaaaauuaaaaaucuucucgacugggcgugguggcucacaccuguaaucccagcacuuugggaggccaaggcggguggaucaccugaggucaggaguucgagacacagccugaccaacauggagaaacccugucucugcuaaaaauagaaaauuagccgggugugguggcacaugccuauaaucccagcuacucgggaggcugaggcaggagaaucgcuugaacccaggagguggagguugcagugagccaugauugcgcuauugcacuccagccugggcaacaagagcaaaacuccgccucaaaagaaaaaaaaaaucuucucaacauccuauaucauaaauauuauuaucuccguaagggaaggagaaaggaggcuuacaguugcuacuccagcuccuagcagagucuaugaggaggcauucaauaacaauuuuuuuuuuuuuuuuugagauggagucucacucugucgcccaggcuggagugcaguggcacgaucucagcucacugcaaccuccgucuccuagguucacgccauucuccugcuucagccucccgaguagcugggacuacaggcgcccaccaccacgcccggcuaauuuuuucuguauuuuuaguagagacaggguuucaccauguuagccaggauggucucgaucuccugaccuugugaucugcccgccuaggccucccaaagugcugggauuacaggcgugagccacugcgcccagccucaauaacaauuugauugagugaauguuuugggguuuuuuugguuuguuuuucagagacacaggcucacucuauugcccaggauggagcacaguggcacaaucauagcucgcugcaaccaaaacuccugggcucaagugauccuaccgccucagccucccagauagcugcgacuacaggcacgugccaccauguucagcuaacuuuaguuuuuuggagagaugaggucucacuauguugcccacacuggucuugaacuccuggccucaagcaauccuccugccucagacucccaaagugcugggacuauagaugugagccaccaugaucagccugaacauuuugguuauuacaaagcgacuauauuacugccaccuugcagcuaguuucacugaaaauacuucugguuuuaaugugcugcucaucucucauaucagaauuguuuauuaccccauugacagaggacacugacuaauuugccuaaggucauuuaacuuaaaaguauuaauagcagagccaggacuugaaccccagcagucugguccagagcccacacucuugaccauggaagaguguggcuuaaucuugugacaaagaaccagaacgccaaggagaagguccuagagcggcaagggccugaggccuuaaaggaaggggcccuaagcaggauuuguguauagcucuauucugggcuggcagcagggugcccacuguuuucaaacugugcaauguuacccaaauaacaucaacuacacuugugggauccaacugugggccuuuauuccccuacaucccaacccuucugagcagcugaguugacuauuuaaugggcaauaagguuacuauaaagccagagggucggguagggcuguggcccaggaacuugcucccucaugggagaauuuuuugccaucaagcaguggagacucuucucccugccaagucugaaaaggaaguccucuugagagaucacugugugagauacuuccuacugacucagugcccaauccugcccaacacacuucccagagguccuugcagcaggcuguggacuugacugcgauuucugcuaaugagauucucuccugagagauuuggaaggcagaaggaggacagaggccaucauccugggacuguggagccugacaaguaaucuuuuuuuuugagacggagucucacucugucacccaggcuggagugcaguggcgcaaucucggcucacugcaaccuccaccucccggguucaagggauucucccaccucagccucccaaguagcugggacuauaggcaugugccaccacgccuggcuaauuuuuguauuuuuaguagagacgggguuugccauguuggccaggguggucucgaucuccugaccucaggugauccacccaccucggccucccaaagugcugggauuacaggugugagccaccaugcccggccugauccuauuauugcgcuauuuauagccaguaauccuuucuagugugggugugguggcuagacgcuggaguccacuguccgucaccaacuucaggagacugagacaguucaauagcagcagaagcggaauugguuuguugaacucugacggcaacaucggaggagugacccugacuuccacuucuccagcccuuuuacuuuuuuuuguuguuguuuuuugagacagucucauucugcugcccaggcuggagugcaguggcacaauuucaguucaccguaaccucugccucccaggcucaggcaauucuccugccucagccucccuaguagcugggauuacagguaugggcccagcuaauuuuguauuuuuaguagagacaggguuucaccauguuggccaggcuugucuugaacuacuggacucaggugaucugccggccucagccucccaaagugcugggauuauagucaugagcuaccacgcccggccucagcucuuuuaaguacuuuuugccuaaguacuuaaaucucuuuccacuuaaaauauccagaguggguuucuauuuccuagucugaacccuaaaugauacagucagucacuggaaaguucagaacucuaagaacagauacuaaacagaaaggcuuuucagaaagcccuuucauuuuaaacucaagauaacaacaggccaggcaugguagcucacauuuguaaucccagcacuuugggaggccuaggugggaggauugcuugaggccaggaguuugagaucagucagcauaggcaacauagcgaggccccaucuccaacaaaaaaaagaaaauaaaguuuaaaaaaaucaaaauaacauuaagagauaauuaggugucagccaggugcgguggcucaccucuguaauccccgcacuuugggaggcccgagaugggcagaucaccugaggucaggaguucaagaccagccuggccaacagggugaaaccccagcucuacuaaaaauacaaaaauuagccgggcgugguggcaggcgccuguaaucccagcuacuugggaggcugaggcaggggaacggcuugaacccgggaggcagagguugcagugagccaagaucaugccauugcacuccagcuugggcaacaagagugaaccucuaucucaaaaaaaaaaagaaaagaaaagaaauaauuagguguugggaggcugagacagguggaucaccugaggucagaaguucaagaccagccuggccaacaagguagaaccccaucucuacuaaaaauacaaaaacauuagcggggcgugguggcagucaccuguagucccagcuacuugggaggcugaggcaggagaauugcuugaacccaggaggcagaggucgcagugagccgagaaugcaccacugcacuccagccugggugacagagcgagacuccgucucaaaaagaaaaaaaaaaaagagaaauaauuagaugucacuuacucugguuuuugaacccuuaacuagaacugcuucaaagguaugggcacagagaucugugacucccugcccagaugcugucauggaagcagcacacgaaucaggccuguccaugaucaagcagcacuggaugcuucucuuccuuaaauuaucugccugucucuuuuauacuuaggaagacugaugauaauaacaucuucuugcaauuuucccuuucucauuuggggcacagaaagcccaggcaggcuuccucuauuuucuaacagugguaucacauaguagcaagcaagcaaacaucuuuuuuuuuuuuuuuuuuugagauggagucucgcucugucacccaggcuggagugcaguggcacaaucuuggcucacuguaaccuccauccccgggguucaaguguaucuccugccucagccucccaaguagcugggauuacaggcaugcgccaccaugcccggcuaauuuuuguauuuuuaguagagacggguuuucaccauguuggccaggcuggucucgaacuccugaccucagcugauccacccgccucagccucccaaagugcuggcauuacaggcgugagccaccgcgccuggccgcaaacaacuuaaaacauaaugaaagacacagaggggcuaaggaagacccauccuuuggugcugugcucuacagucuuguaguaaccuuccacaggaauggcuuacaacacacgugacaguuuugcaaaucuguauguucacagauguaagcaacauugaaacaugguaaaaacauaagccgcuuagccauuuacacagaacugacaaaguugauuacaccauaaauaccuuagcaccuucagagucucuuuccacuccuucugaagacuuucccauguaucaacuuccacccauuuagaauucuugguagcaaguucugccaugaugacccggugauaggcaggaaugaguccuuucuucuuguaggcaucaccaacaggagagaugaugccuuugacaacuguguaccuuccuagauaaaaaguuagguuucacacuagguauaacaaauuagacuuuaugcacaggaaauauuacgaucaauauuauuuguuuuguuuuguuuuuugagacagagucuugcucuguuccccaggccgcacuggagugaucucggcucacugcaaccuccgccuccuggguugaagcaauucuccugagucagacuccugaguagcugggauuacgggcgcaugccaccaugcugguuaauuuuuguauuuuuaguagagaugggguuuuuaccauguuagccaagcuggucuccaacuccugaccucaagugaucugccugccucagccucccaaagugcugggacuacaggcaugagucaccacaccuggccaauauuguuuuauaaucacagauucucuuucuuuagggauuccagcuuauuagcugaucaauuaacugacugaaauuaugguaaaauauacccaagcguacaguucuaugauauuaacugcaaacaugcuguugugcaaccaucgcuccuaucuaucuccagaauuuucucaucuuccccaacugacacucuguacuucaccucauuccccuauacaguuaaauuucuauugauauugccaaauuacuuuguaaaaagccuuaauuuguauuguccaccuagauguaugcaaaagcccauuucucaaugucauaggcaaauagugagcuuuagcauccauccauccaucuaccuaucagcauauuauaugaucauuuauguaacaaaaaaaucgaggccaggugugguggcucacaccuguuaucccaguguuuugggagaccaaggcaggagaaucacuugagcccaggagcucaacaccaacaugggcaaaacagugggacccaguuucuacaaaaaauuaaaaaauuaggccaggcgcgguggcucacuccuguaaucccagcacuuugggaguucgaggcggguggaucacgaggucaggagaucaagaccauccuggcuaacacggugaaacccugucucuacuaaaaauacaaaaaauuagccaggcaugguggcgggcaccuguaaucccagcuacuccggaggcugaggcaggagaauggugugagccugggaggcggaguuugcagugagcugagaucaugccacugcacuccagccugagcgacagagcaagacucugucuccaaaaaaaaaaaaaaauuagccagaugugguggcaugccuguagucacagcuacucaggagccugaggcaggcagcucacuugaguccgggagguaaaggcugcagugagcugugaucaugccacuguacuccagccugcccagccagggugacagagugagaaccauuuccacaaaaaaaaaaaaaaaucuguguauacacacaaauguuugcauauaaauucauacaaagaagaguggaaggauacacaugaaacuguuaugguuaugcuauguuaugguggcucaugccuguaauuccagcacuuugggaggccgacgugggaggaucacuugagaacaggaguucaagagcagccuggucaacauggugaaaccccauuucuacuaaaaauacaaaaaugggccgggcauggugcugugugccuguaaucccaguuacaggggaggcugaggcaaaagaaucgcuugaauccaggagguggagguugcagugagccaagacugugccacugcacuccagccugggcgacagagcgagacucuguagagucaagguuucgccacauuggccaggcugaucucaaacuccugaccucagguaaucugccccuucugccucucgaagugcugggauuacagguaugugccaccacgcccagccuauucaugcauuuuuuuuuuuuuuuuuuuuuuuuugagauggagucucgcucugucacccaggcuggagugcaguggcgacaucuuggcucacugcaagcuccgccucccagguucacgccauccuccugccucagccucccaaguagcugggacuacaggcacccgccaccaugcccggcuaauuuuuuuguauuuuuaguagagaugggguuucaccguguuagccaggauggucucaaucuccugaccuugugaucugccugccuuggccucccaaagugcugggauuccaggaguaagccaccacgcccagccucaugcauuguuuaugaaaacuuuuagcuggguaugguagcucaugccugugaucccagcacuuugggaagccugagguugggaguuugagaccagccugaccaacauggagaaaccccgucgcuacuaaaaauauaaaaaauuagccgggcgugguggcacauuccuguaaucccagcuacucaggagggugaggcaggagaauugcuugaacccaggagguggagguugcagugagccgagaucgcgccacugcacuccagccugggcaacaagagugaaguccaucucaaaaaaaagaaagaaagaaagaaaaaagaaaacuuuuaaaaagcugugccugauccuagagguuuuauguaugcuaaaguacaagcuuucgcuuuuugccuuaaguaaugggaaacuccuaaagaagauuaagcacaggcaugacagaaucaaauuccuuuuuuuggggagggguggucagggucuugcucugauguccaggcuggugggcaaaggugcaaucauggcucacgguagccuagaccucccgggcucaagcaauccuccuacuucagucuccugaguagcugggaccacaggcacaugccaccauaccuggcuaauguuuacaauuuuuuuuguagagaugaggucucucucuguuucccagguuggucucaaacuccuggccucaagugauccucccaccucggccucccaaagcacugggauuacaggugugagccacuguaccuggcuguauuuucuauucuacaggccauagccagaugcucaauucuucccucauacuucacccucuuuuuuggcuaagaauucacuguacaagggagcaggacagcauguuugugcccagucaaugaaauguguauucugaaacagacccagucaugccgguucucuaguauuuuuuuuuuuuuuugagauggugucuugcucugucuccaggcuggagugcagugcagcaaucucagcucacugcaaccuccgccucccggguucaagcgauucuacugccucagccucccgaguagcuaggacuacaggcacagugaauuuucguauuuuuuaguagagacaggguuuuaccauguuggcuaggauggucucgaucucuugaccuugugaucugcccgucucagccucccaaaaugcugggauugcaggugugagccacugcacccggcugguucucuagucuuaagccacuuuugguuacugcuccuaccuguuccauucauguaguccuuggccagcucaaacaaccugaggugcauguuggugaugggauugaaugaaccacaagcaaggagaaccacuucagucuucucggaauuuuccaugguaagaacuugaaguuguugaucuaaauggaaaacugugacaccucccuuguugucuacaaaggaaaaagaaaauaaauucaguuaugcauuuuuuuuucccuaagauaaggucuugcucugccacccuggcuagaguguagugaugcaaccacagcugacugcacccucaaacuucugggcucaagugaugcucccaccucagccucucaaguagcugggaacacaggcacauaccaauaggcuggcuaauuauuuuaaagacuaauuuuuguagagaugggggucuugcuauguugcccaggcugcucucagacuacuggucucaagcaacccuuccaccucagucucucaaagugcugggauuacaagcaugagucaccacgcccagcccaguuauaggucuuuugauguccuuccacauucucauucccaauagauggauuaaaaguauuuggcuuuggcugggcgugguggcucacacauguaaucccagcacuuugggaggcuggggcggguggaucaugaggucaagagaucaagaccauccuggccaacaugguaaaaccucgucuuuacaaaaaauacaaaaauuagcuggguguggugacaggcaccuguaaucccagcuacuugggaggcugaggcaggagaaucacuugaacccaggaggcggagguugcagugagccgagacugugccacugcacuccagccuggcgacagagagagacuccaucucaaaaagaaaaaaaaaauuggcuucaaucauuaugcuaacucuaaaaauguuuccacaucuccaucccuccuuuucaaugugaaucugcaacuucuaccaugaagagauggaagugacuucuccacauuuuuugacuugcuuugggcaaaagaauguggcacaaguguuaguguggaggaugccagaacaugugggagagcaccgaugcucccacugauagacaaccaccccacauguggggaacauagccauccccgaccagccaacuacaguccaucugcucagacacauaagcaaacccaagugagaucaaccaaaccuggcucagaucgucaagccaacaagcugacccuagucucaaaaacaaaaaauuaguguucauuaucauaugucacucaaguuuugugauugcacuauuguggccacaguuaauuaauacaacaauauuaucaucuaccaaauacagcauuuuugccuuuuagucaacaugauaguaacaucauaacuuuccacuaaauaauagaauauaauuuacaaaccucuuuuucauaucaguuauuccacugauccuuccauaacccuaaugaaguaacauaaggcauccaauuuuagguuuuuauuaaaauuucuuuuuuuuuuuuuugagacgggagucucacucuguugcccaggcuggagugcauuggcgcgaucucagcucacugcaagcuccgccucccagguucacaccauucuucugccucagccucccgaguagcugggauuacaggugccugccaccacaccugccuaauuuuuuguauuuuuaguagagacgggguuucaucauguuagauggucuucaucuccugaccuugugauccgccugccucagcuucccaaagugcugggauuacaggcgugagccacugcgccuggccuaaaauuucuuauucaacuaauucauauauauagaucuagaacaucacaggguaaaaaaggcccuuaaugaaaaccaacagccaucaaucauauuccacucaucaucccuuccauccaaccacuuuuaacuuuuucagcuauuucuucugguaguuucuaccauaacucuacauuaugugcuuauaaugccauuucuuaauuuauccaacuauaacagugcccauugacuuuaugaucuauaaagauuagcccucauacccuuugacuaccuucucccaaacugcccaauauaguuuaucuccagacuauguugaaaaucaucuucucucacaacuucaaaggcauuacuucuagauuccaauguuaauagcaugaaauccaaagccacuucuaauuccggagcuuuugaaugucauuuuuuuccugucuugaagcauguaaggucuucucuuuguccgcaguguucugaaauuucacagugcuguccucuagugcagcuuuguuucuauccaucaugcugagcacagggcaagcagguccuuucagucuggaaacuuguaacauucaguucuagaaaauguccuugaguucuuucauugaugauuuucugccucccauuuuaucuguucuuuugaaaugucuauuauuuauuuauuuuuuugagacagagucucccucucucacccaggcuggagugcaguggcacgaucucagcucacugcaaccuccaccucccagguucaagcaauucuccugccucagccucccaaguagcugggacuacaggcaugcaccaccacacccagauaacuuuugaauuuuuaguagagauggguuucaccauguuagcuaggcuggucucgaacuccuggccucaagugauccacccaccucagccgcccaugaaccacugugccuggccugaaaaugucuauuauuuagagcugaagcaucuaaucauuuuuucuguauuuuccaccuccugccuucaugcucuaauuuccugauagccucaacuucauccuccaaucugccuaguuuucacuucugccauuacacucuuaauuuccaagagcccuauccucugaauacuccuguuuaugguauucuacucauuuccccaacagauuaucaucucuauuucucuaccaauauucaugauauauuuuaaaguuucuucaaaaagagcugaugggacaggcugaguggguagguagggcuugugcacaggggccauaacuguucaguaaccugucaguaccgcaggucuuuuugcuuggauuagucagacucuacaagaaaguauccuacaauuucccgccuauauaacagaagaguuaagagccuaugcucugauauuaggcugccuggcuucaaauugcagcuccaacggcaugaccuugggcaaccuaacccuaacuuaaccuuccuuuugugccagguuuuuucuuuggcuuuuuuuuuuuuuuuuugagacagagucucgcucugucacccaggcuggggugcagugguacgaucucagcucacugcaaccucugccuuccagguucaagcaauccucccugcuucagccucccaaguagcugggauuacaggcacgugccaccacaccuggcuaauuuuuuuuuuuuuuuuuuugagacagagucucgcccugucgcccaggcuggagugcaguggcaugaucucgacucacugcaagcuccgccuacuggguucaugccauucuccugccucagccucccgaguagcugggacuauaggugcccgccaccacuccuggcuaauuauuuuuuguauuuuuaguacagacgggguuucaccauguuagccaggauggucuugaucuccugaccuuaagugauccaccugccucggccucccagaguauuggcauuacaggcaugagccacagugcccaccuugucccaguuuuuaaucaaucuuaaaaaggagaaaauaauacuaccuaccuccugauuguugugaggauuaaaugaaacaauacagauccaagacauagaacuacauuuggcaggccaggcgcggcggcucacgccuguaaucccagcacuuugggaggccaagaugggcagaucacgaggucaggagaucgagaccacccuggcuaacauggugaaaccccaucucuacuaaaaacacaaaaaaauuagccaggcgugguggcgggcaccuguagucccagcuacucgggaggcugaggcaggagaacggcgugaacccaggaggcggagcuugcagcaagccaagaucgugccacugcacuccagccugggcaacagagcgagacuccaucucaaaaaaaaacaaaaaaaaaaacuacauuuggcaaauagcaaacaugcuaugaauauagcuauuaugaauguugcaaauuauguuacuagaauugucuuuuguuuuuugauuuuugagacaguaucucacucuguuguccaggcuggaguacagugguacaaucucagcucacugcaaccuccaucucccaggcucaagugauccuucgaccucagccucccaagcagcugggacuacaggcaugcacuggcuaauuguuuuuuuguauuuuuuguagagaugggguuuugccauauugcccaggcuggucucaaacuccugggcucagaaucucgaagcgaaccuguccacuuuggccaauuccaaagugcugggcuuacagguaugagccacugugcucagcaagcaauuuuuuuuuuaaucaacaaaacaucaauuucaaaugguuuaauuuacaauugcuauucuauucaaucuguuuuuuucccagaggauuuucuuucuggaacucuccuccucuuauccagaugaaaaaucucuauuugugaagcuauuauucugaaaacuucuucaucucuuuccuggguuagauccccuauuuauuucucgcuuugcuuucuaaucuuucuggagcguauccucaagcguuucaugauaaaggguugaucucucauacacccuuuaucaugaaacuacuugagaauaugcuccaguaggauucgugggagaucaaguaaguuugauaggcgcaugggagaucaaguaaguucgacgauguuguuauucuuccuucaauuauuaauggcuugagaaaauucuuuucaacucaauaauuucaaauaauuuuuuuuuugcggggagccggggggacuuaguuucacucugucacccaggcuggagugcaguggaaagaucuuggcucacugcaaccucugccucccagguuuaagcaauucuccugccucacccuccugaguagcugggauuauagaugccugccaacaugcccagcuaauuuuuguauuuuuaguagacacaggguuucaccacuuuggccagguuggucuugaacuccugaccucaggugaucugcccgccacggccuuuuaaaguguugggauuacaggcucgagccacugugcccagcccaaauaauuuuugaaauuauucuuuuaagauuauaaaggcacuucuucauuguuugcuggcauucaacauugcuguugaaagucugaggucauucuaauccuuguuccuuuauguguaaccugcuuuuacuuucuagaagauguguaguauauuaucuuaucccuaguacucuggaaugcccagugaugacaguaucuuuuucauucauuguacagaaccuuuuaaaugcugccuacuaguuuucaacaaguuaaaaaaauaacuuugcuauuguaaagguuuucaaauaaauauuuguauauaauuauauauacauacuuuuuuuuuugagacuaagucucacucugcugcucaggcuggagugcaguggcaaaaucuuggcucacugcaauuuccaucuccuggguucaagcgauucuccugccucagccuccugaguagcuaagaauacaggugccugccaccaugcccagcuaauuuuuguauuuuuaguagagaugggguuucaccauguuggcuaggcuggucuugaacuccugaccucaggugaucugccugccucagccucccacagcguugggauuacaggcgugagccaccgcgcccggucaauaauauuuauaaauaauuucuuucuguuuugagauggagucucccucuguugcccacgguggagugcaguggcacgaucucagcucacugcagccucugccucccagguuacagugauucuccugccucagccucccaaguagcugggacuacaggcaugccccaccaugccuggcuaauuuucguauuuuugguagagacgggguuucaccauguuggccaggcuggucucaaacuccuaaccucaagugaucugacugcuucagccucccgaaguguugagauuacaggcgugagccaccgugcccagccaaauacuucugaauaaaauuuuuuuuuuugagaaaggaucucgguguguugcccaggcuggaguccaauggcaugaucacaggucacugcagccucugccuccuaggcucaaaugaucuuccugccucagccuccaaguagcugggaccacaagcacaugccaccacaccuggcuauauuuuuuaaaucuuuugcagagacagggucucacuauguugucaaggugggucucagauuccuggccuccugccucagccucucaaagggauuacaggcaugagcuacugugcuuggacuucaaaauaaauauucuuggccaggugcgguugcucacaccuguaaucccagcacuuugggaggucaaagcagagagaucgcuugaggucaggaguucaagaccagcuugaccaacauggugaaaccccaucucuaccaaaaauacaaaaauuagcgagugugguggcgcacacauguaaucccagguacuugggaggcugaggcaggagaaucacuugaaccuggcaggcagggguugcagugagccgagacugcaccacugcacuccagccugggugacagagcgagacucugucucaaaauaacaacaauaauauaaaaauuaaaaaguaauaaauauucuuauauauccaaagaaugucuuaaaaauaaucauucugagaucuuuuuuuuuuuuuuuuuuugagauggagucucgcucuguugccaagcuggagugcaguggcacaaucucagcucacugcaaccuccgccuccuggguucaagcgauucuccugccucagccuccugagcaucugggacuacaggcccacgccaccacacccagcuaauuuuuguauuuuuaguagagacaggguuucaccauguucgccaggauggucuugaucucuugaccuggugauccacccgccucggccucccaaagugcuggaauuacaggcaugagccaacacaccuggcccugagaucuuauaaauauaauuccagugacauaaucuugcucaaaguauuuucaaaacuuuggggaauuuuuuguagagcuugaagcuuuuuuuuuuuuuuuuuuuugucgcccagguuggagugcaguggcacaaucuuggcucacugcaaccucuaccucccuggcucaagugauucuccugccucagccucccgaguagcugggacuacaggugugcgucaccaugcuggccaauuuuuuguauuuuuaguagagaugggguuucaccguguuagcccaggauggucuugaucuccugaccucaugauccgccugccucggcuucccaaaaugcuggaauuagaggcaugagccaccgugccuggccgcuugaagcauuuuuauaauuaacauagaaauauagcaaaugacaauaaacacaucaauaguuauaugcuacuuuugguuuacaaaaacaaaaguauagaauacuuuuauuuuuucuuuuugagacggggucuuguucugucacccaggcugggaaagcugggagguuuagcuugaacauggcucacugcagccacgaucuccugggcucaaggauccuccugccucagcuacucguguagcugggacugcaggcacacaucaccacacccagcuuaucuuucuauuuuuuuguagagaaggagucucauuuuguugcccaggcucugcuucccacuuugggaaguggaggugggaggauugcuugagcccaggauuucaagaccaagggcucaagugauccucccaccuacacuucucaaagugcugggauuacaggugugaaccaccacaccuggcuuuauaaaaauacuuucggcccggugugguagcucacaccuguaaucccugcacuuugggaggccgagguaggugggucacuugaggccaggaguuugagaccagccuggccaacauggugaaaucccaucccuaccaaaaguauaaaaauuagccaggugugguggcuggugccuguaaucccagcuacuugggaggcugaggcacaagaauuacuugaacccaggaggcagagguugcagugagcugagaucacgccucagcacuccagccugagugauagggugagacucugucucaaaaauaaaauaaaauaaaauaaaauucauacacauugucauuugauucucacugcaaaaaaauaacuuggccaaaagcaauuagcauguuccaaaugauaaucuauaguuaauucaguuuuuccaguuaaucuucgaccuuuggauauuuagguuuuucuaauuuuucacuauuacaaacaucucaaaaaagaaauaaugggggccagaugcgguggcucacgccuguaaucccagcacuuugggaggcugaggugggcggaucacgaggucagaaguucgagaccagccuggccaacauggugaaaccgucucuacuaaaaaauacaaaaauucgcugggcgugguggugugcgccuguaaucccagguacucgggaggcugaggcaggauaauuguuugaacccgggagauggagguugcagugagccuagauugugccacugcacuccagacugggggacacagcaagacgccaucuuggaaaaaaaaaaaaagaaauaguggguuaaaaauaaaucuggaaauuaaggcuaugcaaugccucacuguguacaucuaagacuuggcaauacugaaaacaccugugucaagacuguucauuuguagcccaauaguagucagacauaacugcuaggcugaccaacuugcuuuuguucagauuuuaugcugucaguggacaaagcuagugaauggcacaucaggacuagaauuuagguuuccugacucuuaagcucucucaccaagaagaaaaaugggagauaaacuggaacaguguagauuggaauugagcccucucauagcuaaggaguugagaaauauaaacuuuaaccccuuggacaaugggaaccuuugaagguuucugagcaaaggagugacaacaggguucucaaaauaauaugacauggguguuaaaaacccuuauuuggggccaggcacgguggcucacaccuguaaucccagcacuuugggaggccgagacgggcggaucacgaggucaggagaucgagaccauccuggcuaaaacggugaaacccugucucuacuaaaaauacaaaaaauuagccggguguguuggcaggcaccuguagucccagcuacucgggaggcugaggcgggagaauggcgugaacccgggaggcggagcuugcagugagccgagaucgcgccacugcacuccagccugggcuacagagcaagacuccgucucaaaaaaaaaaaaaaaaaaaaaacccuuauuugguugugugaucuugauuugaucucuuaacucuguuuuuagguucuuuaucuguaaaauggagauaaugagaaggccaaucucaguuacuuugaggauuaauucugaggauaaacauggcaaggggcuuagcauauugccuggcacaguguuaaaaugaaugguagcuguuauuuuuuuuuuuuuuucagacggagucucgcucugucgcccaggcuggagugcaguggcgcgaucucggcucacugcaagcuccgccucccggguucacgccauucuccugccucagccucccaaguagcugggacugcaggcgcccaccacuacgccgggcuaauuuuuuguauuuuuaguagagacgggguuucaccauguuagccaggauggucucaaucuccugaccucgugauccgccugccucagccuccaaaagugcugggauuauaggcgugagccaccgcgcccggcggcagcuguuauuuuugaggaaagugauguuacugaugacagugaugauuuggaauucauuggacgggaugaaacaagauaggaaaagcagccacaaauagucaguggaaauggaaguaagaaagauacuugggguccgggcgcgguaggucaugccuguaaucccagcauuuugggagggcgaggcagguggaucaccugugguugggaguucgagacuagccugaccaacauggagaaaccccgucucuacuaaaaauacaaaauuagccagguaugguggcacaugcccauaaucccagcuacuugggaggcugaggcagaacuacuugaaccugggagguggagguugcggcgagccgagaucaugccauugcacuccaaccugggcaacaagagcaaaacuccgucucaaaaaauauauauauacuuggggccuucucgaaagaaggcacaguggugggaucacagggacacugcuaacuguucuuagggaauaacggagaagguucaguaguagucacuagggcauuagaaaaaaaugaguucaucacuaagaaugauuuaaaugucuuaccuuucaguuaccaucaaaaguaucauaccaugauucacuuggggcuuguacccauacccuuuaucccuaccccaggcccucgauacccauaaaaacuaccagugguauuaugggagggggugaugaaugcgacaugcccauaguacccugaggccuacagagaaaucaggguauccaccagccacugagcaugcucucaaagacugguggaggggcuggguucagcuggcaccagacagacagcuggcgucagacaaccccgcccaucucagguuucaguuacuauucccaagagagagauggaagaaggguaaggcugaguucgagagguguggguccucaagggagcugcugcaguucugaagcagacuucagggaaggauggaacaaacagcuuuuagcccuacacuuggggauaagcuuagguuuccaggugaugcccaagggauguggaagggcuggaggaagcugaucucucagcauaaaggaagcugucuuucucccuuguuacaucuauaacuugucucaaauauccagcucacaguuccacuaacuguuaacaaagccaacucgagcucacaccagacucuaaaccuucagagccacacaagaguuaagguuacagugagcuccuauugcugccaaaaguggguuuuaaagaacuagggucugucccuuuccugaagaguacuuccuccauaucauugcagggcacaugcgcaugcguauaggggggcuguggccgauugaugaaugggugcagcaguuuggaaacucuaacgggacugaccuggguccuccuugucuugcuccaggugcucugggcccagugucaccaugauucacuuuuguuuggcccacacggccuaucgcuugcacugcuggcugcugagaacucaccagcucaggcuguaagugucccuccucagcucacugugacaauaaggaguucauuucuuucucuggcagucuugaggcuuaaaauuuacuuuuaauuuuaaaauuacuaaucuugggcuggguacaguggcacguggcuguagucccagccacucgggaggcugaaauugagccacugcguuuuggccuggguaguuacugaucuuuauuauuauuauuauuuuugguagagauggggucucgcuguguugcccaggcuggugucaaacuccuggccucaagugauccucccaccuuggccucccacggugcugggauuagaggcaugagccaccacaccuggccaaaauaacugaucuuuauguuuuaaaaacacugagauguaaauauuaacauaacauuaagccaggguuuuuuuguuuuuguuuuuguuuuuuuuagagauaggguaucgcucuguugccuaggcugcaguacaguggcacaaucauugcucacugcagccuucaaaucccaggcucaagagauccucccaccucagccugccaaguagcuaguacuacaagcacacgccaucacuccuggcuaaaaagucaguuuuuuaaaaaucaacuuuucgaaaacaauaguaauucuguuuggcuuucccuaucgcauauuucaggaugcucaguauuaaaccuguguuggcuaagaguuaaguaacauggcugaccucaccaccucucaggauuuacaccucuaaaagggugcuauuccuuucaaaacaauaacuuuaagcauguagcuauguucuuguuccaacaaugcugccauuaaauacucuuggggguauauuuugaaauugcauauucuuuugaguaccuucacuggggauaaaucugucuuuggaggguauauuugauuucugugaauccccuaaaguuauucagugcuaaacccaauuaauaaaauaaucaaggugaauuuaauaguuuacagugaagaagggaguuagaaugauuaguuaauggugagauuuucuuucuuuucuuuuuuugguggggggacagagucucguugucgccaggcuggagugcaguggcgugcaaucuuggcucacugcaaccuccaccucccagguucaagccauucuccugccucagccuccugaguagcugggauuacaggcgcaugccaccacgcccagcuaauuuuuguauuuuuaguagagaugggguuucaccauauuggucaugcuggucuugaacuccugaccucaugaucugccuacuuuggccucccaaagugcuaggauuauaggcgugagucaccgcacccggccucuuuuuuuuuuuuuuuuuuuuuuuuuccaagauggaguuucacucuuguccccuggcuguagugcaauggcacgaucucagcucacugcaaccucugccucccggguucaagcgauucuucugcuucagccuccugaguagcugggauuacaggcgcccgccaccacacccagcuaauuuuuguauuuuuaguagagaugggguuucaguaugcuggccaggcuggucucaaacucccgaucucaggugauccaccugccucggcuucccaaagugcugggauuacaggcuuaagccacugugcccgaccaagauuuucuuacaugccauggaaacuacguacacguaaucucaaaagaauuucaaaaaugcuuugagcaguaacaauuuucauuugcuugugcaaguugugguagguagauuaacucucaguuugucaguuaacagucaguuuccucauuuaaaaaaauggagaaccacaguccuaugucauaggauuuugugcauauuaaauuagauaaugcauguaaaauguuugacacauuugucuaccaauuaugaauauugauaacuuaguauuacuugcagguuguuuuacauuaauuuacagucaugauaaaggaaccaagguucuaaagauucccuaaagaucaguaucaacaggcugggagcaguggcucacaccucuaaucccaguacuuugggagacagaggugggcggaucacgaggucaggaauucaagaccaaccugaucagcauggugaaaccccaucucuacuaaaaauacaaaaauuagucgggcaugguggugugcuucuguagucccagauacucaggaggcugaggcaggagaauugcuugaacccaggaggcagagguugcagugagcugagaucacaccacugcacuccagccugggugacagagcaagacucugucucaaaaaaaaaaaaaacaaaacaaaacaaaaaaucaguaucaacaaagccugcuaaauaaugggagaacaauaaguaguagcuauuuuaauauucuuauugaaguauuauuagauagaauuuuauuagaaugcaauggaucucaauucaaucagaaacaccaucucuacuaaaaacacaaaauaucauuauguuuaaaacuuuaucucuguaguuaaauguaacauuaucaccaaacagaaccugaauuuguuuucuggaagcuauuucaucacuaaacgaguaauguaaaauguuaauugcagccugccccauguuuucugccccuauuaccaagggcaaucaccuacuucacuucuuugaaaagccaaaaaucucaauauagugaagauagcuguggguaaacugagcuuaacuuuuaauccacacuuacuucuucugguauagaaagccauuaaauaggagacaaugaggggaccaaugucucaacuuacagauucccuggagaccagucccaacggucuagcguuagcuuaugucugcagggcugagggugacaggcacgcccgaccugauuauuacuuaauauguucuuucagauucugucuucgaaauuauucuuagcggaaacagucuguuaauaacuuuaauucuaaaaaaaaaucugaaaacugagaaucuacuuaagcgagggggagugacaggaagcugcaacacuccuuguaauuagccgaacucaaacucaccagcuucuauuacagaaagucuguguaaaauaagucauuuuuccuuacuagaagucagaauucccaugaaauaguuuuucaccaaaaucgcaaauuaacgugaauuuaaaaacugguaaauaagggcugggcacgguggcucacaccuguaaucccagcacuuugggaagccgaggcguggaucacgaggucaauaguucgagaccagccuggccaacauggugaagcccacucucgcgugguggcgcaugccuguaauccagcuacucgggaggcucaggaaggagaauugcuugaacccgggagguggagguuacagugagccaagaucgcggcacugcaagaaacagagugagacugcgucucaaaaaaaaaaugguaaacaagacugggcacgguggcucacaccuguaaucccagcacuuugggaggcugaggugggcggaucaccugagguugggagugugagaccagccugaccaacauggagaaacccugucuguacuaaaaauacaaaauuagccugacaugcugguacauuccuguaaucccagcuacucaggaggcugaggcaggggaauugcuugaaccugggaggcagagguugcagugaguugauaucccaccauugaacuccagccugggugacaagagcgaaacuccaccucaaaaauaaaaauaaaaaggccagaugcaauggcucaugccuguaaucuuagcauuuugggaggccgaggcggguggaucacaagaucaggaguuugagaccagcaugaccaacauggugaaaccccaucucaacuaaaaauacaaaaauuauccaggcaugguggcaugugccugcaauccuagauacugaggaggcugaggcaggagaaucgcuugaaccucggagguggagguugcagugagccaagaucacaccauuacauuccagccugggugacagagcgagacucugucucaaaaaaaaaaaaaaaaaagguaaacaaggccaggaucaguggcucaugccuguaauccaagcacuuugggaggccaaggugggcggaucaccugaggucaggaguucgagaccagcuuggacaacaugaugaaaccccaucucuacuaaaaaugcaaaauauuagccaggugugguggcacacgccuguaauccuagcuacucaggaagcugaggcaugagaaucgcuugaacccaggagguggagguugcagugagcugagaucauacaacugcacuccagcuucagugacagaacaagacucugucucaaaaaaaaaaaaaaaaaaagguagaccaaucacuugaggucagggguucgagaucagcauggccaacaugaugaaaccccaucucuaccaaaaaauacaaaagcuagccgggugugguggcacgugccuguaaucccagcuacugggaaggcagaggcccaagaauugccugaaccugggaggcagagguugcagugagcagagaucgcaccacugcaguccagccugggugacaaaguaaaacucugucucaaaaaaaaaaaaaaaaagaaaagaaacaugguaaacguuauuuauuuaccagugaugacacuaauaacucuuacuauuauuuauggacuauuuuguagcauuuauuuacagucaugguaaaggaaccaagguucucaagagaagugaguugccuacagccaagaugaacccagugccagaauaagaauuagaguucaaggauuagugccuucugguguuacgcguauaccauagauuuccuguaauaaguaauaaauuaauguaucacccaguuuauugacuuuuaggcccagaucuucccaauauugcagccaaucucuccuguacaaccugguuaguaauaccaucuuuaccuucuucacaauugguaaguguguaguuauccgucaagcauuuauuaaguaucuacuacaaauaguagccagacacugcuacaacaaaaauugguaggacagagcucucugcucuucaggaacucauagacuaaaauuaaaaaaacaacucacaucuaaaauucaggugaagggaaucuuuaaaaacuuccuaaguaucucuuuuaguuguuuuugcuuuuuguuuuuugagauggaguuucacucuuuuugcccaggcuggagggcaauggugcaaucucggcucacugcaaccucugccucccaaguucaagugauucuccugccucagccucccuaguagcugcaauuacaggcaugcgccaccacacccagcuaauuuuguauuuuuaguagagaagggguuucuuucuuuuuuuuuuuuuuuuuuugagacaaagucucgcucuuguccccaggcuggagugcaauggcgcgaucccagcucacugcaaccuccgccucccggguucaagcgauucuccugccucagccucccgaguagcugggauuacaggugcauaccaccacgcccagcuaauuuuuuguauuuuaaguagagaugagguuucaccauguuggccaggcuggucucaaacuccugaccucaggugauccaccagccucagccuuccaaagugcugggauuacaggcgugagccaccgcgcccagcuuagagaugggguuucaccauguuggucaggcuggucucaaaguccugaccucaggugauccaccugccucagccucccaaagugcugggauuacaggcgugagccagcgugccuggccucucuuuuaguuguucuauaauuugaguacggaaccaaauuaaguuaaacauaaauuccuuuuuuuuuuuuuugagauggagucuugcucuguugccaggcuggagugcaguggugugaucucggcucacugcaaccuccgccuccuggguucaagcgauucucgugccucagccuccugaguagcugggauuacaggcacgcgccaccacacgaaccuaauguuuguauuuuuaguagagauggggugucaccauguuggccaggauggucucaaucuccugaccuugugauccacccaccucagacucccaaagugcuggaauuacaggcaugagccaccaugccuggcccaaauuccuucugcuauaaaauucuuuaguguuauaauauuaaaguaucggguuuuucauucaauaaauagucauugaucaagagaugauucugcguagaaaaacaaggacaauggcaacuugaagucaaaaagugauacagggcuggguccaguggcucaugccuguaaccccaacacuuugaggcugaggugggaggaucgugugaagucaggaguucaagaccagccugggcaacauggugagacaucaucucuacaaaaaauagaagaaguuagcugggcauggugucaugcaccuguagucccugcuacuugggagguugaaguaagagggucacuaaagcccaggagguggagggugcagugagucaugucauugcacuccagccugggugacagagggaggcccuaucuccaaaaaaaaaggacacagaguuggucucuauucucaacauucugaaauguggagaaguuuaagaaauauuuuagcuaaucuaucuuaauuauauuuuccuuugaaugugcuuuuaagagugauguaugggccgggugcgguggcucaugccuguaaucccagcacuuugggaggccgaggcagguggaucaccugagaucaggaguucaagaccagccuggccaacauggcaaaaccccuucucuacuaaaaauacaaaaauuagcugggcaugauggcacgugccuguagucccagcuacgauggggacuguggcaggaggaucgcuugaaccugggaggcggagguugcagugagccaagaucgugccacugcacuccagccugggcaagagagcaagacucugucucaaaaaaaaaaaaaaaaaaaaaaaaaagagugauauaugauuucagcaaaaacuauguccgaauuuuuuaaaaugaaaaaauagggccgggugugguggcucaugccugcaaucccagcacuuugggaggccaagacagauggaucaccugaggucacgaguuugagaccagccuggccaacauggugaaacucugucucuacuaaaaauacaaaaauuagcugagcgugguggcacacgccuguagucccagcuacuugggaggcugaggcaggagaaucacuugaacccgggaggcagagguugcagucagccgagaucaugccacugcauucuagccuggcaacagagugagacuccgucucaaaaaaaaaaacaaaauuagcugggugugguggugcaggccuguaaucccagcuacucaggaggcuggagcaggagaaucacuugagccugggaggcagaggaugcagugagcugagauggcgccacuguacuccagccuggcaacagagcaagacuccgucucaaaaaaaaaaaaaaaaagcccgcgcacaguggcucacaccuguaaucccauuuugggaggcugagguggguggaucacaaggacaggagaucgagaccauccuggauaaugcagugaaaccccgucucuacuaaaaauacaaaaaaaauuagccaggcgugguggcgggcaccuguaguuccagcuacucgggaggcugaggccggagaauugcuugaaccuaggaggcagagguugcagugagucaagaucacgucacugcacuuccaccugggcgacagagcaagacuccgucucaaaaaaaaaaaacaugcauacaaucuauaucaaaggaaaaauuaguuugcccagacuggacauuucuguuccacagcaggaagggaaggaaacaaauugcauuuagguuugcauucaagaaucuguuucuagccgagcgugguggcucaaauauguuucuagccgagcgugguggcucacgccuauaaucccagcacuuugggaggccaaggugggcagaucaccugaggucaggaguucgagaccagccuggccaacauggugaaacccugucucuacuaaaaauacaaaaaauuacccagaagugguggugcacaccuauaaucccaccuacuagggaggcugaggcaggagaaucacuugaacccaggaggcagaggucaccgugagcugagauugugccacugcacuccagccugggugacagagugagacucugucuuaagaaaaaaaaacaaaaaaacaaagaauauguuucuuucugagaugauuaaaccuaaaaacugaugcuguuccucugucuuuuuagguuuuacugugcaguuuguucagauggagccauugccacgggcacugaaguggaugucuucugcauuuggugugggauccuucaguuaaggagucugcacuaugguguuaacaguuuuggcaacagacuguguauguuuuuaaacaaugaauuucuuuuuuuuucuuugagacagagucucacucugucaccccagcuggagugcaguggcgcaaucugugcuuacugcaagcuccgccucccagguucacgccauucucccgccucagccucccgaguagcuaggacuacaggugcccgccaccaugcccggcuaauuuuuuguauuuuuuuuuaguagagaugggguuucacuguguuagccaggauggucuggaucucccgaccucgugauccacccaccucggccucccaaagugcugggauuacaggcgugagccauaaacaaagaauuucuaaaggcuuaucuuaaucugaaaguuuggcuguaaauaauaugucuucaauauuuauuuucuacugacaccaaaagaagagauauguggagauggaauaccugauuaggcacaugucacaguuaaaacauuucacuggggaaaguuuaaaaauucuacaagagauuuuuguuuuuguaggugaauucuacuuuacuagagcuucgaaaaguaguuaagauauuaaucaacagugaaacaggccgggcacaguggcucacgccucuaaucccaguacuuuggaaggcugaggcaggcagaucgauugagcccaggagaugaagaccagcauaggcaauguggagaaaccccaucucuacaaaaauuacaaaaauuagcuggaccugguggcacgugccuguagucccagcuacuugggaggcugaggcaggaggaucccgugaacccaggaagucaaggcuccagugagccaugcucacaccacugcacuuuggccuggaugacaaagcaacaucuugccucaaaacaaacaaacaacaacaacaacaacaaaaaaaaacugaagcuguuggauuggguuuggcacaguauacagcaagacuucuauuucuugcuaaauuggcaccuucauuuaaauccuuguggcaaaacauuuuuaacacauucugauuaaaagacaaaguauuccucauagcaccuuuucucucucaaauguaggaaacaacaaccccugaacuuuacuacuugucugugcuccugucggugagcagcuuaacuucuacagguaagcaagaaaacuucccaaguaaccaauccuugucaaaggcuuaccaguccuucgaggcaaguaacuacucaaccagcacugugacugugauguugcaaggagaauauuaagcucuaguuccucuuuuuuuuuuuuuuuugaaacagagucucacuuuguugcuuaagcuggagugcaguggcgugaucuuggcucacugcaaccuccuccuccuggauuaaagcaauucuucugccucagccuccccaguagcuggaauuaaaggugugugccacuaugccuggauaauuuugguauuuuuaguagagaugggguuucgccauguuggccaggcuagucuugaacuccugaccucaacugauccacccgucucagccucccaaagugcugggauuauagcugugaaccacugugcccacacccuaguuccucuuaaagcaagagauccaagaagcuaagaaguaugaaaagcaaagcaaagaaaacggggggaggggaggguuaggauggcauaugaaaagccauccuucucacguuacuuccacugcauuuaaugagauccuauucuuuauccuguagugcuuuugucaggccuggggcugaucuggcgggccagggugaccugucgaaggccagaugcuaacccaacagucugagccaucuggguccuguuuuuccugucugagauacucgucucuaccaggcugggccugucccagcagcacugccaccuaucggccaucacacgaccaucuccuauccugcuauuucagcugaacagcagggccaauaacaggaagcaugucaaaaucagucauuuaguagaaaacugcauuaugccaggcguggugguucaugccuauaaucucaacacuuugggaggccaaggcgggcggaucacuugaggucaggaguucgagaucagccugaccaacaugucaaaacccugucacuacuaaaaauacaaaaauuagccgggcaugguugcaggugccuguaaucccaccuacuugggaggcugaggcaggagaaucacuugaacccgggaggcagagguuguagugagccgagauugcgucacugcccuccagccugggugacagagcgagacucugucucaaaagaaagaaaaagaaagcugcauuuaaguauuaaugagcacucacugacaauggauaaaaagaaacaguuccgcugaaaucacaggacugacaucauaacccaauucaccccaaauaaagaucuccuaucaaauacuuucacaaugauuauugugauuuucuaaaccucauuuuuuguucaaugaaguuaaguggcaucagcugggagacugcuauagaaauaagugcugaaaaagaggaaggaaaauagaaaucuuaguaaugaacaaagguuuaguuucaaaagaccccaguaauucagauuguguauuuaaacaaggucaauuuauugcuucuuuaagaauguaguggggccggacacgguggcucaugccuguaaucccagcacuuugagaggccgaggugggcgaaucacuugaagucaggaguuugagacuagccuugccaacauggugaaacuccgucuccacuaaaaaaaacaaaaaaauuauauauauacacauacauauauauauauacacacacaaaaauuagcugggccucuugguguguaccuauaauccuagcuacucgggaggcugaggcaggagaaucgcuugaacccaggagguggagguugcagugagcaaagauugcaccacugcacuccagccugggugacagagugaaacuccaucucaaaaaaaaaaaaaaaaagcaguggaagauuuuagaguaaaaauaaccacaaccucccccuuauagauuauaacaaucuucugcaucaugacagcuaauuguuuucuagagaaaauagcuaagugaccugcauuguguuuugucuuucucuuuuuuuuuuuugagacagaguccuggucuguugcccaggccggagugcaguggugugauuucggcucgcugaaaucuccgccuccaggguucaagcgauucugccucagccucccacguagcugggauuacaggugccugccaccaugcccggcuaauuuuuguauuuuuaguagagaugggguuucacuauguuggucaggcugcucuugaacaccugacgucaggugauccaccugccucggccucccaaagugcugggauuacaggcgugagccaccauggccagccguguuuugucuuuuuacuucaguguauauuuaacaauuccgggccagacacaguggcugacgccuguaaucccagcauuuugggaggccaggugggugaaucaccugaggucaggaguucgagaccagccuggccaacauggugaaaccccgucucuacuaaaaauacaaaaaauuagccaggcaugguggcgggugccuguaccagcuacuuaggaggcugaggcaggagaaucacaugaacccaggaggcggagguugcagugagcugagauggggccauugcacuccagccuaggcaacaagaguaaaacucugucucaaaaaaaaaaaaaaauucugaaguauuuuuguuagggacuaguuacucacaaauggucccaaugucauuaaggacuggauaccacuucauuuugagacagggucucgcucuaucacccaggcuggaauacaauggcacagucacugcaaccuccaccucccggacucaagccauccucccaccucagcccuuaccccaaguagcugggacuacagguaugccccaccagaccuggcuacucuuuuguauuuuuuuguagagauaagguuucacuauauugcccagacuggucucgaacuccugggcucaagcaauccgcccaccuuaaccucccaaaguguugggauuacgagcaugagccaccucaccuggccgacaacuccauuucuugagaaaaagaacaguacuaaugggcaagaagaacguauucaguauaaaaucucccaaaguaucucugacaggcacagcaccugaacacauggaaaugacuguucaucuguucucaucuggagagguuaccuaauauauacccacuaucccuugacgccaccaacauuuucggaccaccuuccacaucccagacacagcacuaaguuaggaauuagaaaugcgagcaaucacacaauaagaaugaaauuccuuugaaguaauuauauuaccaugauuaacagaaauuauuuagaaacaacacauucucuagaccucaucaaccacugcagggcuuugagcagaggagugacaugaucugacauauuuuuaaggaucucucuagcaguugaagcugaaaacagaauguagggagaggcaaggguacaagugaagacauaagaugggaggcuacugcaauaauccaggugacaggugaugcugaccuggcccugauggugguagcaaagugauaagaugucacucaauucuggguguauuuggaacauacagccaaugugauuugcaauggaugggaugugggcugugaaagaaagaaaagucaagcaugacuccaaaaguuuuuggccuaagcagcuaaaagaacaguauuaccuuuaauugagaagagaaugauagugaagcaugauggcgugugccuguaauccuagcuaccugggaccuugagagcuuguuuggagguucuagcaggggaacgcagcuacuuauauacccuugaccgaagauuaguccuccucuauuggggauggucguucucuucgacuugagugugcagcuucgggagggauauacauggagcagugagggaggaaggagacaccggccuagccagccagaucagccggaucaacccuggugaucaacggggugagagaugucacagccagguugcccucacauccuacuugggaggcggaggugggaggaucaccuaagucuaggaguucaaggcugcagugaaccaugaucacgccauugcacuccagccugggcgacacagcaagacccugucuccaaaaaaaagagaagagaaagaugucuauggaguaggcuugaggggacuaucaggaguucaguuuacagagaagugaaguuugagacaucuauuauauauccaaguggugacaauaaguaggcaaguggagaacaaagccaaguucaggggagagguacagacauacaacagacuagagauuuggauguaucugcauauagaugguguauuugucugcuugggcugucauacuaaaauaccacagacugggugacuuaaacaacagaaauuuacuuugucaccauucuggagacuagaagcccaagaucaagguuuuggccaauuuggucucugguggcagcucuguuccugucuuguacauggccaccuucuugcuaguccucacauaaucuuucuucaguauguaaggguaaggggcaagcucuccauucacucuucugauaaggacacuaguccuaucggaucagggccccacacuuaugaccucauuuaaccuuaauuauuuccuuacuccaaauacaaccacaccuagagugacaucuuugauucuaaaaguucauguucucacccauuaugcaagacuuacaaugguacaagcuauuuaaggcagacauuuaaaagaggcccaaguguucagagagccuuuggcuccugguacuucuuguuagccacucaaguuucaucugucccagcauuuucccuaccuaguuggagcaacuugcguucucugggcucccaucccaagaccaagcugaaguguccucaacuccucccgcugccaaggagcauuuaucugguuucccagugacucccagucuggagguuacuuuccccagugcugucucccaugguuuccuaccuaacaucuuauuucucuuucuccaguuucuucucugccuucugucugaaggcuuguauucuauuuuuguuucagaaugcauuucucuuaugcauuagaaauguuuucauuauccauuaacucuaaacaagaaccuaaaggcauauaaaaaaacccuuagcauagaacugcugaaugacuaagucacagagaagaaaaggcaaauaccuccacugcuucgaagacugcacacgcuaaaacuacacaaaugccagaacagaacauuggauuaucauuaucaaaauuaggggaaggcugggugggguggcucaugccuguaauuccggcacuuugcggggccaaggugggaggauuacuugagcccaggaguuugaaaccagccugggcaacaugacaaaaccucaucucuacaaaaaauacaaaaacuagccggaugugguggcaugcaccugaagucccagcuacuagggaggcugaggugcaaggaucacuugagccugagagauuaaggcugcagugagccgugcucgugucacuguacuccagucugggugacagggcaaacaaaaacaaaaauuaaaaaaucagggaaaguacacugugaacaaauguuuauucagcaaauuuuucaaauuauuauuauuauuuuuuugagaccgagucucacccuguagcccaggcugaagagcacgaucucggcucacugcaaccuccgccugccggguucaagcaauucuccugccucagccucccgaguagcuggaacuacaggcauacgccaccaugcacagcuaauuuuuuguauuuuuaguagagacaggguuucaccauaggggccaggcuggucucaaacuccugaccucgugauccgcccaccucggcuucccaaaguccugggauuacaggugugagccacuacacccagcucaaauaauuuuuuuaaaguauauuuuccaguuuuguuuuguauggcacugacucugucacugugaauuccauuuuacccaaaacauugacacuuccacacauauuuaugaaucaaaauugaaagauaauugcauuaauagguacuuuuauuuuuuucuucuuuuguuuuguuuuguuuuguuuuuuuaagacggaguugcucugucacccaggcugcagugcagcgucgugaucuuggcucacugcagcauucaccuccugaguucaagcgauucucaugccucagccuccugaguagcuaagauuacaggcauggaccaccacgccugguuaauuuuuguauuuuuaguagagaugggguuucaccauguuggccgggcugguuuugaauuccugaccuuaagugaucugcccgccuuggccucccaaagugcugggauuacaggcaugagccacugcacccggccgacuuuugcaaaggaaauucuuugaaucugaagugucuugcaagguagaggcuauugcaaccauuucaacuagugugucaacagucuucucuaaggugggcuagaaaaaugguuucauauucaaauuguaacucugaaaaacaacugaugguaauaaagagauuccauaaucagacagaacuaagugaaacaauuaguuuugguagaguucugugguaaucauaguuagaaguuuauccuggguagcugaaauauaacuaacuucagacuccaggccugucgguggcuugugccaaucaccacaacacuuugaggggccaaggccagaggaucgcuugagcccaggaguucaaggcugcagugagcuaugaucacaccacugcacuccagccugggcaacacagcucuuguuuuuuaacaagacauuguuacuuaaaaaaaaacugcccugaugaaacaauucuaccaugaacacugauguuguucuguggacuacuucaggaagauggacuaagaacaucauuaaauaguuccaaccaguuucuggguaauuuuauuuuuaauuuuuuguuaugagggucuugcuauguugcccagccugggcucaaaugauccucccaccgcgggcucucaaagugcuggguuuacaggugucacaccgcgacagccaaggguaacuuuuuuuuauuuuuauuuuugagauggagucucgaacugucgccccggcuggagugcaauggcgcgaucucggcucacuguaaccuccgccuccaggauucaagcgauucuccugccucagccucccgaguagcugagauuacaggcgcccaccaccacgcccagcuaauuuuuuguauuuuuaguagagacgggguuucacuauguuggccaggcuggucucgaacuccugaccucgugauccgccugccucggccucccaaagugcugggauuacaggcgugagccaccgcgcccguccaaggguaacuuuuuaagagcugcccuacagcucauuaccuccuucucaaggagcaugagugucaaaccaccuccagcaaaguagauguagucuuuuacagauuuggaaagaaggauuuaggaggaaagggaagucguucggaaugaaggauuuccuccucugacgcccagccgucccccguuaagccuaaaggugccagaccucaagacucuucuagaaagagauuuuuccuuuccaaggugaauccaucuguuccgaaggucagaagcuauuuuaccgaaguuuuccguuccacugaaaaaauuaagggucaaucaaagcuccuugccccaaaccugaauaugagcuugccucgggucauauucgacucuaaagacuccaccacaccauccuggacuccccuauaucuaggacaaaaagcgaccaguuucucaggggcuccuugcggggagcuuaccgcgcccucacuguccgccggcccgagugcuaccggagaucaccagcggcccggacgccagcgaguggaacaucucggucgcacucuc

SEQ ID NO: 191435 - RNA, 95472 nt, Homo sapiens
accucuacuggggagacgaggaccccgagguucuggggggcgacgcgaccugcccgaagugacaaggguccugggccgcacugcuccgccggggucugcgcuccucggcggagcgggugggaaggaugaguccucgggguggagaaggaggagcggguccccggguaccgcucacccggccuuaggagcccgggagcgcgcguagggacgcggaguugaggcucuccaucugcggccagggaaagggauacagucccccgggccccucccggccgcucggaacccaccccaggcgcguccccgcgggcgcgcgcuccaggcggggccgacgggcucggaggcgcgcgcccgcugccggguccgccgcgcgcgcucccuccgcuccucucccccgccccucccgggcccgcgcgcucccaggguccgccgcgcgcgcgccucgcgucgcuccccauccccgccccucccgccgccaccccgcccccggccggguacccucgccggacccgagagagagcgccgccgccaucuuaguugcugccgcugccuucagcaagacgcugcucugaggcggggagggcgccgcguccugagcgcgcggcccagcgucacggcggcggcggcggcggcuccuccuuggacccccggagcuccccgcgccgcggagcagcuagccccaggccccuagagccccgagagcuccgagagcuccgcucggcgucccgcgcgccucccugccgcucccgccccgggcuggcgaugcugcgccgccccgcucccgcgcuggccccggccgcccggcugcugcuggccgggcugcugugcggcggcggggucugggccgcgcgagguaagccccggggcugggccgggccgcugggucggugcgggauucggguccgggugcaggauucgggucccggugcggggauucggguccgggugcgggaguagggccggaugccgggauucgagccgggaugcggggagucggguccgagcgcagggagccgggucagggcgugggguucggguugggggucgggcucgcggagccggggccagggcgcaggagacugugggcgcgcgcugcaggcgucccggggaagccaggcuccgucccgggcggggcuccugagccugggcugcccccacugcagcccauggugguggcugcgcugauuugggggaacgugcagacgggccgaagggucaguccgcccugcucagcggcgcacgcaggcuggggcugcaccccugggugagaugcucuguguacgugugcucagaugugcaucaggcggggggugcacgcacaguuuuggugugugcuuacauaagagcccacuccuccgcaucccguuuccaagaucccgauucuguguugcugcaccgcggacaccacgacuucgccccuuuccgccuccucccagaguccuucagacguugucuguuuccaguggagccgaggcugaaacuuagugcuucccucccaccuuuucacccaaaggugaaaucgcgaugagauuugcgaccgcgggcucacccaguguuagaaaucuccgucucugcuaccccuggugccuuggugcuguuuuucugacggucauuuagaccguggaggguuagauguucucuacaaaaacgagaaaccucucugguuuuuuaggauuguaggaccgaaauuauuuuauggcucggugggaaguaguauuucuuggcuaauuuauuauuagcuuuuaaccuucauccacuuaaccuuuuaaaccuugcaugccucugcuauugacuggucuugccaacgaaaagcuuacgcauugcagauacaguauuugcuucugaguggaucuugaaaucguaaacauuuuccuuggccuuagagcagaguaaucuagguguagucuguagaaucuacuguaggcuuaaaucuguuguucugauuuuuuuuuaaucaaaagaaauuuuggggaggaggauugauagaaaucuagaugaaauggucauauuugaauuuagcaagcuuuuuaaaaauucuuauuuucccuucccuggcgugacauaaggagagaaguaugguguucacgaauuaaagggcagaggcggcaaaugcaucuuuuguuccauguuccuuucuaaacaucgaggaugauaaacuuugaauacuucuuuuauuucauuucuaacauucuguugacucugucaaauucagaucuuagucacuaaguaucucauugcuggccauuugauuuuuaaaaguaacaucaagcuaaguuugaaauguucuuuccagauguggguuggaggucugaaacucuaauauauccaagagaaaugucaaaaguuuugcuucucuuggggaaaacccacacauuuuaaaaauaugugcuuggauuggguauuuugggaacaguuuaaguauauuuagucagugauaccauuucuuguuaaaauuggugcuuucuuaaauagcaccuacauuuguuagucauuauuuaauugccuugguuacuuaaacagcauacauuucaacuuugaauaucuucauuaccugagaccgacagaaaucuugugugaaagguguguuggcuaguugagucauuuguaauuugcuuucucuaaguuuuucuuggugcaguuacaguaguucaagauucuuagucuucggaauaaagacauuuuacacaucaguuauucguaugcauuuuuuucagguugcaaguuagaaaaugucuuggaauuacacgaaaugcuaauaaacaauuucauuuugaaauauuacaagugaauuucauauguaaauuuacaguuuggagacacucugugggcucguuuuaagagaucauuucaacuaauugaauuuuuuacggcuguaaggcaguacgacaugaacuccuguucaugcuguagcuaccuuuaaucauuguuaauguuagauuacguacagacugcugcagaaaaugauagauuuucuaauauaaauugcaucuugacucuuaguuuuguagagacccucaaauuuuauuuuaauuauagcuguaguucucaaaaaacauugaguagagcugggugcaguggcuugcgccuguaaucccagcacuuugggaggccgaggccagcggaucaccugaggucaggaguucgagaccagccuggccaacauggugaaaccccaucucugcuaacuauauaaaaauuagcuggguguacugguggacgccuguaacuccagcuacuugggaggcugaggcaggagaauugcuugaacccaggaggcggagguugcagugagccgagauugcgccacugcacuccagccugggugacaaagcaagacuccaucuuaaaaacaaauucaguaagccaaaauauuagaagaaauaucuuuggcaugcccuggacggucauguccuucagcuaccugccuucuucauggagaucgggaaauagaacagugaagcagagaaaauagaaagcuuauaugaauauuuaaaaaaugcaaccauguaaugcauuucgaagccacuuaauacauaaaauucacuguuacuuuuccauuugcacauaggcuuagugagaccuccccucaccauccuauuugaaauaauuucucuuccugaaccccuaaauccuguuucccugcaacacuuuuucuuuuugcauagcacuuagcccauucuaacaugccuuguuguuuacuuauugaauuguuuaucgucuguuuccccucaguagaacauaugccccaagauggaaggguaucugcuuugcauauguuucccgucaccagcacaccagaggcaugccaguauugugugauugaaugaaugaauggguggauggauaacagcauuucaguuuagacagcguaguagcuuugcauccuaauuuucacuuuacagauaaaugcuauauacugaaaaaaauuacauaguguaaagcaaacuuaaguuuuuuuuuuguuuguuuuuguuuuugugacagagucucauucugucacccaggcuggagugcaauggcgcgaucuugucucacugcaaccuccgccucccggguucaagagauucuucugccucagccucaccaguagcugggacuacaggcauaugccaucacacugggcucauuuuuguauuuuuaguagagacaggguuucaccauguuggccaggcuggucugaacuucugaccucaagugauccgccugccucugccucccacagugcugagauuacaggugugagccacugcacccggcccaaacuuaaauucugcagugucgauaugggaauucauuaguggguaaauuuucaaggaucauggggccagccucgguggcucaccccuguaauuccagcacuuugggagaacuaggcaggcagauuguuugagcccaggaguuugagacuagccugggcaacauggugaaaccuugucacuacaaaaauaccaaaaaaaaaaaaaaaguucaaggaucaauucuguugguugcaguauuggggauauuagaucaugaaacucugucucagccuuugaaggcuguagcucuguggcuaccccuguuagucccuuuaaaaauacuauaauuuucagcuuuuuugggaagaugguuucuuaauuuguuaccucguuuuuucagaaguaacgauguggaaaaaagucguucgaauauagaccucaguauuacccauagucuaacauuuuuaauacugaaaguaaauaacauuuauuucucaaaggagaccuauaacugcugaagaaauaauaaaauacgaacaauuuugaauauauuccaauuuuagagcauucacucgguuaacuggaaccuucaguuagcuggaauucguccuuuggcuggauauuucuuuugggagaaaaagcaugaaaccaagcaguuuuauaggaauuauuuuucaaaaggaagguuuaggaggucauaacauacauuaucugugccaguauuugauauucaagccaaaaacgcaaauaauauuucaguuuuaguuaugaagaauaugaccaaaaaaugaaauuuuugugggauauaaaauauuacauugaaaauagaaaaugcuguaauuucguaacacuagcugcaggacuuagugaagcuuauuaaaccaagucuaaauguuuaaaaugaggaagcugagauagguuaaaauuuuagaacaaaggaaaaaaaguacugaguuauuuuuauuauugcuuucugagacaggaaaguauguuuuuuaauuuuuuuggguaguuuucauuuauaagaguugaaacaaaauagagaucugauuauccuaaaaaaccgccaagagucuauuucuuauguauucugguugagggcuuagaucauuaaaacuuguuuuuuuagugggucuuaauuuggugugaagacuugcuugaaggggccgggugcgguggcucacaccuguaaucccagcauuuugggaggccaauguggguggaucacgaggucaggagaucaagaccauccuggcuaacacggugaaaccccaucugucucuacuaaaaaaaaauacaaaaaauuagccaggcgugguggcaggugccuguagucccagcuauucgggaggcugaggcaggagaauggcgugaacccgggagguggagcuugcagugagccgagaucgcgccacugcacuccagccugggcgacagagugagacuccgucucaaaaaaaaaaaaaaaaaaaaaaaaaaagaguugcuugaagaaauaugucuuuauaagugaaauuuaaaauguugauuugcuacaaaauacggauuuuaguaguguuucaggacuacagauucaagauugguggaaauuauuuaugcaaugucauguucgugcauuaaaaaacaaccaaggccuggcgcgguggcucaugccuguaaucccagcacuuugggaggccaagguggguggaucaugaggucaagagauggagaccauccuggccaacaugaugaaacccugucucuacuaaaaauacaaaaauuagcugggcaugguggcaugcaucuguagucccagcuacuugggaggcugaggcaagagaauugcuugaacucgggaggcggagguuguagugagccgagaucacaccgccgcacuccagccuggcgacagagugagacucagucucaggaaaaaacaaaaacaaaaacaaaaaaaaacccaaacggccaggcaugguagcugacaccuguaaucccagugcuuugggaggccaagaugggugaacugcuugaguccaggaguucgagaccagccugugcaacauggugaaaccccaucucuacuaaaaauacaaaacaauuagcugggcaugguggcauaugccuguagucccagcuacucaggaggcugaggcuggagaacugauugagccuggcagguugaggcugcagugagccaaggucacaccacuugcauuccagccugagcgacagagcaagacucugucucuaaaaaaaaaaaaaaaaaaaagccaaacuaacagacccucaaaagugacauuuugaggcuaugcaaaggccauauauaggaacccuuaaauggcgacagccuccccacugugucagccugacauacaauacccgucuuuucccuaagagcugccaccacccgggaacuagaaugcugcuuucaguugucccugauuugauagguucuuucucuccuauguuuuagguauauuuuugcucauuuuuugauuuagcuuuaggauauuauuauuagauuaaaaauuuucacaagaucuguuacuaaaguuuuuauuuuuaaagauucuuggcagagauucacguacuucaaaguagcagaguuuaaagcagcuuaaaugccuauaaaacaucugaaaguuggcugggugcaguggcucacaacuguaaucccagcacuuugggaggccgaggcaggcggaucaccuuaggucaggaguucgggaccagccugaccaacauggagaaaccccaucucuacuaaaaaauauaaaauuagccgggugugguggcgcaugccuguaaucccagcuacucgggaggcugaggcaggagaauugcuugaacccaggagguggagguugcggugagccgagauggugccauugcacuccagccugggcaacaagagcaaaacuccgucucaaaaaaagaaaaaaaucugaaagcuuccuucccauuccggaaccccaauaagaaguaugugauagcauaucaaaagaagagucauguuuuuucuuuuuuacuucuuuggucagacaugaaucauuaucuuaaaaagaauuaauagaaguggcgucucacuguguugcucaggcuggucucgaacuccuggacucaaucaguccucccaccucauccucucaaagagccgagauuauagguaugagcuaccgcaccuggccgaagaaucaucuuucagccaucuguuucguucugucugauucucccaugacaagaacuucuguugagucugcuacuuuucaagccuaccuugaucuguacuuucucugagucauuguguaggacaaaggaggaccaccggcugggugcgguggcucacgucuguaauccuagcacuucgggaggccgaggugggcggaucaucugagguugggagaaagagaccagccugaccaauguggagaaaccccaucucuacuaaaaaauacaaaauuagcugggcgugguggcacaugccuguaaucccagcuacuugggaggcugaggcaggagaauugcuugaacccagggggcggagguugcagugagucgagaucacaccauugcacuccagccugggcaacaagagcaaaacuccaucucaaaaaaaaagaccacuuuugucaugccacugcacuccagccugggugacagagcaagacuuugucucaaacaaacaaacaaaaaaacccaccuuuuucugcauccacuccuuuuuuuuuuuuuuuuuaaagcagcuuuauugagguauaguucacauaccauaaaauucaaccuuuuaaggcauacaauucagugauuuuaguauauuuacaaaguugcacaaccaucaccacuaucuaauuucagaacacuuucaucacucccaaaagaaaucccauaucuguuagcaaucauucuccaucucccuccuccucuccuccucccuuggcaaccccuagucuauuuucugucuauggauuugcuuauuuuggacauuucacaucaauggaaucauacguggccuuuugugacuagcuucuuuugcuuaauaugaugucuucaagguucauccauguuguagcauguaucaggacuucguuucuuuucauagguaaauaauauauccuuguagggauauaacacauucuguuuauccauuuauucacugauggacauuuggguuauuuccacuuuguagcuaauuuuggaaaauauuacuaugaacauuuuuguacaggaauuuguguggacauauguuuucauuucucuuggguguauacccaaguggaauuguugggucuuaggguaacucuuagauuuaacuuuuuaaauuaaaaaaauuuuuuuuugagguagagucucacucugucacccaggcuggagugcagugauguuaucuuggcucacugcagccuccgccuccuggguucaagagauucuccugccucagccucccgaguagcugggauuacaggugccugccaccaugcccggcugauuuuuguauuuuuaguagagacgggguuucaccauguuggccaggcuggucuccaacuccugaccucaagugauccagcugcuuuggccuuccaaagugccgggauuacaggcgugagcacuaugcccggccuguguuuuuaacauuuugaggaacuaccaguugguuguacaaaguggcugcaccauccuguauccacuugaccuccauagucacucacaggagcauuuuucgaaucaaauacacauuucacaguuuucuaguuuguuagaauuuuaaguugaauuuuuccuagucuaggugcaaaccggcauuucauccaaccaauuccuuccuuugccauugucucucauauaauuucuacucuggacuuuagacuuugaguugaaaggaacuuugaaaguucuuuccucuauacuuuaaauagccuucccuguaaaacagacauuuccucauauguucuuguguguugaucauucagccucuguuugaacucugcugcuguggggcucuugguagcucacagagcaacccuuuucuuaaaaacauugagccuuuggucagcuuuccugaggacuaaauuuuaucacgccuuuguauuuuugcaggcauccaagccuacagucuguuguuuuuaccaccucacacauuaagagagacugagagcacugaggccuaggccuugauuucuguagauuucuuaggaaaucugagccuagcacagggcuacacaugcaguguuugggggacagccacccagacacaugcagagucaauauccugguuccaggagcagggcuuaacuuaaugaaagggacuggaaaaaacacgagaauuuucaaacuacaacuaguuuagaaaagugacauuuuucuuuuuuuuuuuuugagacaggaucuugcucuguugcccaggcuggagugcaguggcacaaucacagcucacugcagccucaaccucccuuggcuuaaacuauccuuccaccucagccuccugaguaggugugcacaccgccaugccuggcuaauuuuaaaauuuuuguagagacgggaucuuccuauguugcccaggcuggucucgaacuuuugggcucaagcauucugcccuuuuuggcccuccaaagugcugcgauuauaggcgugagccaccauguccagcugacauuucuucauucauuacauuuuuguuaugcuaguuggcuaaaaaugugcuuuguuaaaaaguaaauuauuuuuucuaguccuuugauuuuauuuaacuauuccucaauuacccaaucuucaaacauauaaaaugcuuagaaauaugucuuuagauucaaagugaauuuuaaaacucaguaaaaaugaauaucuucuuuguuuacauacuuaaaguauagcaaagaaauuuuuauucaagcuggagugcaguggcacgaucucagcucacugcaaucuccguccucccaagguucaagcgaucugcccauuucagcccccugaauagcuggaacuacagacacacaccaccaugccuggcuuuuuuuuuuuuuuuuuugguagagaugggguuuuaccauauugcccagauuggucucaaacuccuggacucaagcaaucucccugccucagccucccaaagugcuaggauuacaagcaugagccaccaugcucagccuaacauuuuucuuucuuuuuuuuuuugagacagugucucgcucugucacccaggcuggugugcaauggcgugaucuuggcucacugcaagcuccuucucccagguucaugccauucuccugccucagccuccugaguagcuggaacuacaggugccugccacugcgcccggcuaauuuuuuuuuguauuuuuaguagagacaggguuucaucguguuagccaggauggucucgaucuccucaccuugugauccucccgccuuggccucccaaagugcugggauuacaggugcgagccaccgcgcccagccaacauguuucuuauauaguacuuuugaggaccacuucaaaauaguugaaugucauaaauuuaaauugaagaaaugugaaacuucagaaugauuuguauaagguugucuauuaaguggcuuuuaaaggguauaaugaauuccaucugaaaugcagacucuagucucacugaguuuugcauauuucagauguaguuaaugaugaagauugacaggacuagcuacauaauccaaggggccaaugcaaaacaaacuguggggccccuuguucaaaaauuauuaaaaauguuuuucuuuuucuuucuuucuuuuuuuuuuuuuugagacagagucuugcuguauugcccaggcuagagugcagagguaugaucucagcucacugcaaccuccgccuucaggguggaagcaauucucgugccucagcuucccgaguagcugggauuacagacaugcaccagcaagccugguuaauuuuuuguacuuuuaguagcgacaggguuucaccagguugcccaggacggucuugaacuccugagcucaggcaguucacccgccucagccucccaaagugcuaggauuacaggcgugagccacugcaucugucccaaaaauuauaaaaaauaucaagauggcaacagguuuuucuuuuuguuuauuagacagagucuugcccugucacccaggcuggagugcagugguguacucucggcucacugcaaccuccacuuccuggguucaagcgauucucaugccucagccuccugaguagcugggauuacuaggcacccgccaccaugccuggcuaauuuuuguauuuuuaguagagaugggguuucaccauguuggccaggcuggucuugagcuccugaccucaagugauccucccaccucagccucccagagugcuaggauuaugggcugagcuaccucaccuggucagcaauagguuuguuuguuuuuuuuuuuuuuuuugagauagaguuucagucuuguugcccaggcugcaaugcaauggcgugaucucagcucaccacaaccuccaccuccuggguucaagugauucuccugccucagccuccugaguagcuggaauuacaggcaugcaccacaacuggcccggcuaauuuuguauuuuuaguagagaugggguuucuccauguuugucaggcuggucuugaacucccgaccucagguguucugcccgccucggccucccaaagugcugggauuacaggcaugagccaccgugcccagccagcaauagguuuuuaaaccaacccuggggcccuucuaugccuggcuccuggcacaugcaggaaacuggcccugaguauugauaaaacuagaugacagaguauuaauagucaaauugugggcccagggccugagauuuucaccagagcugcuuguccucugugucucuugucagcugcaucucuggccaaugcuccuccuuccccuugggaaaagaguccugccuuuuauucuaaguggcuucagggugcaaguuuccccuucaucuuuccauccucagcaacaagcaaaggauaggcucuacuccguucucaguggacagugagaaccgaugguagacagaggcucacagaagacuaggguuguguaugaucugggggacuaaagcccuucuguuaagcagauuauguuuacucuuuuuuguuuuuuugagacggagucuugcucuguugcccagccuggaguacaguggugcgaucucggcucacugcaagcucugccuccuggguucaagguauucaccugccucagccuccugaguaguugggacuacaggcauaugccaccacgcccagcuaauuuuuuguauuuuuaguagagaugggguuuaacuguguuagccaggauggucucagucuccugaccucaugauccacccaccuuagccucccaaagugcugugauuacaggcgugagccaucgccccuggccuauguuuacuuuuaaaaugauuugacuaauugaugcuaguuucuuauuacuuacagaauuaguaaaaaggauaacaaaucauuaaaauucuuggauaaucccuacucuuuuuuuuuuuuuuuuugccaugcauuucaagcauuugucagaguacuaaguaaauaguaaaacacacugacuugaauuucauuuucuccuuaggcccucucacucugggcuaaaauuauuaaaggaacaguggggguggggaguaacaggugggguacagucguuuugaguuuuugagccccucaguuacuagugccuugugacuaguuggaaggggaccuugauaauccugacugauuauaaagcccuaaguuggcaaggucagagcuugcuucugagcugucuguaaauauccauugauaccagcucaugauuccuguagaaaacauuuucauuuggcaaggguuuaaaaaguccaugcccaaguguacgagagccgccucuuguuuaccuaggaagcagcgaauacaugucuucuaaacauucagagccuugaauagaaaauaaauacuggcuuaaaugcuuuuuuauaugaaaucugacauguuaaaacuucuucuaaauuggaguaaguaccacugggauagcuucauaacauagccuuuccccucccuucugcugacuuuaauaacaacuacgacauuacuguuuguuugaaugaaauaauguuuuaggccauuaauaccagugguuaauauauauuugcagauucauuugguaaaguuuauuaacuuugucuuuuucuagacuuuuucugaguguucuuagaagguuugggcuuuuuaacugcuacuuaaaguaaugcauauggcagugggucugaacagauuguguugauugcauuuuucuuguugcauauaaaguauaucauacauuguugugagggucccaggagcaagagaauugaucagagaacagagaggagagaggauccggagguauguggaaugaggcauucuagguagauguggucaacaguuuagauuuuauuuuuauuuauuuauuuauuuuuaauuuuauuuauuuauuuuuugaguuggggucucacugugucgcccaggcuggaguguaguggcgcaaucucggcucacugcaaccuccgccucccagguucaagagauucuccugccucagccuccugaguagcugggauuauagguguacaccaccacaccuggcuaauuuuuguauuuuuaguagagaugggguuucaccauguuggccagccuggucucgaacuccugacuacaggugaucuaucugcuguggccucccaaagugcugggauuacaggcgugagcuaguguccccagucuuuauuuauuuauuuuugagacagagucucauucuguugcccagccuggagugcaguggcaugaucuuggcucucugcaaccucugccucccggcuucaagcaauucuccugccucagccucccgaguagcugggauuacagguguacacucccacaccugacuaauuuuuguauuuuuaguagagaugggguuucaccauguuggccagccuggucucguacuccugaccuuagaugauccaccugccucggccucucaaaguucugggauuagaggcgugagccaccauacccugccugccugccugcuugccugccuucccucccuuccuccccuccuuccccuccuuuccucccugccuucucccuuccuuccuucccucucucccucccucccuccuuccuuucucucucucucucucccucucuuucucucucuuucucucucucucuuucucagagucucccucuguugcccaggcuggagugcaguggcaugaucuuggcucacugcagccucugccucccagguucaagcuauucuccugccucagccucccaaguagcugguaucauuuuuauaguuuuuuugagacagaguuuugcucuuucccucaggcuagagugcgguggugugaucucgguucacugcaaccucugucccccagguuccagcaguucuucugucucacccucccgaguagcugggauuauaggcacccaccaccgcgcccggcugauuuuuguauuuuuaguagagaugggguuuuaccauguuggccagguuggucucgaacucuugaccucaugauccaccugcccaggccuccgaaaaugcuaagauuacagacgugagccacugcuuauauuuuuaguagagacgggguuucaccauguugaccaggcuggucucaaacuccugaccucaagugauccagccuccuugaccucccaaagcacugggauuacaggcaugagccacccugccuggcccaguuuagauuuuagagaagugaaugcaagcaugaguaccgaggagaggcaggugggguggugauuaagaggccguucauguuaucuucaggaaugcacggugcagaguggugugcacaggagccugacugcagagauugaaggagugaauuauucaggauugggugcugacccaggaagaggacagaccaucaggcgaguaaggcagauccgcauuugggcgggcgcuucagagugacuccuggaggcuggggggugugugucugaugggcugucacucacauccugugucuucucagggagggcucugggaggcaucuguggccagcggacagugacagcauaaggccagagguguaagucuuggcagagaauaagggcagagccuggagggccauuguuuccccucagcuuggguuguggguguuuucugcguaugagguuuucacucugguggacagugaagccagggacaaagggagaacaaacaugggccccuugggccaaaucugguuguugcuuaggccugaaggagaaggggaaaaggguuuccugaaguuucuguuauaucuagaaugcaggagaccagaugaggauuugggacagcagccuuggcucaggcuagagcagucccggcuguacucuuaucguuuggaaacccaaguacagacagguaagcuggggcaagcuggugcagagagcagugauggaacccuggcaucugagcagcccacagcaguggccaaccaaugugaguccgugcuaguucuggucagauugaggccuuuuuccugagagcucgggcacguguuauuucuccacucagucuguccccaggccuggguaaaccgaacuggccccuugcugaaauuccugacuaccuccgcucaugggaucgucuaguaauuacuggcaaacugccucaaccuagcuuugucuugauacauuguuuccugguaccuaagccauuucugauuuggaaagguaacucauauugaucgguuuggaguucaaguuggaacccaaauuguaucuuccccguggaaauuuguuauaaacaaugcuuauaaagcuccaaaagugacugucagaaacauauuuaaccuauaacaaguggaaauuggguagauuggcaguaaauuccagcgcaugcaugcacaugcguucacgcucacccacguugcaguacagugcuguugagccuugaacaacauggcuuugaacugcauguguccacuuauaaguggauuuuuucaaccaaacgugaauggaaaauacaguauuugugggcugugacacccgcauaugggaagcacugacucuuugaauacuuggguccugcaggaccaacaacuugaguauguguggauucagguguagacuggcguccuggaaccacuacccugguggauacagagggacugcugucauucuguaaaccagcggugaggcgcugguuaagguggaguggugggaggcauuggaguggcagcgccgcaggauucugugggggcagcagccacaaucaguggccccuugacccccaccugggaugaaggggcuaggaggccgagguaccagagaaggguugugaaggaggcagaagccuaguuccugggguccuaggugaccgagccagugagaagaaaaggagggagagaguagccugccacugggaucugcagaagcacgucaggaagcccagggaggaggggcccccaugcccaggcagaggcacggccuccaagggcagaaagguuuugagguggaggagaggcaggagagccacaaccgggggcggugggcccucugcaagcagccgccucugcaggcccugccucuucacgguggccacgccuuucaggggaugcugacugcuguacgcuguguggaggaaugacuuagggccagacgcgcuuaguguuuuucaucaaagaauuuaacugaaauauugcuauuuaaaauuguuacuugaauuuaccaaguuccuaaaucuauaugaaguaaauuuacucccuuguauagaggcauuuuacuaaagucaguguaaaaaauguauuugauguaacucccagcuauuccagugggauguaucauguaucauuuaauauuaucuuugcuagaaguugucguuuguaaauaauggugacguaguccguguagugacuucuaaugguaaggauguagugaccaacugcaggcuuccccuugaaacucaucuaggaugagagaugggucucccuaggugugugacguggacaggugcuguuaggucaaugaggucucggucauguaagcuugggaagcgcuguuaacguuaaacagguuucguuacugcagggcuucucacaggcuugagugcacuuggaggaauugcugagccggggguaaaaccaacucacuugaccugggacucuuucugccgcaccuguggcaccagugucccggggaacacacuuuaggcaaugcugcuccagacccccccccacgcccuuacuguagaacaagaaaacacaguuaguccaaaauagaaugaaaguaagguaaaaagacuuaaaagacugccucuuugacaucauuaguguaaacauuuugugucuguuuuuauuuuuauuuuuuugagacggaaucucacucuguugcccaggcuggagugcaguggugugaucucagcucacugcaagcuccaccuccuggguucacaccauuuuccugccucagccucccgaguagcugggacuacaggugcccgccaccacgcccgguuaauuuuuuguauuuuuaguagagacaggguuucaccauguuagccaggauggucucaaucuccugaccucgugauccaccugccucggccucccaaagugcugggauuacaggcgugagccaccgcgcccggccucgugucuauuuuuauagauuuuuuucuuuguacaaauuuaacuacauaaaguuuuaaacaaaaugcagucauauucuacaggguauuuuguaacauucucuuaaagucauucauucagcagacauuugccccagguaugguguguaaacuaaucccuuagagggauguaguagaauugaacccaaccuaacccuuuaggguucccagauuguuuggucucaggaccccugugcucaaaaauuaccauggacuuuaaagagcuugugguuauguguuuuuguuuguuuguauuuucgagacagaguuuugcucuuaucaggcuggagugaaguggcgugaucucagcucacugcaaccucccccccuccacccccccugcccuggguucaaacgauucuccugccucagccucuggaguagcugggauuacaggugcccaccaccauggacagcuaauuuuuguauuuuuaguagagacaggauuuggccauguuggccaggcuggucuugaacuccugaccucaagcgauccaccugccuuggccucccaaaauguuaagauuacaggcuugagccaccgugcucagccauauguggguuuuaucuauggauauuuauuagaaauaaaaagugagaaccuauuaaauaauguaauuauuaaauuauuuaaaauagcaaugauaaacccauugcauggugacuuaaauaacuuuuuuuuuuuuuuuuuuuugagacagagucuugcucuguaacccaggcuggagugcaguggcacaaucuuggcucacugcaaccuccgccuccuggguucaagcgauucuccugccucagccuccugaguagcugggacuauaggcgcgcaccaccacaccugguuaauuuuuguauuuuuaguagagaugggguuucaccauguuggccaggccgaucuugaacuccugaccucaggugauccacuugccucggccucccaaagugcugggauugcaggugugagccauugugcccaaccuaaauaacacauuuuuagugaaaauuaacuguuuuccaaaaaccagaaacaacuuaguaagaagacuggcauuuuaaguuuuugcuaaucucauuaauguccaacuuaagagaaaacagcuagauucugcauugucuguuaucuguuugaaguagaugaagaaaacugagcuucacacagauauaguugggaaagagagagcuuuggggauuccucccugcccccgcaggaguccuuagaucacgcucugauaacugcugcucuagggcagucauugaugucaagauacaacuaggggacaugucaccaguaauuugcuucuaaauaauaguugaaguaacaaagcaaagcuuacuagugauuuacuugcuuaaaaacgaaaugagaguuaguucaacuuuuuccuggaauuaugucucuucauaguuuacauugccccuugcuuucuuuucuuuuuuuucuuuuugagaggagucuugcucugucucccaggcuggaguacuauggcgcgaucucggcucacugcaaccucugcuucccagguucaagugauucuccugccucacucccgaguagcugggauuacaggcaugcacuagcacgcccagcuaaguuuuguauuuuuaguagagacgggguuucacuguguuagcuaggcuguucuggaacuccugaccucgugaucuccugcuucggccucccaaagugcugggauuacaggcauaagccacugugcccggccuuucuuuuuuuaagacagggucucacuccaucgcccaggcuguaaugcaguggcauaaacucggcucacugcagccuugacuuuccgaacucaggugauccuuucacuucagcuuccugaauagcugggacuacaugccugccugaaauuuuguauuuuuuguagagacgggauuucacuguguugcccaggcuggucucaaaauccugggcucaagugauccgcccaccuuggccuccuaaagugcugggaugauuggugugagccacagcuccugccacuccuugcuuucuuaaguggagaagcuggguggaguucauuauugaacuccauauggccuggaauugcccauaacauagagcaccugcugcugcucccagggaggcccucacagguggacaggugguguccauucccaugugcagucaggaucugcgugcuuguggauuauuacccucgccuuuuuuuuuuuuuuuuuuuugagauggagucucucucugucgccaggcuggagugcaguggcaugaucucagcucacugcaacuucugccucccggguucaugccauucuccugccucagccuccugaguagcugggacuacaggcgcccgccaccacgcccggcuaauuuuuuuguauuuuuaguagagacgagguuucaccauguuggccaggcuggccucgaucucuugaccucgugauccgcccgccucagccucccaaagugcugggauuacaggcgugagccaccguacccggccccucgccuuuaauaagggaaaggcaagaauagguacaaaaauauaaguaaacguuaaaaucagguuuauuugggcuuauucuuugguaguguauccuuucaccauauuaauauuuuccugaggucuagaaaaagaucaaggcuuuaacaaaaguucaguaguugaaaaagauuaccacuuucguuuuuccucacaagauggccuuuuugagaccuuuaaauggcugaugucauuguaaaacacuuuuuaaaaaaaauuuaauuuuauuuaauuuuuuuuaagauggagucuugcucuguugcccaggcuggagugcaguggugugaucuugcucacugcagccuucaccuccuggguucaagcaauucuugugccucggccucccaaguagcugggauuacaggcauauaccaccacacccagcuaauuuuuguauuuuuaguagagacgggauuucaccauguuggccagacuggucucgaacuccugacuucaaguuaucugcccacauuggccucccaaagugcugggauugcaggcgugagccacugcgcccggccguaaaacauuuuuauaacuaccacgauaaaagaccuuugugcuacuguuugcuuuauuuuuaugaaaaaucuuuucagcuuuucucagaaucugguuuuacccauggaauaucugugcgugggccuguaccugggcugucugccuugaugggagagguugagagcugcuguuuugggugguuuguugguuuguuuugguauuauccuugauuaccaaugaucugguuuuugccuagacuauaucccauaaauccaguuuccccuugagagguuaucuaauccuuuccucccuuuuaugauagaauccuuugcuuuuagaaucuggcagcgugccuucccacuuaaguaagcucuguuugcuuguauauuauuuuugcauuagaauguuaaguacuuuuagcugggcgugguggcuuaugccuguaaucccagcacuuugggaggcugaggcaggaggaucacuugagccaggaguuugagaccagccuggacaacauagcgaaaccuugucucuacaaaaaauaaaaaauuaccuaagugugguggcaggugccuguggccccaguuacuugagaugcuuaggugggaggaucauuugagcccuggagcuugaggcugcagugagcccugauugugucacugcacuccagccugggcgacaaagugagacucugucucaaaaaaaaaaaaaaaaaaaucuaagaaaaucagcuccuuaauuauauggcuagaauucuagaaauggaaggagcuugagaaaucauuuagcccaggcagcccauuuuaccaaagaggaaacaagugaaguugccauugucgucagugugauauuuucguaguucagaauagggaaaguagaaugaacagugggaucuggucuggggugucuuuaacccuguuucccuauaauagaaaauauucagaaagcauacauuugggugagucuguaccucucucauguacaguugagucaggaaaguagauuauaaaauuagaguggaguuuaaaaaaucuggauggauaguacauccuguuaacaaagucacauuauuugaaaauuuguagcacuuuuuaaugugaacaucucagaaauuugcacacucugcugaaaucacaguugcagaguugacaagagcuuuagaaauggucuggcuggggcagcuuuugacguaggauccucuucacaguguggccugauauaauuuagccaggcccugcuggaauucuucuaaucagagagcaucuuucuauuuuggagggaagcauuccuugucagaaaguccugggucucaguucugccuaaauguugucacugcaagagcauaguggagcaguuaugagcaugaacucugaacuaaacuguugagguucagaccccaagucugcggcucauuagcucuguaaucuuggacaucuuacuuaaucucuacaugccucaguuucuucaucuguaaaauggggaugaugauaauaauaccccucucacagaguggguggggggauugaaccaauuuuguaaaguacuuagaacacuauaguaaacauguguuugcuguuuuuuugcuugcuuuguugaggguuuuugcaucuguguucaugagagauauugguguguaguuuucuuguaacaucuuugucugguuuugauagaauaaugguggccgaggccgggcgugguggcucacgccuguaaucccagcacuuugggaagcagaggugggcggaucaccugagcuccggaguucgagaucagccugaccaacauggagaaaccgcaucucuacuaaaaacacagaaaguuagccgggcaugguggugcaugccuguaaucccagcuacucgggaggcugaggcaggagaaucacuugaacccagaaggcagagguugcagugagccgagaucgugccacugcgcuccagccugggcaacaagagcgaaacucugucucaacaaaaacaaacgaacaauaauggugaccucacagaaugaguuaggaaguauucccuuugcuucuguagagaauugguguaauuucuuccuuaaauguuugguacaauucaccagugaacccaucugggucugguacuuuucguuuuggaagguuauuaauuguugauuuaguuucucuaagagauacaggucuauuuagauuguuugcuuuuucuugggugaguuuuggcagauuguaucuuccagggaauugauaaauuucaucuagguuaucaaauuuuuaggcauagaguuguucauaauauuucuuauuuauuuacuuuugagauggaguuucgcucuuguuucccaggcuggagugcaauggcacgaucucagcuuacugcaaccuccgccgccugggucaagugauucuccugccucagccucccaaguagcugggauuacaggugcuugccaccaugcccagcuaauuuuguauuuuuaguagaguugggguuucuccauguuggucaggguggucucgaacuccugaucucaggugauccaucugccucggccucccaaagugcugggauuacaggugugagccaccgcacccagccucuuauuuauuuauuuauuuauuuuugagacugagucucacucuguugucuaggcuggagugcaauggugcaaucucggcucacugcagccuccgccucccagguuccagcuauucuccuaccucagccuccugaauagcugggauuacaggagcaugccaccacacuccuggccaauuuuuuuuguauuuuuuuuucuuauuuauuuauuuuauuuuauuuuuauuuuuuuuuugagauggaaucucacucugucgcccaggcuggagugcaguggcacgaucauggcucacugcaagguccgcuuccuggguucacgucauucuccugccucagccuccugaguagcugggacuacaggcgccugccaccacacccagcuaauuuuuuuuuuuuuuuuuuuuuuucuaguggagacgggguuucacuguauuagccaggauggucuugaucuccugaccucgugauccuccugucucggccucccaaaguucugggauuacaggcgugaaccaccaugcccagccccuuuauguaucuuuuuaauccauggggucuuauagcgguguuccuguuuucauuucugauacuaggaauuugugucuucucucuuuuuuuuucauaguuagccuggcuagaggcuuaucaguuuuauugaucuuuucaaaaaaccagcuuuugguuuuguugguuuucucuauugaguuccuguuuucaguuuuauugauuuuuguuucaguuuuuauuucauuuucuucugcucucuuuguauuuaaucugcugaucuuuuucuaguuuccuaagguugaagcuuauaugauugauuuuagcucuuucuuuuuuucuaauauauguauuaaaugcuuaaguuuuccacuaagcacugcuuucacuacaucccacacauuuugauaaauuauauuuucuuuuucauuuaguucaaaacauuuuaaaacuccucgauauuucuuuguugauccacguguuacauuuaugugugguuuuuuguuuguuuguuuauuuugagacggagucuugcucugucacccaggcuagagugcaguggcacgaucuuggcucacugcaaccuccgccucccggguucaaaugauucuccugucucagccucccaagcagcuaggacuacaggcacccaccagcacgcccagcuaauuuuuguauuuuuaguagagacggguuuucaccauguuggccaggauggucuggaucucuugaccucaugaucugccugccucggccucucaaagugaugggauuacaggcgugagucaccgcgccuggcauuuuuuuuuuguuuuuuugggagauggagucuugcucuguugcccaggcuggagugcaguggcgcgauaucggcucacugcauagucugccucccggguucacaccauucuccugccucagccucccaaguagcugggacuacaggcgcccgccaccaugcccagcuaauuuuuuguauuuuuaguagagacgggguuucaccguguuagccaggauggucucgaucuccugacuucgugauccacccgccucugccucccaaagugcugagauuauaggcgugagccaccgcgcccggcucccuggaauuuuuaacucucagaguucugcacauugaacuccagcaguuugucgauuacagcuuagguuuuccuacccuggcaccgguucccauggagguuucugcucuguaaauugugauuccuuguguauuugccugugucuccaauuuuuaaaauuuauguauuuuuuucuuuuuugagacagggucuugcucugucacccaggcuggaguucaguggcacgaucagggcucacuggauccucgaccuccugggcucaagugguccucccaucucugcucccugaguagcugggaccaugggcgugcaccacuaugucuggcuaauuuauuuugauuuaguaagagaugaggucucacuuuguugccagaaugggcucaaacuccugggcucaagugauccuccugccccgcccucccaaagugugcugggauuacaggugcgagccaucacacgcagccugucuccaauuuuggggggcagcaauugccuugugaucucacuucucuuagggaucuaagaauaguucuugauuuuucaguuucuuuggcuuuuuuacuuguuauuaggacagauuagcaacuucuaaucuccuaacaugcuguacuggaaacuggaagccccagcaucacauuuuaaaauguacaauccaguggcauuuaguacauucagcauugugcaacuaccaccucuaucuaguuccaaaauguuuucgucaucccaaaagaaaaccucaugcccauuaaacaggcauuugcuacucccuucugcccccagcacuuggcaaccacuaaucggcuuucugucucuauggauuuacuuauuuuggcuauuucauauaagugggggaaucaugugauacgugaccuuuuaugucugguuucuuucacuuagcugaauguucugaguuucauaauuuuuugaggcucguacauguuguggauaucaguacuucauuccuuuuaugguuccuuguuuggauagacugcauuucgucuguccguucaucuguugaugcagguuuuaggaugguuuuggcuguuggcuguugugaauagugcugcugugaugauucauucauaaguauuugaguaccuguuuucaguucuuuuggauguauaccugggaguggaauaucugggucauauaguuuuucuuuucuuucuuuuucccuccccucccccucccucuuccccucccccucccucuuccccucuuccccucuuccccucucucccucucucccucucucuuucuuuguugacagagucucgcucccucuguugcccaggcuggagugcaguggcaccaucucggcucacugcaaccuccaccucccagguuaaagcaauucuccugccucagccucccgaguagcugggauuacaggcauguacccccacgccuggcuaauuuuuggauuuuuaguaaagaugagguuucaccauguuggccaggcuggccucgaacuccuggucgcaagugaucugcccgccucauacaguauuucuauuuuuaaucgauugaggaaccgccaaucaguagcugcaauauuuuaacauuccugccaggaaagggaauuuaccuuguccuccccucucucucuccguaucagcuucuuucauuuccuagccaagccuccucuguuccuucagcuguuuuucaugucacuuuguuuccaaaaucuccaccagccagccuucucuucucuucuuuugagacagggucuugcuuugucacccagacuggggugcaguagcauaaucauagcucacugcaaccuccaacuccugggcucacaugauccucccgccugagccucccaaguagaugagacuacagacaugcaccaccacgccaggcuaauuuuaaaaaaauuuauuuuguagagauugaggucucauuaauguugaccagguuggucuugaacuacuggcuuaagugauuguccccaccuuagccuccaaagggauagaauuacaggcaugagccaccauggccagccugauugauuuucuuucuacccucucccucccccacuuccccuuccucuccccaccuuuucuuucuuuuggacagggucucacugcauugcccagucaggacucagacucuugggugggcucaaggguccucuugccugagccuccugaguccagcuugauuucuuucucuuuggaugccuuucagauggggccaagguuuuaacagaauuccugacucaaggacagccuuggaguagcauggggcuagcauucccuugucuaagugucucagcagccuugucacacugcauuuuauuuaacuccaacccccaaguaccccuaccacgcaccaguguuuaaccaugcuucucaucuucaagcuugauguuuuguucuagugugagucucugcauuuaucucuguugcauuucaucuugccguaucugacucuccacucugcuccgucaagcaguuuugaauccugacuccacauuccaucuguucauucuggcuucguguuauuuucaaauuugauguaaugguugaacagagccaaccaaguaugaugccuuugaaagguuaccagaggccguugcagguuuccauggguuuauuauucagugaccuuuuagguggucauuaaaccuguuguaaauaauucacccaucuuucuuuucuuucuuuuuuuugaggcggagucucgcucugucgcccaggcuggagugcaguggcgugaucuuggcucacugcaagcuccgccucucagguucacgccauucuccugccucagccuccugaguugcugggacuacaggcgccugccaccacguccggcuaauuuuuuuuuuuuuuuguauguuuaguagagacgggguuucauguguuagccaggauggucucgauuuccugaccucgugauccacccgcuucggccucccaaagugcugggauuacaggcgugagccaccgcgccuggcccacccaucuuuauuuucauccaguuuccauuucaccaucuuguccucagucaccaggaaguuaggagaugccaggucaaaugccuguuuuuuuuuuuuuguuuuguuuuguuuuuuguuuuuuuuuuuguuuuuggagacagucuugcccugucgcccaggcuggagugcgguggcaugaucuccgcucacugcaaccucugccuccuagguucaagcaguucuccugcuucagccccccgaguagcugggauuacaggcgcccaccaccacgcccagcuaauuuuucuguguuuaguagagacaggguuucaccauguuggccaggcuggucucaaacuccugacuucaagugauccggccaccuuggccucccaaagugcuguuagaggugucagccaccaugcccagccucagauuuuuuuuuuuuuuuuggagguggggacagggucuuguucuguugcucacgcuggagugcaguagugugaucaucgcucacugcagccucagccuccugggcucaagcaguucuccugccucagccucccaaguagccaggacuauaggcaugcaccaccaugcuuggcuaauuuuaaauuuuucuguagauacagggucucaccauguugcccaggcuggucucuaacuccuggccucaagugauccuccugcauuggccuccccaaagugcugggauugcaggcaugagccaccgcacccagccaguguccuuuauuuccuuaaaauaacuuaaggaaaguacauuuuuuucuuuuuccuucaugucuuccccaaucuuguacuguaguucucuuaugcuucuauugguucugcccuuuuuaauaaaaauaaacaugcuucuucagugacucaguggcagaauaagauugagcgguuuuguuuucuguugcucuaaaaauguuaguauuuggccgggcacgguggcuuaugccuauaaucccagcacuuugggaggcugaggcgggcagaucaccugagguugggaguuucagaccauccugaccaacauggagaaaccccgucucuacuaaaaauacaaaaauuagccgggcgugguggcgcaugccuguaaucccagcuacucaggaggcugaggcaggagaaucgauugaacccaggaggcagagguugcagugagccgagaucgggccacuguacuccagccugggcgacaagaacgaaacuccaccucaaaaaaaaaaaaaaaguuaauauuuguuuuauaaaugauguaagaauucuauguaaaagcauuacucuugcuauuguugguauuuuaggaauguaaauaauaaaagcaaaaaaaauaggggugcaaagacagaaucuugauuuuuuuucuuuuuuuuuuuucugauuagccuucauggauuuauuagacaauccuagucaguuggugacaguauuuuggguaacagcuguuaagaacuuggcauugauaaugaaugccaucaggccuugaauacuguguggacuguuuugaacuauauaugauaaaguuuuccauuguaugugaaggucaggagacaaaaaacacauacagaacuuggaaauuaccccuggucuguuauguuuugauuaaggauggugcccuguccuauuuuuaauucaagacaaaugugaucaugauaaagaagaaagaaaaggccagaccuagcccauauuuucugauaacauugcaaaauaggaaauugaaggaaaucauggcacgucccugguuguguagcuagauuccugccuggcuuggaucguaagaguuaauugaaggccagacguggugguucaugccuguaaucucagcacuuucggaggcugaggcagguagaucauuugaggccaggaguucgagaccagcauggccaacaugacgaaacccugucucuacuaaaaauacaaaaauuagccaggcauggugaagcacgccugugaucucagcuacuugggagguugaggcaggagaacugcuugagccugggaggaggagguugcagugagcugagauugcgugacugcacuccagccuggacgacagagggagacucaaucucaaacaacauuuaauuggugaaugaaaauauacggucaacaguuggaaauguucugauagugguuuggcauuggauuuguuccccuggugcuguguauuuaauucucuggacaagguauaaacugaagaaagcucagggcucuguucugaaaacguguuccuccaccagccugcaaagugccugcguuacuuacccuguuuuuauauuaaauugcugagguucuuuacaaagugugagugccuuaagucauuaccggucauuagcaucccccuccaauuaguuuauugaacuaaauggccaguguuaguggggcugugaagaaacgggaaguuggagcgggagaguucuaacccaaugcgaaugaagugagcacuuaugggggaaggugucuguuggaaacccuggcccaccaggggaagcucuaggaagcugguagcagcauggacagaaaggcaguggguaccacugaagauauucccaacuuugcacuguuuugccugugggaaauucuguacguuacauuucagagauuuugagaugauuuugcuucagggaggcucaugcuaaaacacaagauagcagcaguggcuguaacuggugcugcuugcaaguuaaucucuuagaagagcaaagcugaagaccccacccgaggcgggacauacagagggcaaaaagcgucuuggagucaaaguggaaauugcccaggaaggcugauaaccucccuucuuugcuuacaagaaagcuuucgaauggccuccauucaugaaccuucugugaggccauuguucucuguuggggagugcaucaaauuguuccacagcaaaccugucagcgccaggucagauugauugucucagauucgaagcgggggcccagcgggugcaguuuaacaggguugucuagaaaaucuugccuggcgccccauuacggcccacagcugccguggauggaugggggcgugcucuuuacuaucugagguuugaucuccccuugucuguuaggauccguauuuuaggcugggcgcaguggcucacgccuguaaucccaacacuuugggaggcugagacugguggaucaccugacgucaggaguucgagaccagccuggcaaacauggugaaaccccgucucuacuaaaaauacaaaaauuagcugggugugguggcgcgugcuuauagucccagcugcuagggaggcugaggcaggagaaucgcuugaaucuggaagguggagguugcagugagcugagaucacaccacugcacuccagccugggcggacagauugagacucugucucaaaagaaaaaaaaagggaucugcguuuuaaucgagauuucuccaguuucccaccuuugcuuacucuagagauaaauguuggaaugagagagaggcuguccaccucugucucuuccccugcccccuucucacuccguuucacaaaacuuagcucuggaauaggacuacucaacauucacacaugaacagcugcuccugaggguacggagcuugagaaacacuagcagaaacuugaccccaccccugcacccauccaccuugguccaagaccccaaagcuccuuggggauuuuuaccugcaaacgugcucuuguuucagggacccaucuucacgcauccucucugggguauucugggauucaggccaagggcaugcuguguuuccagggauaccguagccaagggcaugguucccgacacccgacacccguggcuggagucugugucccugguaauuaauacccuacaggauggcuguaagaugacucucccaagguuacagcccaaucaugagggagaccccuuauuuccuaaguguuuuaagaguggcccuuccugcgcaucucaccugucagcuuuggaacuucuggaaggauugugcuaaagccuuugcugcuggaaaucucacugcuguagguggacaugaggcucucugcuggagaggcugccacaucacaccugugacauucaagagagacugccagccauggcauaugagaguuguuuaggaagcucaggauggaagucaguguggaauaccggcauugcuguuacacuugcugcuuauguuuuggguuggugccuggccuguuuuuuuuguuguuguuguuguuguuguuuuuccccuugaaguggagucucgcugucgccuaagcuggagugcaguggcacgaccgaucucagcucacugcaaccuccaccucgcagguucaaaugauucuccugccccagccuccugaguagcaaaugauucuccugccccagccucccgaguagcugggauuacaggcacccgccaccaugcccagcuaauuuuuguauuuuuaguagagacaugauuuccccauguuggccagacuggucuggaacuccugaccucaggugaucgacccgccucagccucccaaaguguugggauuacaagcaugagccacugggcccggccagaaaucuuaacauuaaacuaaaaaggauuuggggccgcaugugguggcucacaccuguaaucccagcacuuugggaggccgaggcaggcggaucacuuaaggucaggaguucaagaccagcagcuuggccaacaugcugaaacuccaucucuacuaaaaauacaaaaauuagugggcaugguggugggcaccuguaaucccaacuucucaggaggcugaggcaggagaauuguuugaacccagaaggcggagguugcagugagcugaggcugugccacugcgcuucagccuggguggcagagcgagacuccaucucaaaaaaaaaggauuugggccgggcaugguggcucacuccuguaaucccagcucuuugggaggccaaggcagggggauugcuugagcccagaaguucgagaccagccugggcaauacagugagaccgccuucucuacaaaaaaauuuuaaaacuagcuggacaugguggcuccccagcuacucgggaggcugaggcagaaggauuucuggaguccaggaguuggaggcugcagccugggcaacagagcaaaaagccugugaucugaaaaaguugugaacuuugcuuuaggaaguccugccacuuuaacuacaaaccuucaaauucuuugucuuucagcuuuaggguugcuauauuuaagccagguuuaacaggagaaacaauuccaucuuuuuuuuuuuuuuuuuuuuugagauagagucucacucuguugcccaggcuggagugcaguggugcgaucucggcucacugcaaguucugccuccucccgccucccggguucacgccauucuccugccucggccucccgaguagcugggacuacaggcgcccaccaccacgccuggcuaauuuuuguauuuuuaguagagacgggguuucaccuuguuagccaggaugaucucgaucuccugaccucaugauccacucaccuuggccucccaaagugcugggauuacaggcgugagccgccgcgcccggcccuguuuuuuuuuuaauccuaauuuuuaaaagcacauuugcgaucgucacacccugauuuuucaaaaauagccuugugauugucgcugucucuugccuuucauauagcugaauccgcuagauuagccucaguggucagcaaaagggaguccacggcgccugaccugugcuccgaaauaugcguaauauuugaugcugaguauacaaaacuggauauauucaugccaguagaauuuucagaauuuucaaaagaaaagugaauugaaauauacugacaaaauauuuuaauggcgaucucaacaaaacauuuaaaaaguccucaacaaaaaucaaaucaaacaaugugcaagaagaaugauacaccaugaccguauaggaucuaguccacauacauaagacuguuucaacauuugacagucaauaauucaccaaucaauacgcuaaaaaagaaaagucacagcauaccaauuaaugccgaaauagcauuucagaagaugcuauucauucauucaugaugaaaacucucaaaguuaggaauagaggggcucucucucaauuugauaaauaacaucuacgaaaaccuacuuaauaaacauacuuaaaggugaaaaaagaauuggcgacauuguggaaaccccuaagcauuacuguucaagguuaucagugcuuucauuuuucuuucauagcggaauucggagugaaacaacacaaacuuacccuacagagcgagaaaagucuugagugaaauuauuugauacaccaaacaagcagauaaauaggaacccugauuagguauuugaugauauuaaauaauugugaaauuuuagguaauacugccauuaugguuaguuuuuauuuauuuuacuuuauuuuuuuagauagggucuugcucuguugcccaggcuggagugcaguggugcaguuaugacucauugcagccucuaccagccaggcucaagcgauucucccaccucagccucccaaguagcugggacuacaggugugcaucaccacgccuggcuaauuuuuguauuuuuuacuagagacggguuucgccauguugccuuagcugauuuugaacucuugggcucaagcaauccacucuccuuagccucccaaagugcugggauuacaggcauaagccaccucucccagcuuauuuuauuuuuuaccuuuaagcucuauuggacuugauaugguuaguuuuaaaaagaguuguuaucuuuuagagauguaugaugcgguauugagaggggaaguuauaugaugucuggcauuugcuucaaaauaagugguaucgguguugggagugggagugaagucaaacaagauucauucugcguggaucauuauagugguuagugaggagcacauggggcuucuuacucucuguugucuacuuugguaucuuaucaauuuuacacaauacgagaagguaaaauuacuugauauaaagcauguuugguuucaucuguuaggauggucuaucaaaaagcagaaaauaacaagugcugggaaggagguggagaaaucggggcccuugugcacgguuggugggaauggaaaauggugcagucacuauggagaacgguauggcggcuccucaaaacacaaagauacaaucacccuaaagauagaaucaccguaugauccagcaguccgccuucugggcauauucacaaaagauuagaaaacagggccuugagguauuuguacaccagcauuagcagcauuguucacaauggccaaaagguggaagcaacccagcgucuguuaaccagggaauggauaagcaaaacaugguauccuucuaacggaacaucauccagccucgaaaaggaauuccaacgcaugccacagcaggggggcaccucgaggacauuaugcuaaugaagccaguuacaaaaggauaaguguggugugaucccacucauaugagguacuagaauagucaaauuccuuuuguuuuuuuuuuuuuuuuuuuuugagacggagucucgcucugucgcccagcuuggagugcaguggcgugaucuuggcucacugcaagcuccgccucccggguucacgccauucuccugccucagccuccugaggagcugggacugcaggcacccgccaccacgccuggcaaauguuuugcauuuuuuaguagagaugggguuucaaaguguuagccaggauggucucgaucuccugaccucaugauccgccugccucggccucccaaagugcugggauuacaggcgugagccacugcgcccggccucaaauuccuuuuuuuuuuggaaacagucucacucugucacccaggcuggaguacaguggcaugaucucagcucacugcaaccuccgccuccuggguucaagcgauuguccugccucagucucccaagugacuggaauuagcauggacuaccaugcccagcuaauuuuuguauuuuuaguagagaugggguuucaccauguuggccaggcugguuucaaacucccaaccucaggugauccacccaugucggccucccaaagugcuaggauuacaggcaugagcuaccgcaucuggccuagaauggucaaauucuuuauuuuuauuuuuuugagacagggucucacucugucaugcaggcuggagugcaguggcaccaucuuggcguacugcagccucgaccucccaggcucaggugauccucccaccucacccucccaaguaggcgggacuacaaguguggcaccaccaugccuggcuaauuuuuguauuuuuuguagagacggggucucgccagguuggccgggcugaucuugaacuccugaacucaagcgauccaccuuccucagcuuccuaaagugcugggauuacagguuugagccaccacgccggacccuuagucaaauagucaaauucacagagacagaaaauagaaugguggcugccaggggcugggggaggggaaauaggaaguuaguauuuagugggugcagaguuucaguuuugcaagaugaaagaaguucuagagacggguagugguggugacgguuggaugacagugugaauguacuuaaugcuauuggccuguacacuuaaaaaugguuaagaugguaaauuuuuauacuguguauuuucccacauuaaaaaaacuuguuuggaauuuggaggaaaaauuagaaggcucacgccuguaaucccagcacuuugggaggccaaggcagguggaucacgaggucaggagaucgagaccauccuggcuaacauggugaaaccccgucucucuaaaaacacaaaaaauuagccgggcacgguggcaggugccuguagucccagcuacccgggaggcugaggcaggagaauggcgugaacccgggaggcggagcuugcagugagccgagaucacaccacugcacuccaggcugggcgacagagugagacuccgucucaaaaaaaaaaaaaaaaaaauuagaaggcucacuuuaagcuuucaaaaguugcaauuguaggaagugaggauuacuuugcagguucuguuucaaauucauauuuuuaucaaccauaacacaagcucugagagggcaggggcuguuuuacucaccauuauuuucuugguaccuagaagacuaccugggccucgagaaagacggauggauggauggaagaagggggaaacagaagccccuucuucuggauucuccugcccugucauuccuccuuagcucucaguucuaguuggggacagccccaucuccgugugcgggagauaccuagacucuaaacugcagucucagcccagccccuuccccuucucuucucaccccugcagccaccucuucacccccaacuucguucuugggacucuccuggcauccuacccugaggcucaugugcagggucugguccccuugcuuccuucuuaguguucagggugggaugugcaccagggagaaggacauagggguuccuccuccaucuguuccugcucauucccuggucuuuucucaugaugccaccaugcaugccuugcgcuccccaacacgaggagcccgauguagcucucaggcccugugagcuggguaguggugagcccaugcccagccauagaccgccugguggcggacaggcaggugucccagccugugagcaagagaguggauccagaugugcagagcuugcaaacagcucucaccuuuguuuuuuuuuuuuuuuuuuuuuuuuugagacggagucucacucuugucagccaggcugcaguggagugcaauagcacaaucucagcucacugcaaccuccaccucccggguccaagcaauucuccugccucagucuccugaguagcugggauuacaggugcccaccaccacaccuggcuaauuuuuaguguuuuuaguagagacgggguuucgccauguuggccaggcugguuucgaacuccugacuucaggugaucagccugccucggccucccaaagugcugggauuacaggcaugagccaccgcgcccagccucaccuuucguagaacagcugcauuguguguaacaguauguggugguaugaugcuuguccugggaaaagugaauaaaugcagggaaaguuucacuguacuauuaaaaaacucaauuguucuguuagcuuaagaauuuauuugacacuuaauguguguguuuuuuguuuguuugaggcaggucucgcucugucacccagucuggagugcaguggugugaucucagcucacugcaaccuccaccucccaggcucaagcgauucucaugccucagccucccgaguagcugggaggucccaaguagcucccaaguguaccaccaugccuggcuaauuuuuuccuauuuuuuguagagacaggguuuuaucauuuugcccaggcuggugucgaacuccugaacucaagcgauccacccaccucaaccucccaaauugcugggauuacaggcaugaccuaccgugcccggccuuaauguguuuuuauuuuaaaaauuaacuucaagcuggguggggugucccacaccucugagacagagugagacccugacucggaaaaaaaaaaaaaaagaaauucacaucaauguaaugcacaaauuauuaaaguggcucuuuuaaaguguacaagugauuuucauguagacaucauugguuuuccuuaacgggguggaugucagucagugguucucaagggaggagggaggaggauugcccccaggggaucuuggggaaugucuggagacacuucugguuggcacaucuugguggggaggccgcggacauccagugguuuugaggccgggaugcugcugaacgucccacaaugcacgggacagccccacagcuaaacauugucuggcccagaguguccagcuguugagaaacccugaucuaaauaaugucuaagcuauguauuugguguuucaaucagcccuuuaaaauuuaguuuguuugggauucugaugaagaaauccuuaaaccugugcauacagagauucuuuggcaguguucagucuuuggaaaaaaaaaaauaagaguaauuaaaaaaucuguuuuacagcugggugcagugggucacgccuguaaucccagcacuuugggagacugaggcaggcggaucacuugaggccaggaguuugagaccagacuggccaacauggugaaacccugucuccgcuaaaaauacaaaaauuagccaggcacgguggaucaccugaggucaagaguucaagaccacccuggccaacauggugaaaaccccucuccucuaaaaauaacaaaaauuagcugggagugguggcacacauuguaguuuuauuucacuucagccugggugacagagcaagacucucaaaaaaaaaaaaaaaaagaauuuaugacuagggacaauacuuagagacccagagauaaugccuuuuuauauuuugauuuuaaaacugugaauauuuuaccuguuccaaaugcuuuuuugaggaaaaaaagaaucagcuggagauuuuaaacuuagaguuuaagauacuuuucuacccaugucaucuuuaacaagggccuacuagcucgccuuuggaaauuaacuagcaggauuuuaaaaucaaagccugagaacuuggagcaugcaagggcaccugucaccaccugcuggcaguguuccuuaauugcagguucuuaugauagaccaagguuuaaaaguugaaucugcaaaugaaaccuguaacaucaucuaggauuuauaggugagacgccaacagucucuugcaauauuuagcuguuguuuuuuaagggcagacaugaccaaccuacgugucaugauaagaggcacacaucacacucuuguuugaaacaguggguuucuuuuuucuuuagagauagucuuguucucccugaggcuggacugcaguggugagaucuuggcucacggcagccuguaacucuugggcugaaacauuccuccugucucagccucccgaguagcugggaguacaggcaugugccaccaugccagcuaacuuuuuuuuuuuauucaagagggaaucucgcuuugucacccaggccggagugcaagugacacaaucucugcucacugcaacgucugccccccagguucaagagauuccccugccucaaccuuccgaguagcugggguuacaggugcaugccaccacgcuugguuaauuuuuuuuuuuuuuuuuuuuugagauagaguuucgcuccugucgcccaggcuggagugcaguggcgcaaucuuggcucauugcaaccuccgucacccugguucaggcaauucuccugccccagccucccaaguaucugggauuacaggcaucugccaccacgccuagcuaauuuuuguauuauuauuauuauuauuuuuugagauggaguuucacucuuguugcccaggcuggagugcaauaguguggucucagcucccugcaaccucugccucccagguucaagcaauucuccugucucagccucccaaguagcugggauuacaggcacccgccaccacgccugguuaauuuuuguauuuuuaguagagacaggguuucaccauguuugccaggcuggucucgaacuccugaccucaggccaucugcucaccuuggccucccaaagugcugguauuacaggcgugagccacugugcccggccaauuuuuguauuuuuuuaguggagacgggguuucaccauguuggccaggcuggucucgaacuccugaccucaggugauccaccugccucggccucccaaagugcuggaauuacaggcgcgagacacugugccuggccuaauuuuuguguuuuuaguagaaacaggguuucaccacauuggccaagcuggucucgaacuccugaccucaggugauccacccgccuuggccucccgaaguguugggauuacaggcgugagccacuguguccagccuaauuuuuuaaaacauuuuuuuguagagacgggaucacaccuugucacccaggcuggugucgaacuucuaggcucaagcaauccuccuaccugggccucccaaaguguugggauuaugggugugagccacugcgccuggcuggaaaccguggauuucuaguuacaaagucuucuuuacuuacaaucagguuuaucuucugauaaacccaucuuuguaaagucuaaaaauccuaaguugagccacuguaaguggggaaccauccauaugagugaauaaaccggaaaggaacuguucguguacuggguugacugauaucagggccacccugggaccugugguuggcgucugggcucugcaaccaaccugcugaaauccccguuacuugugagacuuaggcauggguccagccucucucucucuuuuucuuuuugagauggagucucgcucugucacccaggcuggagugcgauggcgcgaucucagcuuacugcagccuccgccucccagguuccagcuauucuccuaccucagccuccuggguagcugggauuauaggcgugugccaccacgcccggcuaauuuuuguauuuucaauagaggcgggguuuuaccauguuggccagguuggucuugaacuccugaccucaggugaucugcuugccuuggccucccaaagugcuaggauuacaggugugagccaccacgcccggcccgggucuagccucucuuuagcccacagaguuggguugugcuggggcagcauagcuuauauucauguuaauccuaaaguugauuauuguauuuuuuucaucuugacuuaaaaaucaaauaauuucuaaugacugaaaucuaccauaacccuaaaaaaugagucauauccugaaaugauaggugugugccuagcuacagccugcacuuguagaagguuugauugccagcuuugcuuuugcauaguuuuaaauuaauacauucaaaguuuaguuuuuuuuugaaacacauuacuuaccuaauaacuuauuaaauaaccauucaagauuuauuagucaaggacucaaauuacuuuuauguaagaaaaguaaacaggaguuuggcauguuugcuauguuucauuuuacacauuuuuuuaggccuccauuuauaggguauaaaacuuuaagaaaacauucucauuagcuguaaaugauucgaauugcaaauaauacuaaccuaagcauugucauuacuuuuaaaaucuaaguuucuagaaguuuaaauuuuuacucaauacaaaaaugaccugguucacauuauuagcugcccaacaaacuguuuaaaaaacuaaguauucuuuguuaaagaucagauugcaagaaauguuuuccaugcucuuauuuuaaaaaacaagauuccgacauacauaaugaaucuaaaucagaauucaccaaugguggcugaaauagugucagcuuucagcccaauacaauauaaauccacaguuauaaugcauaaacaauucaaaguuaaaauuuauaguggaaaugucaacaagucacaacuacuacacauuacuacugauggguuccacuacaggcacagcagaugugcacaucugauagacugcuuagaaaauuaaagcuaucaaagcuauaaauaaagaauacauaaauaugaacauggcgauguggaagcauuagagccguuaaaaaaagugaauaagcugggcgcggugacucacuccuguagucccagcacuuugggaggccgaguugggcggaucaccugaggccgggaguucaagaccagccugaccaacauggagaaaccccaucucuacuaaaaauacaaaauuauccaggugugguagugcacuccuguaaucccagcuacuugggaggcugaggcaggagaaucgcuugaacccgggaggcagagauugcagugagccgagaucacgccacuacacuccagccugggugacaagagcgaaacuccgccucaaaaaaaaaaaaaagaauaagaugugauguaaacacaucugauaguucugucuguaagccacuuuccacugauuuauaaugcuaugguuuuauaauucuuuuaaaaaggaaaauuuuucuacacugcugcauucaguaucauuguacauucucgacuacagugcaaucuuuaaauccucuugcagagcuugacauaucucaucagaauuuccccagaaaaucagcuugucauauuuucagcagccuuuagugcuucaguagccuugcgaagcuccuuaauaacugaugauaaagcuucuggguuaauuucuuguucacaaagccguacacaaauaggaguuuccauaucuaagccagcauucuaaauucuugaaaucucaagcagaaugugugauuaguacagguuggauacucuuaaucccaaaaccugaaaugugaaaugcuccaaaauccgaaacuuuuuaagcaccgacaugacaccacaguggaaaauuccacaccucaugugauggaucaaagucaagaugcaggugcacaacacacaguuuauucagcauccuguccauggucucccgcaccgcauuuggauucgcugccacggcuacucgccauggcugaggccaagggaggcaggagaagcaguuuaguuuguuuuuuaaaaccuccuagaaugugaugaaaugagucagguauagacuuccgacauaggugacacguuccuagacuugcagccaguagucucuugucuuugccauuuuuuugugaugaugacagaaacaucggucacuuguuucuguaaauguuuuaugaugcaaauugaaugugaugaaauauuaaaaauaucacucauuaaauauuuaaaaguucaguguuuggaacuggccagaucucauucuacugccagcuuaagagcgauuuagaaaauuugaauuauaaaauuggaauacugggaacauaguuacacaguuauuuuuccaccgaacccuuaaccauuucagcugcaggccuuuccauuugggcagcagaaacacacauuuuacguuacuacucaucauggguuuucuguaaugugcucugccugguauuuuuacauccccguugggcuaaauaaagacauaaauucauuuaguuuaagucucaggaguuuuauggacucaaauauuagaagaauauuuaguuuuaguauuuauagugcuuguaauuuuauuaauaaaaccuuaaaguaugaagccaaauuggaaucgaauauuaauuugauuaguggcaaauugaacuagcaauuuuugcuuuaaaaugaaagauuggaggccggaugccguggcucaugccuguaauccuggcacuuugggaggccaaugcaggcagaucaccugaggucugaaguucgagaccagccuggccaacauggugaaaccccaucucuacuuaaaauacaaaaaaauuagccgaguguggugaugcacgucuguaauuccagcuacucaggaggcugaggcaggagaaucacuugaaccugagaggcaaagguugcagugagcccagauugcaccauucauugcacuucagccuggaccacagagugagacuccaucucaaaaaaaaaaagaaagugaaagauugguaacaaacaauggaguuuuuggaguccuuucuuuaaaauggccuaucuuacaucuguaacucuaagcuucuuccagccuacaucauagcaugguuuauuuucauagauaccugagcuggauguuguagcucacacuuguaaucccagcacuuugggaggccauggugggagaauugcuugagcucaggaguuugacaccagcgugggcaacauagcaagacuucaucucaacuaaaaaaacuuuuuuuuuuguuuuuugagacagaguuucacucuugucgcccaggcuggagucaaacuccaugguuucuccauguuggaguggugcgaucuuggcucacugcaaccuccaccucccggguucaagcgauucuccugccucagccuccugaguagcugggauuacgccuggcuaauuuuuguauuuuugguagagacggaguuucacuauguuggccaggcuggucuugagcuccucaccuuagguaauuggccugccuugaccucccaaggugcugggauuacaggcaugagccacugcacccguccuaaaaauuuuuuuaaaaagauaaucuggagaggauguugaguuucagugguuagauaaaguguucaaccugauugcaaagucaaguuauucucucagagagccguuucagaccugaugcuggugcagucugugcguaaagcucccacagacagccucacacauaccuccugccggcagacccccugcugcuccagggaggcucgcaggagaaaggugccguaccauagccagccuucuucuucuucuucuucuuuuuuuuuuuuuuugagacgaagucucucgcuucucucccaggcuggagugcaauggcacggucuuggcacacugcaaccucugccuccuggguucaagcgauucuccugccucagccuccugaguagcugguauuacaguugccugccaccacgcccggcuaauuuuuguaauuuuuuuuuuuuaguacagacgggguuuuaccauguuggccaggcuggucucgaacuccugaccucaggugauccacccgccuuggccucccaaagugcuaagauuacaggcgugagccaccgcauccggccccuuauucucuucuuagccagucucuuguuucagagcagccuauggacggggggagaagacggauuucaaagacacuuuuauuuuuggucuuuauggucuggguuugauuucauauuaagucccucuguaaucuaaccuuccauaacuuaaccuuuuccagacugaugucuuuugaccuguugguuucgugcguugucucuagauuuucuagcucucuugcucagaacauccaccuggagaaacaaacaaaaauaaaaaaaaacaccuucgcaguaucuuuugaauucccagcuccaaagcuaucuucuccaugagagaauucauaaaucagggcaacugaucugauuugcgcauuugagguuucuuauauacucauuucccaaauaguuccugcaugugugcuaagcauaauuccagguacugggaauuagagaaugaaaaggccacuuucucacagucugcguguguguguguguguguguguguguguguguguguguguguguguuggggaggagaaauaacaccaccaccuuuugauacuuacugagugccagacacucuucugaacauuuuauauguaaugaacugugauugcauguuuaaucacacaacgaccuaugagauggggacuauuauuguccccauuuucuagaugaggaagcgaaggcccugaggucgcgggcccuuuggagcccaggcaggucccacccaggccuuugggcacugggcuccagugcccuccccugccgucuucuccccagguguuggaacagagggacagagcgagguuggugagagcagcaggaaggaccuuuucaacagagcccgagugagauacugagucccugaaacccuggcaggaugcgagagggcagaacuguaacaauauuaagacauuauuugccguuuucucauccucuuaggcugcacuguggcauuuucuagagacuauguuaaggggagcaaggcagcaggcugagugcagggggagcggggguagagacgagaacucaggugucuucugugaagguggacaacaaagauuugcaaaaacaaaacuguugccacucuucuuaguaagcuuuguuuucaaaaaguuauuuucauaaaaauauuguuuaugugaauguauuauauaauguguuuguuuuuuaaaugaguuaauaaguauuaaaauuaucuuuuuuguugucgucguuguuuuuugagacauagucucgcucuguuguccaggcuggagugcaguggcgagaucuuggcucacugcaaccuuuaccucccgguuucaagugauucuccugccucagccuccugaguagcugggacuacaggugugugccaccacgcccagcuaauuuuuguauuuauaguaaagacaggaggauuuuaccauauuggucaggcuggccuugaacuccugacuucaagugauccgccugccuuggccucccaaagugccaggaucacaggcuugagccaccacucccaggcuuuuuuuuuuuuuuuuuuuugagacagucucgcucugucgcccaggcuggagugcagugguacaaucuuggcucacugcaaccugcaccucccagguucaagcaauucuccugccucagccgcccgagaagcugggucuacaggugcgugucaccacacccggcuaauuuuuguauuuuuaguaaagacaggaggguuucaccauguuggccaggcuggucucaaacuccugaccucaagugaucuguguggccagccucccaacacgcugggauuacaggcaugagacacugcuccuggacugguuuuaauuuucaguguaguaaaugcugauagauagauagauagauagauagauagauagauagauagauaaaugcugauagaugauagauaaaugcugauagaugauagauaaaugcugauagauagauagauagauagauagagauagguggguggauggauggauaaucaacugacugaccaauccauuuaaacaaaagcuauuugggucccucaguaacuuuuugguguacagggguucugagaccccaaaguugaagacccauuguuguagaagcuucccucuggcugccgaguaagugccgggauaaggacagggaggcuuguuacuuggcuuuugugaccuuucaggaaggagguaagaaauggcugugucugaguuuguguguauguggauuuuuuuuuuuaaauguaaacuacagcaaaauuuuccugucuaccauuuugaagcguucaguucaguagcaucaaguacauucacacuauugugcaaccaaccuccaaauuccuuucaucucacaaaaccgaaauuuuauacccauuaaacaacaacuccccggggucuggguuuauuuaggaagugaagccagaaggauuugcucuuggcuuggauguaguguguacaaaugucugguaaauguuucauuaauuagagaggaggcagcggcuuggcgcaguggcucacgccuguaaucccagcacuuugggaggcgaggugggcggaacacgaggucaggaguugguagaccagccuggccagcauggugaaaucccgucucuacuaaaaauacagaaacugagcgugguggugagcgccuguagucccagcuacucgggaggcugaggcaggagaauugcuugaaccugagaggcgaagguugcagugagcugagaucgcgccauugcacuccagccugggcgacagagcaaggcuccaucucaaaaaaaaaaaaaagagaggaggcagcuuuguucuggucugucuuccuuccagaugcaagccuucacacgccuacucugagccuuacacgugagcgugaccccccucccugggugccacucuggggaaagugcagguacagcagagguagcaucacauccuggaauguugcacgaagauccuucuggauugacucacacuuaacagaaccugagugguucauucaauaaguaggccccgucuacuuggaaacaacguuuucaagccauuucuuuccaucuuuucagaucagcuuaaucgaggaguccccugguucauucauagucugagguuauaauggaagcuguuaacccucuuaaggugaacauaaaaggaaaauggaaauauuugagcuguggaacagggcccccagugugcguguggagauacugcuggcucagggagggauucauggcuaccaggaggacgucugacaucgacacuuaggagccgagccccaggcaaagcaaagcagacaggggcuaaaugaucaucuucucagggaagugaggucagcagcggccagaaaagcaaaaguagcaguucugguagagucccaaucaagaagggacaagauagcacuucuccagugauccgggccaucaccgagaggagggugggggugucccugguuuacgaacgaggaacuugagaucaguuugucagaggcauuugaaccagagcgacuccaucuugaauagggucugggugaaauaagguugagaucuauugggcugcauuccuaggagguuaaggcauucuaagucacaggaugagguaggaggucaguacaagacacaggucacaaagaccuugcuuauaaaacagguugccauaaagaagcccgccgaaacccaccaaaaccaagauggggacaaaagugacuucuggucguccucacugcucauuauacacuaauuaaaauacauuagcaugcuaagagacccaccagcaccaugacaguuuacaaaugccauggcaacgugaggaaguuacuguaugugcucuaaaauggggaggaguccucaguuuccgggaauuucccauaucuuuccgggaaaacucaugaauaauccacccuucguuuagcguguaaucaagaaauaaccauaaaaauagccgaccagcagcccucagggcugcucugccuguggaguagccauucuuucuuccuucacuuucuuaauaaaguugcuuucacuugacucuguggacuugccccgaauucuuacugcaugaaguucaguaacacugucucgggggcuggauugggacccuuuuccggcaguaaguuaauguacuuaauuaaggucacacagcucauaauagagggaggcuggaauuggaccccaagccuaacucaaaaguggauuauuuuuuuuuuuuugaggcggagucucacucugucgcccagucuggagugcgguggcgugaucuuggcucacugcaaccuccaccucccagguucaggcgauucuucugccucagccucccgaguagcugggauuacaggugugugccaccacaccuggcucauuuuuguauuuuuaguaaagacaggguuucaacauauuggccaggcuggucacaaacuccugaccucaggugauccgcccucgucagccucccaaagugcugggauuauaggcgugagccaccacgcccggauggauuauucuuaaacacucuuguuuucagucaagugguggguuuuucugaaauucugcagaguuuuauuuuaauacuuuauuguguuuugcaucuuugcuuuacauuauuauuuguaauacaaauuuaaaauuaauauugggcagcugggugcggugguuuaaugagugagugagcugagauccuaccacuacauuccagccuuggcaacagagaaaaaagaaaaaauaauaauaauacuggggccaggugccguggcucacgccuguaaucccaacacuuugggaggccaaggcaggcggaucacuugagcccggggguucaagaccagccugggcaacauggugaaacccugucuguacaaagaguaaaaaaaaaaaaaaaauaagucaaguaugguggugcacacacauagucccagcuaccugggaggcugagugggaggaucaccugaaccugggagguugaggcugcagugagucaugauuacaccauugugcuccagccugggugacagagcaagacucugucucaaaaaaucauaaagaagugaaaauaccuuucuuuguaacuuuucagugauaggcugaaaacagagauagucuucccguagccaucagucuuuuuuuuucccuugauuucuagagcaauuuauuucuuauuucugguugcuucauggauucagauaauuucaacauuacuuauucuggaauuuagaauuucaucucauuugggucuugauaccaaauuuugcgacagaacugugagcacugucuucaagccuaaugagaguuuuauuauuuuaauagcaggugugugucuucaaaaguaguggaguugaaaauaauauuucuaaccuugucuauuuuuuucucuuguuuuaaacacaguuaacaagcacaagcccuggcuggagcccaccuaccacggcauagucacagagaacgacaacaccgugcuccucgaccccccacugaucgcgcuggauaaagaugcgccucugcgauuugcagguaggaacggggcuuucauugacucuugaugaaucgggccuggucaggaagcauucugcacaucccauuuggguaaugcugagcguuucugaaaaugucuccauagcugaggguuauuuguagcguccuuuguagcauguuuuuuuuuccuuuuaauaguugggguagcugacaaaaaggccuguucuuauaguugaaaaacaaacuguuuaauuuaauugcauaauuuuuuucuuuaucuuaauguagccagauaacuccuagaccagugcaucccuggcucuagggugcacacggaguaccugaggaauguagagacagcgggucugggaggaccugagauucugccuuucucaccugcuccuagguacugcugguguugcugguccucaaguggcauggagccggagaaucacagcgccagggguuccuugcauuaccuagauuucaaugaccugagaagacuuacuugaagaaguugagcggucuuuauagaggaaugcuuuuggcauagauuuuaccuucagugaauuuuaaagacaugagauuguagccucagucuuuauagagacaaaccuguagcauugcuuuggagauuuucauacuguaauaaccguguacauugcuaacacuuaauagcauuuuccaagucagagcuguucuggcuucacguuggguccuuaacugguagagaaugggcugcgccaccuuuuuucugccucagaguuggaguugacauuguaaaguuaauuuuuaagaguuguuuucgcauauuuuuccagaucagaucuucuccugcacggcugggcacagugacaugccuguaaucucagcacugugggaggcugaggcaggaggauugcuugaguccaggagguggaggcugcagugagccuugauugcaccacugcacuccagccugggcaacagagcaagaccccaucucaaaaaacaaaacaaacaaaaacuucucguauuaaagaguguucuggccgggcacaguggcucaugccugugccagcacucugggaggccgaggcgggcgggucacaaggucaggagaucgagaccauccuggcuaacacggugaaaccccgucucuacuaaaaaaaaaaaaaaaaaaaaaaaaaagccgggugugguggugggcgccuguaguccuagguacuccggaggcagaggcaggagaauggcgugaacccaggaggcggagcuugcagugagccgagaucgcgccacugcacuccagccugggcgacagagugagacucugucucagaaaaaaaaaaaaaaguguucuauuugucuagggacaaauaagaaaaauuggaugaauuuguaugaaacauauguuaauuuuacuauaguaaguugaaggaaauaaacaugaguuuguuucugaagaacuauuugaaaaauaaauuuguacuucauucuguuuaggcgccacaucacauuuucagcacagucacccgugaaccagcuugugcuguaaagauagagccucccaaguuguuuuguguguuuauuaauuuucagagagaauucugaugaaaaggacaguagaggcaguaccccaugccgugaacacacacacagcauuuguccaguugccagggugauuauuuuugcuuuuucccccacauuuuuuuuuucuccugaaacagucuugcucugucacccaggcuggagugcaguggugcaaucucagcucacugcaaccucugccucccggguucaagcaguucuccugccucagccuccugaguagcugggauuacaggugccugccaccacgcccagcuaauuuuuguauuuuuaguagagaugggguuucaccauauuggccaggcuggucuugaacuccugaccuugugauccacccgccuuggccucccaaagugcugggauuacaggcuuaagccaccaugcccguccuaauuuuuguauuuuuaguagagacgagguuucaccauguuguucaggcuggucucgaacuccuggccucaggugauccaccugccuuggccuugcaaagugcuaguggauagaucauuuuaacagaauuauuuaguuuauguuuuugagcaguuuuauauacauuacugauguuuuacgcauuucaagaagugauugcaguccaggcuuguguauuugcucccucagguccuccuuugccuuuugaaguaucagcaguccuguuguucgugcagugugaucuuacuauguuguuaauaauugaugcacuauuuuauuuuauuuuguuuuguuuuauuuuugagacggugucucaguuugucgcccaggcuggaguccaguggugcaauuucggcucacugcaaccuccgccucccagauucaagcaauuuuccugccucagccucccauuagcugggauuacaggugcccgccaccaugcccugcuaauuuuuguauuuuuauuagaaacaggguuucaccguguuggccaggcuggucuugaacuccugaccucaggugaugcgccugccuuggccucccgaagugcugggauuauaggcgugagccaccacacccagccaauaaugcaugcacuuauaaagcaugcauagcaaugucccaggcacuacucuaaguacuguacaaauauaaauuuguauuuaauccccaauaaccauaagauaauaaauacgcuuuucugcauuaaaggcaggaagcggaggcacagaauaguuaagcuauugcucugggcguguagcuggucggggggugcagaggcagggcuccagcccaggcgggacagcugccugcuacgaugacguagcuacaucuuuaacugcacgaaguucacaaggaaguaggaaaugaaauguacgccgaguguuaacuuugaaagaaaaagucuuaucaaugaaauauuuuuuucuuacuguauuuaauuuuauuguguauuucucaaacuuaagauauucuagaugaaauaauacuuauacaaguuuauuuuuuagagauucucagguuuuuuuuacugauguacaaaaauuauauguugugauauguauuuuaacuguauagaaaagcaauuuaaauccaauuauagugguaacuugguuguauuugccauaguggauagauaagucaauauuuuccuuuuggauauuuucaugggggaagcacaguuacucauauaauauuuuuucuuucuuuuuucuuuuuuggagauaauucauaugccacaaaaaucacccuuuuuuuuuuuuuuugagacggagucucacucugucgcccaggcuggggugcaguggcgcgaucucggcucacugcaagcucugccucccggguucacgccauucuccugccucagccucccgauuagcugggacuacaggaguccgccaccgcgcccggcuaauuuuuuguauuuuuaguagagaugggguuucaccguggucucaaucuccugaccucgugaucugccugccucggcuucccaaaaugcugggauuauaggcgugagccaccgcgcccugccaaaaaaucacccuuuuaaaguguacagcucauugaguuuuagaauguuccaaaaaccaugcaccugccaaccacugucuaacuccagaacauuuucaucaccccaaaaaggaacccuugcaccaaguggcacucaucccucagucuccuucacucccaagcccuggcuaccacuacagauuucucuauucuggauaaucauguaaaugcacuguacggcuuuuugugaugggcgucucccagcauggugauuucacaguuuaccuguguuaggugccuagcagccccucauuccuuuuuuuguugcuggauauuauuucauucuaugaguagaucacauuuuguuucucuguucauccacugauggacauuugaguugcuucuacuuuuuggcuauuaugggucaugcugcugugaacauuccuguacaggucuuuguguggacauagguuuucaguccuuuaguauacacacaggagugcaacugauccccuugacugaagcgugggguccucugcuggaggagugggcagcugcaugggggggagggagcaccugaccugcagccguaucccuccuuaccucccucccuccuuccuucccucccuuccucccucccucucucccucucauuuccuuccucucucucuccuucccuccuucgcuuccucccucuguccuuuccuuccucucucccucccucucccucccucccuuuuccccuuucucccucucucccucauucccuccuucuguuccccccucccucacuccuuccaucccuucuucccuccuucccccuuuuccucccucccucccucccucuuucccuuucuccuuuacuuucucccuguguugcuuccucccucccucccucuucuguugcuuuggugccacccaacacagaaccccacccccguggugccacccaacacagaaccccgcccccauagugccaccuaacacagaaccccgcccccauggugucacccaacacagaaccccgcccccaugaugccacccaacacaaccccacccccauggugccacccagcacagaaccccacccccauggugccaccuaacagaaccccgcccccaugauaccacccaacacagaacccugcccccauggugucacccaacacagaaccccgcccccauggugccacccagcacagaaccccgcccccauggugccacccagcacagaaccccgcccccauggugccacccaacacagaucgccaaccccauggugccacccagcacagaaccccacccccauugugccgcucaacacagaaccccgccccccuggugccgcccagcacagaaccccgccccccggugccgcccaacacagaaucccgcccccauggugccgcccaacacagaaucccgcccccauggugccgcccaacauagaacuccgcccccauggugccgcccagcacagaaccccgcccccaugaucuugcccaacauagaaccccaucccuauggugcuaccgaacacagaaccccgcccccauggugccguccaggacaaccccgcccccauggugccacccagcacagaacaggacccuaugagacugagcaagggaggucaggaacagagacccuagagccgagggaccagugagugaaucguagcucugcuacuuauuggcuguguggccuuaggcaaauuacuuacccuuucugugccuccauuucaucauuuguaaaaggauaagaugucacagaccucauuaaugucacagaccucauugguuugggggaauguuagcuucuuuauucauacgugugaagagcuuuaaacagugggugguacaguaauuaccaccuacaguauuugccgcugcuguuauuacuacuaauagaaucuuuuaaaaauauuuuuucacuuaacauuuugugagaaauauuuuuucaucuuucuacaaaagucguuauaguguugcauuuucuuacagacuuucuuaaguauuuuuuggauaagacagaggcuagaccuggagccuuauuuucaucuuagauugauuugggugaugacauugaguuuaauuucgcaccauguugaggaggaggguggugauggugguggcaucuaacguuuauugagugccugcaguguggcagagguugcucugagggcccgguguggguuacuuucuccgauucuuuucagcagguuuuuuuuuuuuuuuugagauggagucuugcucuguugcccaggcuggagugcaguggugcuaucucggcucacugcaaccuccgccuccuggguucaagcaauucuccugccucagccucccgaguagcugggacuacaagugcaugccaccaugccuggcuaauuuuuuguaauuuuuauuagagacgggguuuuaccguguuccccaggcugguuacgaacuccugagcucaggcagucugcccgccucggccucccaaaaugcugggauuacaggcgugagccacugcgcccagccucucuucuccaaucuuacgcaguagacaugcccacugucccuguucuccaggugaggaaccaggcucagcgugucugccagcugcgugacagcaggagaagcuacuuuguuuuccauuuuauccccaaaaccuccgucagugccuggaacacagucacuccauagauauuuguagagggaggagaugaguuuacccaggaucacacagcucauaagugacagagccgccucugggcccagcucacugugugaacauuccaguucauagugugaucccacuacaaggcauguguguguggguagccacaggaguucacuuguuagagcucugaaaugaaugcacaugcaaugcugggagcuuagucauugaagcuccuuguaagucaucacuaaucagacauucacaaugaagauccagucucgcccggauuguuuccuuggggugaaauucugauacagagucuugguauuugucaaguguuuuaggaaauuuaaaugauucaguuucuuguucugcgccuucucuuuaaucugcugaaagccugaguagucaugggucagaaaacaauuuuuguauuuuauuauuuaucuauuuauuuuugagacagggucucgcucugucacccaggcuggagugcaguggcgcgaucucggcucacugcaaccucugccuuccggguucaagcaauucucaugccucagccucucgaguagcugggaucacaggcgugcaccaccacgagccagcuaauguuuuguauuuauaauagagacgggguuucaccauguuggccaggcuggucucgaacuccuggccucaagugauccuccgccuuggccuccuaaagugcugggauuacaggcgugagccaccgcgcccggccuauuuuguuuacauuuuauauauuucguggagaguuaccagcuugagccucaugugugggccacaggguuggggccuugaagaugaugcauucuguucuugucagaagccgugccuccucuucuuguuuccucuucagagcuccuccuucuaggagguggugguguucuagcaaucucuuuccugcuuuuccagauuaaguauggauguuuuacaagauugguugaaccauaaugauacaaauagaauccaaaagaaguuucagggcaagaaugggaacuuaguuuucauugauagucaguuagagcccaccgaggagcccugugauacucuugucuguauucuuuguuaugaaugugauucacaugcccugaggguggccagugggguuaacugcugcauuucacugcccaguuuugcuuuuuuagcacauguaacugagcugaccuugugcuugcagcagugaauugguugaccugcaugaaauugccuuuuuuuuuugagacagagucucgcugugucgcccaggcuggagugcaguggcgcgaucuuggcucacugcaaccucccggguucaagcgauucuccugccucagccuccugaguagcugggauuacaggcgcccgccgccaccacgcccggcuaauuuuuguauuuuuaguagagggaggguuccgcuuuguuggccaggcuggccgcaaacugcugaccucaggugauccaccugccucagucucccagagugcugggauuacagguggagcaacggcgccuggccuccauuuuuuuuuuucuuuuuuugagauggagucuccguuucccggguucaagugauuucggcuaauuuuuguauuuuuaguagagacaggguuucaccauauuggccaggcuggucucaaacucuugaccucaagaucccccugccucagccuccuaaagugcuaggauuacaggauugagccaccgcaccaggccaauuuuuucuuuuuucugagauggagucucgcucuugucgcccaggcuauagugcaaugacgcgaucucagcucaccgcaaccuccgccuccuggguucaagcgauucuccuguaucagucucccgaguagcugggauugcaggcgcccgccaccacgcccggcuaauuuuguauuuuuaguagagaugggguuucuccauguuggucaggcuggucuugaacuccugaccucaguugaucugccugccucccaaagugcugggauuacaggccugagccacugcgccuggcccaauuuuuuuaaauguugaaauauuaagguauuugaaaaaaaaaugacauuucacaugcuucagcuuaaucgaaggcaauaaugcauugaguaacaauuuuaaguaaguagcugaauguuaggacaggugcuucuuauuaaccgugauugacuugaauggacccauuuuggauguagacaccacccaggaagaguuugggaucaguaaugauuaaauacuagguagcuaugcuagguuuuccagagaugauaaaaaaaaguguaaaaguugguuccuguuuucaaagccacugauaauguggguaagagggccaaaccaagauuggcaaaggauacuaggaaacuuguaguucagccccaagugacagaggcaacgauggugugggcuaaggaggcaagugcugcaguuuggauguuuguccccuccaaaccucauguggaaacuuuuuuuuuuuuuuuuuuuuuuuuuuuaaagauggagccucacuucaucacccaggcuggaaugcagcagcgggaucucagcucacugcaaccucugccucagauauucaagcgauucucccaccucagccuuccgaguagcugggauuacaggccugugccaucauaccuggcuaauuuuuguauuuuuaguagagacaggguuucaccauguuacccaggcuggccuugaaccccagaccucaagugauccaccugccuuggccucccaaaguguugggauuacaggcaugagccauggugccccuaacugaaacuugaucccauuguuggagguggggccuaaugggagguguuugggucacagggggugaauccuucaugaauagauuaauguugucccuggcuaugggggugaggugguggggugggggguagugggugaauucucacucuuuuaguucccacaagagcucauugcuaaaaagagccugugguugcuccuccuccucccccacccaccucucucucucccucucucucucucucucucucucuuucuuucucccucaccaugugauuucuacacacgauuccccuuggccuuccgcagugaguggaaguagccugaggcccucaucagaugcagaugcccaaccuugaacuuuccagccaucagaagugugaaccaaagaaaccuuuuuucuuuauaacuuacacagccucaggucuuccuuuguagcaacacugaaugggcugagauagcccagaagugguucuacagugguuuacagggcuugaguccuguaaaggguggguggaguuugcauaggcagugaagagaggggagaggugggagcagaggugggaacuggaagggccucccaggguaggugaccaggucagcuuguguggcgugggguauagaggagcacaggauugaagucaacuugaguccacaugguuuccauugcuaggcugaauggaugcaugggguuuuccaaugcuaugucuggaucaccuggggcccugguguagagugcagguuccugagcuccaugcucagcugccuagucuguaccuccaggaguggcaccugagaaauccauaccagccagcuagguuugcaaacccccaaugggccaccuucccaggucugcagacugucuguguuggagucaucuggcagugcuugcucaaaaugcagaucacugggcucugccccuagaaccaccaagucagaauuucuggggauggagcuuggaaaccacauuuuuaacaagcgucacagaccauuuuuggcacacuagaauuugagagccacugcuguagucagugaggaacuugcgagagcguaacucuuggagucugugguuauuguuacauauauuuaagguauccuaggccgggugcagugguucacaccuguaaucccagcacuuugggaggccgaggcaaggagaucacuugaggucaggaguuugagaccagccuggccaacauggugaaacccugucucuacuaaaaauacaaaaauuagccaggcgugguggugugcaccuguagucccagcuacucgggaggcugaggcacaggaaucacuugaacgcaggagguggaggaugcugugagcugagguugugccacugcacuccagccugggugacagagcgagacucugucuccaaaaaaaagaaaaaaaaagguaccccgaaaaaacugcugauuagagacacguaugagcucauuccagaaacuagccuggaccaguaagcaagaaagccagaggucacccaacgucagggacagcccggacacccagccguugagugcgggcaccaaggccgaguggagcagagagaaguggauagucgcugcuuggcaagaaagccagaggucacccaacgucagggacagcccggacacccagccguugagugcgggcaccaaggccgagugcagcggggagaaguggauagucgcugcuuggcaagaaagccagaggucacccaacgucagggacagcccggacacccagccguugagugcgggcaccaaggccgaguggagcagagccguugagugcgggcaccaaggccgaguggagcggagccguugagugugggcaccaaggccgagugcagcggggagaaguggauagucgcugcuuggcaaguguccauuuucucuuuuuuuuuuuuuuugagacagagucucgcucugucgccuaggcuggagugcaguggcgugaucucggcucacugcaacuucugccucccggguucaagcgauucucaugccucagccuccugaguagcuggaauuacaggugccugccaccauguccggcuaauuuuuguauuuuuaguagagacggguuucaccauguugaccaggcuggucucgaacuccugaccucaggugauccacccaccuuggccucccaaaaugcugggauuacaggugugggccaccacacccggcccauuuucucuucuuuacagccccgugauccguuucccauugggcacagaucaguggaucuacaaccuguuacccagcuuccccuagccaagugaacaggugccccucccugaaguuugaauggugaguggagcgacagcgaugcuaagaauaguugcgguucgggucugucuguccaggcuguucugcagugggacuguugcgguuccuguuuccuggucuccagccgccuuggcuuccaccuguuuccaagucccuuucucuggccuacagucaguuccaugaguuccugauaguuuuccaaucaguuuccuuuugcuaaguuaccuagaaaggauuucuguugcuuacaaucagagaaccuuagcuguuauacguaaggagcaaaggaaacauuugcaauauaagggcaggguccccugagagcugggagacguguguaggaggggccauccucagauuaggaagaagacuucgaaagaacagcagggccagccuaaagcugggguuugucaaaggcacagaugaggaaagugagggcaaagugcugucagcugagaacccugcacgugacuuuggauauccagaagucaaauccauacuuuguuggguucauccauuuuucauauuuuuauguuuugcuuuaaaaauuccuuaaaaaaauuuuuaaaaaaauuuuuagacauggucucacuccgucgcccagaguacagaggcuggagugcaguggcaugauaauggcucacuacaggcuuaacauccgagacucaggugauucucccaccuuaggcucccaaguagccgggaccucaggcacacgccaccacucccagcuaauuuuuguauuuuugguagagacaggauuucaccguguuggccaggcuggucucgaacuccugaccucaggugauccacccaccucagccucccaaagugcugggauuacaggugugaccuaccaggccugcuccucaaauuucuuaaguaaaguuccuuuugaccauuuuagaugaucuccuaggggaaugaagguuuggggaaagagacugggaaggauuuggcccauuccuaggagagccuaacuggagagguugucugggaaaccugguugggugucuucagcuugauaaaagcaggguuuuagguagauuugcguaacagagccagcugaauugagugggagggagcagggcagaaaggaacugggaugugagaggcaauucugagagguccuucccugcaacggaugagguuguuugaguuugagagaggcugaguuuaggauagcgagugguggagcugcaccuucguaugugauggugccguagcaugcauuugacuaccaugaacuggggcgggcgugguggcucaugccuguaaucccagcucugagggaggcugaggcagguggaucacuugagcucaggaguccaagaccagccugggcaacauggugaaaccucaccuguagccaaaaaaaaaaaaaaaaaaaaaaacccgggaauggguggcaugcaccuguggucugagcuacucgggaggcugaggugggagaaucgcuugaacucaggagguggaggucccaucuauuccccuaaaaaucccuuaaaugucuccuugggacagugccuaguucagcccucauuguaucucaucagagguacugugguagccccugucuugcuccaguccgauccgucuuccuuauuaaaaguagaguuuuagguugaaugcacaaauggccccuugagguaggcguacuggcugacccugcagauggcucagcaggcucugcagugaugggcucgguugcaaggcugguguggaagacccaggucugccugaguuuugcaaagcccacacugcaccugccaccuugaacuaccaaccuggcgaguugguuuuuuaaguccuuguagguaaaggagccagccugacuagcaauugaauaaguacugguggauuugaggcaccauauccuguugguggaacucauuaaaguagccaaugucaauacucagaauauugauuauuuugagagcuaggauuguaucauugcauuccagccugggcaacagagggaaacccugucucuaaaacaaccaaccaacaagcaggaaaucugcacuuaccuauggagagaccugugucaggaaagcacaccacagucacugucauuaaugucaguucagaugauguggaacugccucgcuauuccacaguaaacucaagucaaaaacugagaaguuuuauccaaauuaaagcugggcaaccuaaauuacuuuaaaauguauuaugcaguauuaauaugcaucaaaacauguaauauugugaguuagcacauccuggaaaacauuuggacacaucugauaccaggcaguuuuacucgugggugucucucuagagcagagaucagcaaaccuuuucggugaagaacuagauagggacuauuuuaagcuuuggggccccucggaucucuuucgcaaugauguaacucugcaacaaccucugcccuugcagugugaaagcagagaccauacauuaaacaaaugagcaugucuguguuccagugaaauauauuuauagaaacuguauuugaggccaggcgcgguggcucacgccaguaaucucagcacuuugggaggccgaggcgggcggaucaugaggucaggagaucaagaccauccuggcuaacgcggugaaaccccgucucugcuaaaaauacaauaacaaaaaaauuagccaggugugguggcaggcaccuguaaucccagcuacucgggaggcugaggugggagaauggcgugaacccgggagguggagcuugcagugagccaagaucgugccacugcacuccagccugggcaacagagcaaggacuccaucucaaaacaaacaaacaaaaagaaacuguauuuguauuugaaauucauguaauuuucucauguuaugaaguacuauuaaaaauuguuuuuagugugugggcucuucaaaaucaggaacagguuggacuuucuggaaacggcaguuugcagaccccuaauucaaagcaacucuguccagugggacuugcugugccaaggggagcacucugcguccauugucuucuugcagcagccaccagccacauguggcugcugggcccuugagaacuggccaguguaacugaggaacuggauuuuucacauuguuugauuuuuagcuugaauuuucauuugcauuugaacagccccacauggcuaguggcugccauguuaggcagcacaggcguacagaggcucuuguagacgugcagcagcaagcagggaccgaaauaaucaugacaccauuguuuuuaaacagcaggaacaacugauggcauuuucacacaguggaaaaugauuguaauaauagcaaacauuuguuaagugcucucuuuccgccaggcaauguuuuaagcacuuuacauguuuugacccguggauucucacuguuagguaguagugaaaaugaauaaacuauagcuaccuauaccagcaaggaugaauaaaucuuagauacacaaaguugcaugaaaaagcaagucauggccaggugcggugacucacgccuguaaucccaguacuuugggaggcggaggcgggcggaucacuugagaucaggaguucaagaccagccuggccaauauggugaaaucccauuucuacuaaaaauacaaaaauuagcgaggcuugguggcaggcgccuguaaucccagcugcuugggaggcugaggcaugagaaucgcuugaacccagaaaguggagguugcagugagcugagaugcuaccacuguacuccagccugggcaacagagugagacucugucucaaaaaaagaaaaagaagcaagucauaaaaacugcacgugggcugggcgcaguggcucacgccuguaaucccagcacuuugggaggccgaggcgggcggaucaccugaugccaggaguucgagaccagccugaccaacacagagaaaccccaucucuacuaaaaauacaaaauuagccaggcaugguggugcaugccuguaaucccagcuacugaggaagcugaggcaggagaaucgcuugaacccgggaggcagagguugcagugagccgagaucuuguuacuccauccugggcaacaagagugaaacuccguucccacccccccccaaaacaaacaaacaaaaaacugcaugccaugugauaccauuuuuaaaaccuuaaaaccaagcaaaaugaaacaacacuguucagggagaauaaaugguagcacuauuagcaaagcaagggaauucaggucguguuaccuuugggggagagaaggugccaccagugagggcccaguguguugaggggcagcgaaauuccugaucucuucacauuuccacuccuccauaguaaaggguuuauaagcaggauauauauugacuugguagaacagagcuuucauguaaugagaacagugacuguuguagcaucccuacaguuaguuuugaaucugguuucuauucacauuuaagcagauguuccauuagcagagggguuuauauuuguugccuugguuggguacuuuggauuagaaaaauauugucauuuuuuucaguucaagaacaaaggguuaaaaccuuuuguucggcugggugcgguggcucacgccuguaaucccagcacuuugggaggccgaggcggguggaucaugaggucaggagaucgagaccauccuggcuaacauggugaaacccugucucuacuaaaaauacaaaaaauuaacugggcgugguggcgggcgccuguagucccagcuacucgggaggcugagguaggagaauggcgugaaccagggaggcggagcuugcagugagccgagaucacgccacugcacuccagucugggcgacugagcaagacuccaucucaaaaaaaaaaaaaaaccuuuugcuccaaauuuuuguuucauuaaaucuacugaugaguugaauguuaccagaaucuagcugagagaauuuagguuggaaaugaacaucugaaaacugcaaaauaacaaauagauguacuuauucaugguuugucacuagaguguucauuaaaagaaaaauccugccgggcacgggggcucacuccuguaaucccagcacuuugggaggccgaggugggcggaucacgaggucaggagaucgagaccauccuggcuaacauggugauacccugucucuacuaaaaauacaaaaaauuauccgggcgugguggcgggcgccuguagucccagcuacucgggaggcugaggcaggagaauggugaacccaggaggcggagcuugcagugagccgagauagcaccacugcauuccagccugggugacagagcgagacucugucucaaaaaaaagaaaaauccuaaugaccccugaggguguuaggacacuucauguaggaguauuucaucccuaaauuaauaacuucagaauuaugcaguaguucaugguaaguuggauucaaagugacauuuuguuccugaagauuagguuuugcuguagcaaucguagaagccggucgcugagcuugguguggaaauguguaauaugugcaccuuugacuuuuuuccuuaguguauuccaucuucauucuuuccuguauuacugacaugggcuuaucuuuucucccuuuagagaguuuugaggugacagucaccaaagaaggugauaaaggguucuuucuuccccucuuaugaauauuaacccacuaacuuuguuuauaaaauugggaaucagcccuuaaacaggagaaacugucaugcucuuuuauccuuauuuauucuccuacuuuguuucuauuuuaaaguauauugauggaaauuguauguaaccagacccuugguuagaaauaucuggaaaucagacauccauuugaacuguauggauaacacuguacauuuuuguuuaauagaacuucagagauuugcuuuauaacaauuuucuauuaguuggaauuguggaaggagugcagucuuauuuucaugugaaauacauuuuguggaguuucacaucgacaucaaaacauuuauacuguucucccauggacaagaauggaaacauagauuuuuaacuccuaauuaaguugugagccaauuuagauguagagaaguucccaggcuggugucuuuuucagguuugauaggauaaaguccgaaacaaaggcaagucuagccagucccucccauaauagaaacugugucugaaucguagaugauaaaauagcuguugaaauggaugccugacgagucgguauuucuaccuuucucauugaguaguuuguuuugauucccuaauuuuagccaggcucauugcacaggaagacuuguuuccuuugauuuuuuuuuuugacagaauuucuguaauuacggugcugauccuauaucucacgcuuccuccucucucaacacauaacugcguuuuagcuucucucugguccaaaucaaacuggcugccagcccucccaggagcuggggcagcgcugguguucucaggccuggcugugugcuaaugagacuccuuuuacccucgagcuaucuaagugcuccuguggaaugccugucuauauuuucuucucucucucuuuuguauuccugcaugaauggaugcaaaguaaacaaguugcuuggaaagccagaaucugcuucaucuuacuaaagcccgagaacuuccccauguuuaaaacacagugccccugcuuuguccacggacccuccaaaccccuggcugccaaauuguugucauuuauuuucuuuggggguggagauggggggaggagggcaaggugcagaagaucuaugugguaggaauucuuaccuguucugcuuugacucccuaggugagauuuguggauuuaaaauucacgggcagaauguccccuuugaugcagugguaguggauaaauccacuggugagggagucauucgcuccaaagagaaacuggacugugagcugcagaaagacuauucauucaccauccaggccuaugauugugggaagggaccugauggcaccaacgugaaaaagucucauaaguaaguaagcuggacaaagagugaacauaacccaccgaguaaacgugugugcgcagaacgaaaauaguagugacuauugccugcuccccaagacuguuuuugaaauaggcagaagauaguucucaagugucuacaauuagauuguaaacacuuggagggcaggaaucaugucucucuacccuuguauacaguuucuagcaagagccuugcucacauuaggcauauuagguuuuuugggguuguuuuuguuuguuuuuugagauggaguuuugcucuuguugcccaggcuggagugcaauggcaugaucuuggcucgccgcaaccuccgccuccuggguucaagcgauucuccugccucaaccucccacauagcugggauuacaggcaugcgccaccacgcucagcuaauuuuguauuuuuaguagagauggggauucuccauguuggucaggcuggucucaaacucccgaccucaggugauccgccugccugggccuccuaaagugcugggauuauaggcgugagccguaccuggccuuuuuguguuuuguuuuugagauggaguuucgcuguuucacccaagcuggaguguaguggcacgaucuuggcucauuggaaccuccgccuuccgguuucaagugauuuuucugccucagccucccgaguagcugggauuacaggugccugccaccacgccuggcuaauuuuuguauuuuuaguagagacggguuucaccauguuggccaggcugguaucaaacuccugaccccaucauucaccugccucggccucccaaagugcuaggauuacaggcgugagccaccacacccggccuagguuuuuaauaaaugaaugagugaauaauuuuaucacaccaaauacucuauuaaagaaguaaaggcccuacauuaaaaauugaaaaagucugcuucucccuuaggaagguuauuuuguugucauauuuaucuuuugcuguaauuccuaagggcauaaacuuaaucauuguuggccaggugcaguggcucacaccuauaaucccagcacuuugggaggcugaggugggaagauugcuugagccuaggaguuugagagcagccuagacaauguaggagaugccaucucuacaaaacauaaacagccagguaugguggcacaugccuguggucucagcuacuugggaggcuaaggcgggaggauugcuugagcccgagagguugaggcugcagugagccaugauugugccacuguacuccagucugagugucagaaugagacccugucccuaaaaaacaauaacaacaaaaauuggccaggcacgguggcucacgccuguaaucccagcacuuugggaggccgaggcaggcagaucaccugaggugauuuucaccugaggucaggaguucaugaccagccuggccaacauggagaaacccugucucuacuaaaaauacaaaauuaaccaggcaugguggcacgcgccuguagucccugcuucucgggaggcugaggcaggagaaucacuugaaccugggagguggagguugcacugagccaagaucacaucauugcacuccagccugggcaaaaagaaugaaacuccgucucaaaaaaaaaaaaaaauuagucacugcugguggaaguaggcuggcucgcugccacaauccugaguguguugcugcaccuccugccaguuaggaacugcaguuguagcagagagggcuuuggacaagacaacauagaacaggggucgccauaccucaggacgugggccaguacugguccguggccuguuaggaaccaggccacacagcaggaggucaacagcaugugagcgagugagcauuucugcccgagcuccaccuccugucacaucagcagcgguaucagauucucacaggagcgcgaacccuguugugaacugagcaugccagggaucuagguugugcgcuccuuaugagaaucgacugccugaugaucugagguggggcauuuucaucccaaaaccauccucccacccccaucuguggagaaauugccuuccaugaaaucaguccuuggugccaaaaaggcuggggacugcugguguucucaaguccagugucuucuacaauuagauuguaagcucuagucuuuucuagagcucuagucuuuucuccaccacuugcuagcccuuuggcauugugcaaauuuaauuuuguugagucuguuucuuuuucuuuuguuuuauuuauuuauuuauuuacuuauuuuuugaggcagagucucgcucugucacccaggcuggagugcgguggcacaaucucggcucacugcaaccuccaccuccaggguucaagcgauucucgugccucagccucccaagcagcugggauuacaggcacgcuccaccacaccuggcuaauuuuuguauuuuugguagagacggaguuucaccauguuggccaggauggucuuuaacucugaccucuggugacccuccugccucagccucccaaagugcugggauaggugugagccaccacacccggcccugagucucaguuucuacuuagcacaucuacuaaagaaggguaugugggcgagauggugucacauaacccauugugagggucagaccgauggcacugggaugaggaggcucauggugagcagaaggugcagugccccagugagucucuucucuuuuuccacaguguaauguuauuguuucccuugaaaaggucagauuuugaccaaaguccuugacugauucagaagcaugcccugaccauuagcccuugaaaccuacaguuuuuuuuauuuguagccaggucugaugacacccuaauuuucuugauaacugagcugggguauuggcagguggcaacggccugccucuccugaacucuuccauuuguugaaucaggaccaggugaugccauggacuccagccuauucccuagaaguaggacagaauucguuugaacucucagaaucaaaccauuucaugcuuucucuguuucauaccccuucuucccuuggcucuauuuuuuuucuggauuuugcuacaaaauauguuucaacuuuauaauuggagagcaaacagacgucugguauuguuuaucucccuucugccugucuugucccauauugucaaaaaaaaacacccaagucucuuuuauuuuagaugauugguuuuuugcuuuauucuuaggauauggaagaaucgacccaaaucccucuuuuaacuuucuguuaucuccacacuugaaugaaaagcagugaauagcuuguuuaauuuuugacuucaucauaugaauuucaugaaacaagguaucagaaacaggaaauuuuaaaguagggcagaauuggguaaacacacauacacacucucugucucucucucacacugaaaacaagcagaaaaauauuuuucucccucccuuuguccagagcaacuguucauauucaggugaacgacgugaaugaguacgcgcccguguucaaggagaaguccuacaaagccacggucaucgaggggaagcaguacgacagcauuuugaggguggaggccguggaugccgacugcuccccucaguucagccagauuugcagcuacgaaaucaucacuccagacgugcccuuuacuguugacaaagaugguaagaaucgaggagccggcuuuucagcuagguagacagucccugcuaaccccacugacuuuacaccccagcuucugugcuucgucagaacuucauggaacucacaaguuggagaccuaaccugguguguguuugcuuuuaauuguaaaaacauuuaaguuucuacuuuguucccugacaacuucuucucuggaaccuguaaguccuguguucucuuguggggcucaccucuuuuuugcuuucccaccaaaaucaaauaaaaauccuccuaccugacauggcuuuguuuuuuuaaucuucuuaacuuucaguccacaugcaucugaaugagacugaccuuuacauuuaguuugucucauuuucuguucuccauuaaguuuuuuguuuuuguuuuugugguuuuuuuuugagacaguuucucacucuguuccccaggcuggaguacaguggugcgaucucagcucacugcaaccucugccucccggguucaagugauucuccuaccuuagccucucgaguagcugggauuacaggugcccaccaccacgcccagcuaauuuuuuguuguuguuguuuguauuuuuaguagagauaggguuucaccauguuggccagacuggucuugaacuccugaccucaggugauccgcccaccuuggccucccaaagugcugggauuacaugugugagccaccgcgccuggccauguucuccauuaaguuagaaucuccugugacaucuuuuuuuuuuuuuuuuuuguuugagggaaggucuugcucugucgcccaggcuggaauguaguggugcagucacugcucacuguaaccucgaacuccugggcucacgggauccucccgccacagccucgcuaguagcugggacugcaggcacacaccuguagucccagcuauuugggaggcugaagugggagaaucgcuugaacccaggaggcagagguugcagugagccgagaucaggccacugcacuccagccugggcaagagaacgagacccuguuccaaaaagaaaaaaaaagauaauacaguguuuccauuguuaaucaaugcacggucuagaaucuuugauggaauuauggacauugcaaacacuuuccagagaucuauacucaccacguucaaaaagcaggcuucuguucuaagcagguggggguaggaaaucucucuuucuuuuaauauaguaaauguuugaucagcgaucuuauauuuaauauuugagguacuugaauuauuauuauuuuuuaauccucugaauguauguaaacaguuaaaucuuaauguaaagcccaauguaacacugugagaguaaguggagacugagcuguguagcuccgucucuucuguugaaacucuucaggauggauuuagugcguguuagggcucagggaggacagguugaggguuaagcaucccaagcauauguuuauuucuggcugaguauuuacagggcuuaaagccuaugcauuuugucuuuccgccuaggacaacaaaaguaaaaccagcauggguuuuggcucucacuguuguuuuugcccucuguaagguuauauaaaaaacacagagaaauuaaacuacgggaaagaacaucaauauaagcugaccgucacugccuaugacugugggaagaaaagagccacagaagauguuuuggugaagaucagcauuaagcccaccugcaccccuggguggcaaggugagcuucauucucuccccugcgcucacaucugcucuuaaaacugauguaugcggcagcaaccuagaguguguguuuuccuucucucuuccccugcugacuuguggaccaacacaggauggaacaacaggauugaguaugagccgggcaccggcgcguuggccgucuuuccaaauauccaccuggagacaugugacgagccagucgccucaguacaggccacaguggagcuagaaaccagccacauagggaaaggcugcgaccgagacaccuacucagagaagucccuccaccggcucugugguaaggagaccaggcguucuugcauccggcuggcuuuggugaaggugggagggaccuuuacaacuggaaauacuuguguguguuguguucauaauuauaaacugugacagagaaucugcauuucugaagugaacuuugcugccuugcuggcuaguuuucauacuggaugggcuucggggguggggcaggggguggacaucaacuccuaaacgucuauucaacauguuguguauaugugcauuuuaagaaccacugguggccagaugugguggcuuauaccuguaauuccagcacuuuaggaggccgaggugggaagaucacuugagcccaggaguuugagaccagccugggcaacacagcgauaccccaucucuacaaaaaauugaaaaauuaacuggggaugguggcauggaccuguaguuccaguuacuugggaggcugagcgggaggaucaccugagcccgggagguugaggcugcagugagccgugauggcaccauugcacuccacccugggcaauagagugagacccuguuuuaaaaaaagaaccacugauuugaaggaaguauuucuccagcauacucugagaaucauccaaaaagggcuucuauaggaguacauggagugaguuuuacaugaaaugagauguuuacuuacgaauugaagacaaaggccagggcaugggggcucaugccuauaaucuuaccacuuugggaggccgaggugggcagaucaccugaggucaggaguucgagaccagccugaccaacauggagaaaacccugucucuacaaaaaaaacaaaaacuagccgggcauggcggugcacgccuguagucccaacuacuuggggggcugagggaggaggaucgcuugagcccaggagguggacguugcagugagccaagaucacgccgcugcauuccagccuggaugacagagugagaaccugucucaaaaagaacugaaggaaaaauauagguaauacaauagcuuuugacaaacaugaaguagaaaaucagaacuaaagauagccacaucuaacuuagaaucucaauagauuuucuauaucacaauauuguguggagaaauugagagacagaauuacugggaaacccaccagaaggcuaggucucucuuuacugucagcugcggauauuuuucugguuuaucuaaaugaagaagaggugagguauggauggcugucauggaagauguugagggaagaacauuuaguugacuggugauaaaaucccacuaaaugaagcagcgucuucauaaauuggaagggucuuuuguguuucaaaaagcuuuugugaaacagcuuuucagggagcauuuucuuaaacugaugagucuuuucacuagccugauaacaaccaugagauuuagguuacugguuuucuuuuuuuuuuuuuuagacagagucucacucugucacccaggcuggagugcaguggcgccaucucggcucacugcaagcuccgccuccuggguucacaccauucucccgccucagccucccgaguagcugggacuacaggcaccugccaccaugcccggcuaauuuuuuuguauuuuuaguagaaacgggguuucaccguguuagccaggauggucucgaucuccugaccucgugauccgcccaccucggccucccaaagugcugauugcaggcaugagccaccgcgcccggccacugguuuauaauugaaaauuauccagaucacuugaggucaggggucuaagaccagccugaucaacaugaugaaacccccgcucuacuaaaaauaaaaaauuagccaggcguggugcgaggugccuauacucccagcuacuugggaggcugaggcaggagaauugcuugaacccaggaggcugcagugagccaagagugugccacuacucuccagccuaggugacaaagcuagacuuugucuuagaaaaaaaacaauaaauaagaagaaaauuaucaugugguaaauaaaccaaaguagaaaacuagacauuaugcugccacaguccaaugaugagcauauggggguguuuggcaacucugaauccaaauauucauaauugucaccuaaauauauuuaaguaaggaggucuggcacauuuucuguuuuaaaccaugcauguaaguauaauauauaaaauuuauuccgucucucauuucaugguauuaagugaauuuuuuuucagcagaauaaaguuaggaagaauagaaauaauuugagugcuuacuaugcaccagguacuuuuuuuuuuuuuuuuuuuuuuuuuuugagacagucucccucugucgcccaggcuggagugcaguggcgcaaucucacucacugcaacgucugccuccuggguucaagcgauucuccugccucggccucccaaguagcugggauuacaggcaugugccaugaugccuggcuacuuuuuguauguuuaguagagaugggauuucaccauguuggcgaggcucgucuccaacuccugaccucaagugauccacccaccucggccucccaaagugcugggauuauaugcaugagccacugcgccuggccuuacuccagguacuucuauguguguuuuagcuuaauguucccaacaagucuacgaaguagguggguauugaccuuguuacagaggaauuaaacaauugagacuaaagcagguuaaguagcuugcccaagcccacauauucaggagcugagguucuagugugugugugugguuuuuuuuuuucuuuugagacagagucucacugucgcccaggcuggaaugcaaucgugcuaucuuggcucacugcagccuccacuuccuguguuuaagugauucucccaccucagccucccaaguagcugagauuacaggcaucugccaucaugccuggcucauuuuuguauuuuuguagagacagaguuucaccauauuggccaggcugguuugaacucuugaccucaguugaucugccugccucagccucucaaaguucugggauuacaggcgcaagccaccacgucuagcuucaggagcuaagauuuggaccaaggucuucuguuacucaagaggccaggcugguccagccaaggccugcugcuccgaguaauagcuuagucaagaaggagcuugcaaaaucuuuuccuguggacaaaaaaaaauuuuuuuaauuugaacauggcaauacauaagaaugguuggaaaacauuuuuuauguuuuuugacuuaguaauuucauuucuaggaauuuauuuuaagggaauaaucauggagacacauaaagcugugcaugcaggugagguuuauaauaggaaaagguuagggacagccucugugcccaccugggaggcuggucaguaggugaugcuguaucuguacaaugaaaugcuauucaggccgagcgcgguggcucacaccuauaaucccagcacuuugggagucugaggcagauggaucgcuugagcccaguaguuggagacuagcuuggacaacauggcgaaaccccgucucuacaaaaacacaaaaauuagccgggcaugguggcacacaccuguggucccagcuacuugggaggcugaggugggaggauugcuugagcucaggaggucaaggcugcgguaaaccaacgcugcaccacugcacugcagccugggcgagagaggagacccugucucaaaaaaaaaaaaaaaaaaaaaacaacuauucagauaguuuaaauuacaugauagaagaauauugcuaggaauauauauguauuaugcacauacauagcaggacuccacuuuuauuguauuuguuuauauauuuuugagacagggucgcacucgcccaggcuggaguauaguggcacagucacagcucacugcagccucaaccuccugggcucaagugauccucccaucucagccucccaaguagcugggacuacagggaugcaccaccacaccuggcuaauuuuuguguuuuuuguauugacaggguuuugccauguuguccaggcuggucuccaacuccugggcucaagcaaucugugugccuuggccucccaaagugcugggauuacaggugugagccaccaagcccugccaggacuccauuuuucuaagaaaacgcaucauuuuuguguauauuuaccaaaggaggacuggguguuuauacuaaaaugguauaauuugaaucagauuacaagaaaugcuuccuuucccuuccuuuuuguuuuuuuuuuuuuuuuuugagacggagucucgcucuguugcccaggcuggagugcaggggugcgaucucggcucacugcaagcuccgcuucccggguucacgccuggcccuuucccuuccuuaaacaaauccaugguuguuauuuuuauuuuuguaauuuaaaacccugauuuuugaagagaaguaaacugaaagggccaagcgugguggcucacgccuguaaucccagcacuuuuggaggccgagucaggcggaucacgaggucaggaguuccaggccagccuggccaacauggugaaacuccggcucuccugaaaaugcaaaaauuagccaguuuuaauggggcgcgccuguaaucccagcuacucgggaggcugaggcaggagaacagcuugaacccgggagguggagguugcaaugaaccgagaucgcgccacuguacuccagccuggggacaaagcaagacucugucucgaaagaaaaaaaaaaaguaaacuggagccagcagauugccuaaguguaagacaagcacgugccugggggcuugaggugcgcgggaccucuggcuccucacaugaguuucaccgagcacuguggcuucaggugcggccgcgggcacugccgagcugcugccauccccgaguggaucccucaacuggaccaugggccugcccaccgacaauggccacgacagcgaccagguguuugaguucaacggcacccaggcagugaggaucccggauggcgucgugucggucagccccaaagagccguucaccaucucgguguggaugagacaugggccauucggcaggaagaaggagacaauucuuugcaguucugauaaaacagguaggguaauagcucugcaagcgaugccaggccccaguguccaguagggugggugccagcggcaggcucccucuccuuucccaggguccccugccagccuggugcucguaggccaugugccaugcugugugccuggggcacuugguucccuagagccacggccugggcauuuggguauuagcuguuguugcucagugggguccacggugaucacaggcuccgccucucaggaaagcccaaguguauuuguuucuaagcccugccuuggcuuagccgaagaguucauuuaugcagaugaaauugugucuucaaaauccauucaagaaacagcuuuaauuucuccuuuggaucuuuaguuggcaauuuacccauagaaacugccuuugcagauaugaaucggcaccacuacucccucuauguccacgggugccggcugaucuuccucuuccgucaggauccuucugaggagaagaaauacagaccugcagaguuccacuggaaguugaaucaggugagugaauugaaaacgcacuaauagggccgggcaaggugcucacaccuauaaucccagcacuuugggaggcuggggcacgaggauugcuugagcccagggguucgagaccagccugggcaacauuacuaagauccugucccuacaaaaaaaaaaaaacccacgaaaauuagcugggcaugguggcacaugccuguaguccuggcuacuuggggagcugaggugggaugauugauggagcccaggaggucaaggcuguaaugagcugcgauugugccacuucacuccagccuggaugacagagugagaccccgucuccaaagaaaaagaaaaacacugucaucuucuaagagagaguaagcagguacugcaaccuugcacauggauggcuguguauagucaguguauauuuauaauuuuaugaguagcugggacuacagacacaugccaccacacccagcuaauuuuuguauuucuaguagagaugagguuucaccauauuagccaggcuagucuugaacuccugacuucaacugaugcacccaccucagccgcccaaagugcugggauugcaggccugagccacugugcccggccgcaaagcuaauuuucuagcaguugcugugauagaaagcaaauauccugugaaaaaccccacgugcuacaggaaacgagagagcacuguaaaauuagaacccucuauuaaaaucagaauagaucauuuuuucuuuugauguagaguugggaugagaaggaaaccuuuggccuuaucaucauuuuauuugucucauggaguuaguggacaaaagcugacauauguuauaugugccugcaguugcuaaaauauaauagugucuaaaaauaaucauaggauagauaaaaguaaaagagaauaaaugagaaaggaaaaaguauaugauaguggaaaguugaaguggguguccaguugguagcauuugucucuuuuuuuuuucccccgagacugagucucgcuuuguugcccaggcuggagugcaguggagaucuuggcucacugcaaccuccaccucccggguucaagcgauccuccugccucagccuucugaguagcugggauuacaggcgugcgccaccacgcccggcuaauuuuuguauuuuuaguagagaugggguuccaccauuuuggucaggcuggguagcauucaucucuuauugguguauuuuuuuauuuaugugagugauuauuucucagaaacuauuaccauuaauuauuuucaaaaaacuaaagaaaggcuuaguccuggaaaaauauuuugcaacauagguggacauuuuagcuacaguucuguuauaguagccauagucugcauuuauauauuuaguuucuucuaaguauauacuguuuaaaaacuguauuauggaaaauuucagauuuauauaaaagcagacagauuaaagaauagcccugugugcccuuaugccuucaacaguugccaacucuuggucagucuaguuucauuguuaccccuauucacugcugaaaauuuuuaucacccccucaaacguuaguuaauaauuuucaagaaaucccaaauagagcauuucauucuuguagacgcccgccuguaugucaugauguaucucauagacaagcauaaucacagcacucuuucacauuaaaaaaaaaccuaacaguaaaauuucuaauacgaucaaauagccagucaauguucagauuucaaguagccucauaaauguuuuuguguuuacaauuuguuugaguuacgacccagauaagggcccauugcagcuggcugaugcguguucacacacucguucaucacaggaugggaacacaguuugguuuggggugcccuuggagcugauguucauauuuauugagaucaucaacuuugaguuggaaaagaaaauacauguacuauggugugccuuauucugagauuaaaggcacuuuuuugucggcgguggggaggagauagagucuugcucugucacccaggcuggagugcaguggcacaaucucggcucaccgcaaccuuugccucccggguucaagcaauucuugugccucagccucccaaguagcugggacuacaggcgugcaccaccacacccggcuaauuuuuguauuuucaguagagaugggguuucgauauguuggccaggcuggucucaaacucuugaccucaagugaucuccucgccuuggccucccaaagugcugggauuacaggccugagccacugcgcccggccuaaaggcacuuuuuauuuuuauucagaaaaggaauggccagugguaaacuaacucaacccuuucgaggguggguauccagcuugcccauacaggaacuuccuggugccacacuguuggcagagcagaauugggcagcucccuacuugggcuguguccucugguuagugagcaaugcagcccccguaguuuggaaaugcccuagagaugcuuggcuucuuuuggugagauguauuugcagauauuuugugguuagauuuuuuucauccuuuuccuccuaggaagacccuuguguugggugacuugguuuccaugggcauugaugagaaggaaaguggacaucucacaccuccccgcuucccuuugccucuguaggucugugaugaggaauggcaccacuacguccucaauguagaauucccgagugugacucucuauguggauggcacgucccacgagcccuucucugugacugaggauuacccgcuccauccauccaagauagaaacucagcucguggugggggcuugcuggcaagguaccugucauuaccccccgcccucgacucgagaauuaaguuguaccucuuuacuagguugguggcagcaggcugugaucgguauccuacagccuuacccucguguccuggaucuuuuccuuccauuuccuguguacagccuuuuuggggacacugccguuaccccacucuagcuagcauagcucugucuguaggugcuccauaaaggugauaggacugaccacaccgucaccuuucccggaaacccaagagggagcguuccacagagggagcguguaguggggggaacuguuuuauaaauuaauccguuuauugaaagguucacaaggacaaagaggcaacagcaagagucaggcacagaaauaaaggacgcagaaguagaagugcgccuuggaccuggaggacucuuccagaguguuuaucacuuggugaccugguaggagggcugcgagggcucuguucacccucagcaagggccacguguggggaggauuccauggaagucucugcugagaggggauaugauaaccaccagagcaccagugcuucuuaccuguacuuaccaaguggcaggcugugugccaacuccuuuauacacguugucucaccuaaaccuuagaaucccuuuuuuauagcugaagaaacucaggcccacagaagcagcaagccaggugucacccagcugaugaaucaggagccaggguuuugaauuuuuuuacuuugagaagccugugggccaggcgcggugucucacaccuauaaucccagcacuuugggaggcugaggcgggcagaucacuugaggucaggaguucgagaccagccuggccaacguggugaaaccccaucucuacuaaauauacaaaaauuagccaugcauguuggcaugugccugugaucccagcuacucgagaggcucaggcaggagaaucgguugaacccaggaggcagaggcugcaugagccaagaaugcccuauuggccgggcgcgguggcucacgccuguaaucccagcacuuugggaggcugagguggguggaucaugaggucaggagaucaagaccauccuggcuaacacagugaaaucccaucucuacuaaaaauacaaaaaauuagccaggcaugguggcgggugccuguggucccagcuacucgggaggcugaggcaggagaauggcgugaacccaggaggcggagcuugcagugagccgagauagcaccacugcacuccagccuaggugacagagcgaaacuccgucucaaaaaaaaaaaaaaaaaaaaugcccuauugcacuccagcccgagcaacagagugagacccugucucaaaagaaaaagaaaaaccuguguauucugggcccacacucagacccaccagaucaagguuuuuauuauuguuauuauuuuaauuuuuuauaaaaauggggucucacuguguugcccaggcugaucucaaacuccugggcucaagagauccucccaccucagccuccuaaaguacugggauuacaggcaugagccacugcgccuggcucagaccugggguuuuaagcccuuuuuugugccauggagcccuuggguggucuggcaaggccaauggaucccuucuuauuaaucuacaaaauaaauacauaggauucaaggguaaucaguuaaacugaaauauaguuauuaacauccugaaauacuacauuugugaaacaguaacaccagugguacuuuauguuaacaaaugaagaaccagcuuuagcagcagguccaacagugguguaaguuccaaguugugagggcugugcgaggaucccuguggcaucugcaacagcuguggccuggugugcaaauaucagugcauucuauuggugacaaaguugcagucauugcuaacugcugugguguguagccuacauuuauugccaaaggaaaugcugaauuucagaaguuaguggaaauaagcauguaauuuuucccauccaaguucauggaacccucagguuaccccagagguucaugauucccaccuugacccuugcacuggacucugcugugucauuucaagguaucaucaucauuaauuacuuuuugauuaguuuuuucucccuauggaaacauuguaccuugaguaagguuagaaauuuaugaaagaugaccgugcgcaguggcucacaccuguaaucccagcacuuugggaggcgguggcaggcagaucacucaaggucaggagaauuucgagaccagccuggccaacauggugaaacucugccucuacuaaaaauacaaaaauuagccaggcgugguggcgugcgccuguaaucccaguuacuugggaggcaggagaaucacuugaacccaggaggcugagguugcagugagccaagaucacaccacugcacuccagccugggcaacagagugagacucuaucucaaaacaaacaaacaaaaaaaccccacagauuguuuaaaauucaguuaacaggagagaggaucuccuuuucuuuuuugugguugauucugccacuuuugcuacacguuggccguggagagcuugggcugugggcagcagcuucauucccuucuaccagcguguugugggggagucuugguguguguggagguagcacaggcccguggcucacaugggcuucaccuggauacaccucuagccuugccccuugaugcagccccgcacagccgcagcccaaaaggggcccuagcacaccauagaggggagggcugcagggcugcagggcuugaggaguggccuuuccccucagcaugaccuggagaguguugguucugugcuuagccgcugugugugugccuuucugguagguuguauuacucuguacacuggauccaggagcuagaggagcugaagguggugaggguccccagguccaccguaggcuaugcuucccuagguggguuccuuagccucugcaucucccucucauucagaaaaagugauugagaaugucuucuuuccucugucgcccaaagguuaauggcuagacagauguaaacuuguuuggagcuuccaaaauauacagacuuccgcaugcuuacuguguaccaggcuugggacacgugugugcuaugccuuuuugucugcgcagugucuucccuauuaggagaagaggugcuguugguccggaacuuggugguguuuauaucgggagcagcauugcagcccaggcucagccucuguggaguguccuacuucauagcacggauuggggaggggaacgaauuccaugugugugcuuucauucaucuuauuuugaaucuaacauauguuuuggcaaggaggaugugggaagguggaacaaaagaagccugggguugggggugguaaagucacuucugggaaaaggugauuaaauacaagcuugcguccagauggguacaucccagagcgggaucacgagggaauuuucucuucauguuuuauaguugguugcuucaaaccugguuuucaagguccgguuugaagacccuaaccucucaguccuuuucuauugucuuugucuugcuuuuccacagaguuuucaggaguugaaaaugacaaugaaacugagccugugacuguggccucugcagguugcuggauuuuuucccuacauucacuauuguguuucauuuaaagaugagacugauucauuccacgugucgcaugaaacgccccaguugcauuuugguccuggacaccaucugagcugcuucccugcauugcgcuuccccauugcuucauggaguucccuuauucugcccauucugaccccagcuggagugaggacaaaugacaucucaggcagugcaugcaugggacuuccccccccauccaguuugacccugaccccacugcaugaggcucccugcuuuuucagucuuacaggcaggguuugggaggccgccucgugacugucauguggaugaaccacgagacaggaaaagacuuguuucuagauauucuguccugauugacaguaaauuuuaaauagacgucucucuuuuuuuuuuguuuugagauggagucccgcucuguugucugggcuggagugcaguggcgcggucuuggcucacugcaaccuccaccuccugggugcaagcaauucuccugcuucagccucccaaguagcugggacuacaggcaugcaccaccaugcccagcuaauauuuauauuuuuaguagagacgggguuucgccauguucgccaggcuggucucaaacucugaccucaggugauccacccgccucggccuccugaagcgcugggauuacaggcgugagccaccaugccuggcaaauagccguuucuuagaaaccucaauuccuagucaugauuuacagugccugauuucuguaccagaaugagacacauugcugaaaauuugucccuuuuccuuuucaguuuaagaacaagguuuaguguaaccuguuucuggcucuuuguugucaucugucaagggccauuuucuggguuuugguuuucguuguaacaucugcacuucucagcaauccucaggaggaggcaggaaggaugggacuuaacaccauagcauccuugaaauaggccguuccaugcagggaguauuuuaagccucccuuuuauccucccugccucgcuuguguggguucauuccccagggcgugccagguagagaaaacagccauguggaacccagccagcugagaaggcaguggcuggagaggcugguggcguaggaagugucaccaugcacccuggugaugagaacaggguaggccaccuuaccagguaguggccagagguguggggacccucaggggaccucuuggcuucaggugagacacccccaacucucccuuucuccaggccaugugcaugaucauaaacgguuuaauuucuucauugcgcuuccauguagauugcaaggcuaacaggacuugguaugaacuaacccgcauguccauccacugagcugccagcaccgguaacaccguguugagugagaagugaguugggcgaugcuggguugcacgccugacuucgccuuuucuccccugacccaaagguggcgaccugcacaugacccaguuuuuccgaggcaaucuggcuggcuuaacucuccguuccgggaaacucgcggauaagaaggugaucgacugucuguauaccugcaaggaggggcuggaccugcagguccucgaagacaguggcagaggcgugcagguaacaccgagcgcucgacugcacaccacucaugggccccuuagacuacagccccggaggcuggugggaugagggagugaguaaucugugauugauacguuuacuguuggguaaaagaguuguguucacuggacuuaaacgagcuuuucuuuuucaagucagcaauucaaaucgaacccaggccaguccccuuuguggaggcaucugugguuucagcuccugcgguuacuggcuuauucuucuccucucuguggcuggugugauuucagauccaagcacaccccagccaguugguauugaccuuggagggagaagaccucggggaauuggauaaggccaugcagcacaucucguaccugaacucccggcaguuccccacgcccggaauucgcagacucaaaaucaccagcacaaucaaguacguccugauuuuuaacagccggccuguuuugcccaaugacacuuguauauuuagguuuuuaagacagccuaaccccuucuguaaggaaaggugagccaucguguguaaccagaaaguguggggcagagagcugagugauauuuacgcaucuuguuugcaaguguguuccuggaguggccccggcagguguuagugggggccucuguaucccaccuccaugugccuuugcacaggugggcuccaagaucggcucccaaagcccugacccuuccccauuucuugcuggcagguguuuuaacgaggccaccugcauuucgguccccccgguagauggcuacgugaugguuuuacagcccgaggagcccaagaucagccugaguggcguccaccauuuugcccgagcagcuucugaauuugaaagcucagaagggguguuccuuuucccugagcuucgcaucaucagcaccaucacgagagaaguggagccugaaggggacggggcugaggaccccacagguaaugugcucuguggggcgcgggcucccucgccucggccggaaaccccauuguccccauguacuuggcggggcucuuugucucugugggauuuggggagguuuuaaucuuucguugguguucucucgggugugcuucuggaaucugacccgugagcuggagcucauggugaucucuggaaucccaucuggaggggucuuacaucuuuuccugguugcugccaggcuuugagauguggcuugagguugagggguugagggcacuuacgggagacacugcuugcaccugccaggcuggccagcccauggaggcacaauguccccacaauucuugcucaggacacaugaaacucccccccuuuuuuuuuuuuuuugagauggagucucacucugucgcccaggcuggagugcaauggugucaucuuggcuaacugcagcauccaccuccugaguucaagcgauucuccugccucagccucccgaauagcugggauuacagggaccugccacaacgcccgguuaauuuuuguauuuuuaguagagacgggcuuucacccuguuggccaggcuggucucaaacuccugaccucaggugauccacccgucuuggccucccaaagugcugggauuacaggcgugagccacugcgcccagccguuucuugaaagcaacucucgcuugcuucugucguugguccuuacgagagccauguagguuuggggugagccggcagggcauccagugugccccgccacgcugggccccacugccccuacuuaauauuucugguugggccucuuuugcaguucaagaaucacugguguccgaggagaucgugcacgaccuggauaccugugaggucacgguggagggagaggagcugaaccacgagcaggagagccuggagguggacauggcccgccugcagcagaagggcauugaagugagcagcucugaacugggcaugaccuucacagguaaggggagcgcugcagccacgcaggugggccaggcugcaagaggggacuuugagagcucuuggcuggcugcugccugccaucugagaauguugaguuaucuuagagggagauggggaaggagcacguucgcugggaucauuguuggcugcacgcauacuccugucuccuggacagguaccggauguguagccacuacucucuaaagggggaggguugaggcgugggaugacacgucccccacagagggaagaaugccccugugcacauugcauuuauucccauggcuagaaagccaacuugugugaccccuuggccuagcuaaccugggugucuaauugagccugccugugcugacggcugcagcccugcccaugcuccugcccuaagccacccggcaaucuucccccuuucaaccccugcaggcguggacaccauggccagcuacgaggagguuuugcaccugcugcgcuaucggaacuggcaugccagguccuugcuugaccggaaguuuaagcucaucugcucagagcugaauggccgcuacaucagcaacgaauuuaagguggaggugaguacaaggcucccacugagcagggccaauagcagcagugagugagggcgcugauuugcagcccuaauauucacaaacgccaaccucagagcauucaugauggcagcuauacaggcucauucuagggggucgccuuuccagccuggggccugcugcagguuacaccugggcuuguuggagugacaaguuguguuuggggugagcugggguggggggugcuccccuuucccuggcugccucagccugaguuggagccuaaggaacuuugcagggaggugacaaagagcaaguggcaguuaaugccucuggggcuucuugagauuucccaugagagaaacaggaggaugugguuuuauuuauuuauuuauuuuuagagacgaggucucacuauguugcccaggcuggucuuguccccccagguucaagcaauccacuugccuuggccuccaaaagugcuaggauuacaggcgugagccacugugcccagccaaagacacuguuuuagaaagagcagcauccagggaaccaaaaguucucugcaucugugccaggucacuggcccuccugugaaugaagucgaguccucggcccagguugagaggggcucacgcagggacccgcacgggcaggaccagugcugcugaggcuggcgcuggugacucacaggccacacaggcuagaggguagcuccuccugcucugaggucgucuacagaccuauccagcagcugcuucaucgcucaggcucucuguggccuggagaaaauugacccaaaguuacucuuagcaauggaauaucaccaugaacucaagagcagaaugcuaaauucggugccuguuuuguuugagucaaaggguaagagauaugaaaggaaauccauggcagugauuggugcugucuuucacacggcugugauuugaggaaaaaggucuacgccagugcuucccaaacgacccauggggaaggaccaucggcuucuuuuucugcucuuguuuugggcauaaucuuuuauaaaaugcaauaaaaauggauugcagccaggugcguggugcuugccuguagucccagcuacuugagaggcugaggugggaggauuacuugagcagggaaguuccaggcugcagugagccgugaucaugcuugugaauagcuacugcgcuccagcccgggcaacacagcaagacccagucucaacaaauacuaauaaguagaaaagugauacauuucuggaaugugugagaauauuagauuguuauagcaguuucuaagugcuuauuacucuuuuuuguuugguuuuuguuucuuuuucuuuguuuuuguuuuuuaagugcuuacucuugauuuuuuuuucuguccuuuucccguagcuccguuugcccccagcugcgguccaggagccacucugaguggcacuggucaugccagcugcgggacuccacugucaccucuuggacaggcucaggaugccugucuccagcgauccucucuuucucugcuauaggugaauguaauccacacggccaaccccauggaacacgccaaccacauggcugcccagccacaguucgugcacccggaacaccgcuccuuuguugaccugucaggccacaaccuggccaacccccacccguucgcagguaggacauggggagggagaccaagcggagaugcuccaugccguccgcccugcccccaccccaccgugggcacagccuccugcucagcaugaccgccggucuuucccugucccaauuauuccccaucacacacaaggaaacuaaagcccucgaagagggcagaugaugucacccgcagccauggagcaggacguggccgagccagguuggaggcccauggcgagcuuuuccugguauuuccuccuggccuguggguucagcugaagcgugcuguccagcccguuuugaccaggcacagccgaggaggucaagggcacaguggccuucugggccgagugaccucgcaucccgcccccucauucucccacagucguccccagcacugcgacaguugugaucguggugugcgucagcuuccugguguucaugauuauccuggggguauuucggauccgggccgcacaucggcggaccaugcgggaucaggacaccgggaaggagaacgagauggacugggacgacucugcccugaccaucaccgucaaccccauggagguaggagugggcgggcgaccuccaggacugagaggcagcacaggccagggccuccgagaagccgguacggcgcggcuccuucagguucacaugcuuuccaucgcgucaucugcucagcaagccuggggcuuaggugucuucguggguaaaccgaggcugagagagaccuuauucaaggccguucugccuuaaguguagagaagagccaugccagggcuuggcgcucuugggucaugguaauccugagagaguucucugguggggcagcugaggugcugucccaagcugcuuuguaugugggugacuccgugggugcugacuggagcuuuguuuucccuucacuucuaauauaacuuccggugccguccuggcugcucugucgcuggggagggagacgcuggggcaaguucuccuuccucuguggcugucgagaggagaaugccaggugacggggcugugggcagggccggacucauguggccgucacuucuccuugccagaccuaugaggaccagcacagcagugaggaggaggaggaagaggaagaggaagaggaaagcgaggacggcgaagaagaggaugacaucaccagcgccgagucggagagcagcgaggaggaggagggggagcagggcgacccccagaacgcaacccggcagcagcagcuggagugggaugacuccacccucagcuacugacccgugcccccggccaccucgguuucugcuuucgaagacucugcugccauccguucucccagucccaaggguccacgauguacaaagucauuucggccaguaggugugcagaccccuccccgccacgaucgucgcugugcuugguguguaggacccuaggcuccccgcccacccucugccuggucgcgcucuucagucccacgaggagcugacacguccucucuggccgccauccggcucgcacaggggccucccagcgccucaggccccgcguuugugucuggagucuccccccggggagaggacacuggccccucgcacuccagaaaagccaugccagcugggcucguugacaaaggguaaaacaugcucacucccacccgguaaucauuuuuuucuuuuuuuaaaaaaaguuuuuauuuuuuccaaacuagugcauguauaaauaauggcaggaugggggguacuguguagaugauuaacugacuuuuuaauauuuuguaaauaaaucggauuccuuguguccuuugugcuaguguaacccgggacuggaauguaaagugaaguucggagcucugagcacgggcucuucccgccggguccucccuccccagaccccagagggagaggcccaccccgcccagccccgccccagccccugcucaggucugaguauggcugggagucgggggccacaggccucuagcugugcugcucaagagacuggaucaggguagcuacaaguggccgggccuugccuuugggauucuaccuguuccuaauuugguguggggugcggggucccuggccccuuuuccacacuccuccuccgacagcagcucccugggcaguggccuggucucaccgugugcagccuugugguuuaugcuuaaauguacauuuuccugcugguaaaaggagaaacugagagguguccugcagaccggcugaccacuccuuuuggagacggcaggaggccugagcgauccguacucagaacguccaggagagacgcauggcccgaagucaaagugcuggaauuuuccaaaacagccuguucucuccucucuccuccccagagcacccccugccaucagggggguugaaaucccucucccccaggagcccugcugcuuugcuuggugguagggcaggagagcaaacaaacagucauggucuaaaacccacauagcacuuugcucuuaguuacauguaaaauuuuagauuucuaaaacaggugggcaaucauuuugaauacuguucugugacccugacugcuaguucugaggacacugguggcugugcuauguguggccauccuccaugucccgucccuguagcugcucuguuuagacagcggacagacgcucacgcccaggggauguccucacgcugucgccgcgcgguuucccuucgcagauguguauacucaugauaggucagaaaguguauccgcuacaauaaaguucugguucuaacuaacucca

SEQ ID NO: 191436 - RNA, 33252 nt, Homo sapiens
ggcucggaggccccucuuuucggcagcugggagggcagcggggcggaccgacgggaucucgcgagauucucgcgcgguaggcccugaggacccagcauggcggacucgggacugcugcuaaagcgggguuccugccguuccacuuggcugcggguccgcaaggcccggccccagcucauccucagccgccggccccgccgccggcucgggagccugcgcuggugcggucggcggcgccuacgguggcgguuacugcaagcccaggcguccggcguggacuggagggagggagcccgccaggugucgcgcgcggcggcggcccggagacccaacaccgcgacccccagcccgaucccuagcccgaccccggccuccgaacccgaguccgaacccgaacucgaauccgccucgaguugccaccggccucuccucaucccaccggugcggcccgugggccccggccgcgcguugcugcugcugccggucgagcagguagguggggggcgccgguaguaguccccgagggcagggagggcuggagaggcagccccgggagagcugcaggguaggagaggaccguggucccccgggccuguucucuggcugccagucggauucaaguccauccucuugaugguugguggcaacuaggcuccccugagcagcaggguaacagguacccugcuaaggggucccuaggccuuacgagcuaaagggacuuuauuuuguuuuguuuucuuucuuucuuuuucuuuuugagacagagucucacucugucccccaggcuggagugcaguggcacaaucucggcucacugcaaccuccgcaucccggguugaagcgauuccccugccucagccuccggaguaguugggacuacaggcgcgugccaccucgcccggcuauauuuuuuguauuuuuaguagaaacgggguuucgccauguuagccaggauagucucgaucuccugaccuugugauccacccgccucggccucucaaagugcugggauuacaggugugaaccaccgcaccuggaacucugaaagggauuuuaauaguuaaaaaaaaaaaagguugcaauuacugagagcucagaaauuccaggauuuaaggguuccaaaaguguuuuaggcuuugaacccauuuaaacauccagcucucuuacggaguaguugucccucucucuaaguguuuacagacgaggagacugagguuggguaacuuacacaguagagggagagcuaggagucgaacucaggcagccugauucuuaacguggaugccauuccuggagauucccugucuaaugcaggagggaaggcaaaacccaggaaguucuggaagagacuuggcaagcugugggucuuuaaaaggacagagugguagagucugucugaaccaggagcacagagccgaguucacggucaccaugcuuucucuguagcugccaugggguaugaucuuaguuuaaaaauauaaaguaugggccaggcgcgguggcucaggccuguagucccggcacuuugggaagccgaagcuggcagaucaucugaggucaggaguuugagaccagccugaccaacauggugaaaccucaucucuacuaaaaauacaaaaauuagcugggcaugguagcacacgccuguaaucccagcuacucaggaggcuaaggcaggagacuugcuugaacccgggagcuggagguugcagugagccaagaucacgccauugcacuccagccugggcgacagagugagacuccgucucgaaagaaaggaagaaaggaaggagggaggggaaaagaaagaaaggaaaaggaaaagagagagcugggcacaguggcucacgccuguaaucccagcacuuuuggaggcugagguggguggaucaccugagguagcgaguucgagaccagccuggccaauauggcgaaacccugucuaguggcucacgccuguaaucccagcacuuuuggaggccuaggugggcggaucaccugaggucaggaguuugagaugugguggcacacgccuguaaucccagcuacucuggaggcagaggcaggagaauugcuuuaaccugggagguggagguugugguaagcugauacugucccaaaaauaaauaaauaaauaaaaauuaaauaaaauuaaaaaauuuaaaaggcugcagccauaaaaagggaugagaucauguccuuugcagggacuuggauggagcuggaagccguuaucuucagcaaacuaauucagguacagaaaaucaaauaucggccgggugugguggcucacgccuguaaucccagcacuuuuaaguuccaggguacauacgcagggugugcagauuuauuacguaguuaaaugggugccuuggugguuugcugcacagaucaacacaucaccuauguauuaagcccagcauccauucuuccugacgcccuuccccagacccccacaggcuccaguguauguuguuacccaccauguauccauguguucucaugguucaaaucccacugauaagugagaacauaccauauuuugauuuucuuucuuuuuuuuugagauggagucucgcucuguugcccaggcuggagugcaguggcgcaaucugggcucacugcaagcuccgccucccggguucacgccauucuccugccucagccucccgaguaguugggacuacaggugcccgccaccacaccuggcuaaguuuuuuguauuuuuuuuaguagagacgggguuucaccguguuagccuggauggucuugaucuccugaccuugugauccacccgccucggccucccaaagugcugggauuacaggcgugagccaccacacccggccgauauuugauuuucuguaccugaauuaguuugcugaagauaacggcuuccagcuccauccaagucccugcaaaggacaugaucucaucccuuuuuauggcugcagccuuuuaaauuuuuuaauuuuauuuaauuuuuauuuauuuauuuauuuuugggacaguaucacugucgcccaggcugcaguguacuggcaugaucucagcucacugcagccuuugccucuggauucaagcgauucucaugccucagccucuggaguagcugggauuacaggcacaugcccagcuaauuuuuguaauuuuaguagagauggugguggcggggguggggugcagggggguuugccauguuauccaggcuggucucaaacuccuggccucacucaagugauccccccaccuccuucucccagaguucugggauuacuggcgugagccaccgugccuggcccaauacuuauuacugauggaguggagugguguaauuacgguucacagcagccucuaccuccgagacucaagcagucuacccaccucagccucccaaguagcuaggaccacagaggcaugccacugcacccugcuaauuuuuaaauguuuuguaaggagaagucucacucuguugccuaggcugaucuugaacuucugggcucaagugauccuccugucucagcuucccaaaguguugggaucacaagcaugagccacugugccuggccuuaccugccuuuugaugugugaauagcaaguuaagauuuuagaauuuggccaggugcgguggcgcacgccuguaaucccagcacuuugggaggccgagguggauggaucaccugaggucgggaguucaagaccagccugaccaacauggagaaacccugucuuuauuaaaaguacaaaauuagccgggcguggugacacuuaccuguaaucccagcuacuagggagggugaggcaggagaauugcuugaaccugggagguggagguugcggugagccgagauugugccauuguacuccagccugggcaacaagagcaaaacuccaucucaaaaaaaaaaaaaaaaagauuuuagaauguuucagucauuagugacaugaucuauaauguuuuuucuguuuucucucccugcuaggguuuuacuuuuagugggaucugucgugugacuugccucuauggccaggugcagguauuugguuuuaccaucagccaaggccagccugcccaagacaucuucucuguguauacccacucuugcuugaguauccaugcacuucacuacucacagccugagaaaagcaagaaggaacugaaaagggaagcccggaauuugcucaaaucucaucuuaaccuugguaaugaaaagaacuggguaauuuacugagggccuacuguaauaaggcuaauucauaauuuuuagggccaggcgcgguggcucacgccuauaaucccagcacuuugggaggccaaggcgggcggaucaugaggucaggagaucgagaccauccuggcuaagauggugaaacccugucucuacuaaaaaugcaaaaaauuagccaagcgugguggcaggcgccuguagucccagcuacucgggaggccgagacaggagaaucgcuugaacccgggaggcggagcuugcaguaggccgagaucacgccacugcacuccagccugggcaacagagcgagaccccaucucaaaaaaaaaaaauuauuuuagaugcuuacuauggucuaggcagugugcuaaggacguugugguaucuauauaaacccuuacgaggguccugagagugaaaguacuauuguuaucaccauuuuacugacaagaaaaauuguucaaggccacagaauuauuauguggcaaaccucgauugacuucuccucccagauguguucuuaguauguaguacggcccccugaaaaaggcucucaaccguaauuccuacucuccuaauguuuauaguuuagccgaggagauggcaguccuaaagggcguggaauguaaugaaguuacugcuucuaaggugguuuauuuuucucuuuacagaugacaggcguuggucgaugcagaauuuuucuccucaguguuccauuguguugcuagaacaucugaaaacugccacuguaaacuucauaaccagcuauccggguucauccuacauuuuugugcaagagguagaacccguuuucauucagaguuuugcuaauuacuugcaccaaaacagugauuucaaaugacuauguaggauguugucuuggaagaacaguuggucuaucuagugcucucaguccuacagaauguaauacguguauacggaaacuauuauagaaagguguaucgugaaaaauguucauccuccccuccuuaguuucauaccugagccaccauuuuauaucguaguugguuaagugcuuuuuggguuuuuauuaacaccaugcuccagcccugcuuuuuugguugguugguugguugguugguucguuuuuuugagacggagucucacucugucacucaggcuggagugcaguggugcgaccucaaccucacugcaaccccgccucccagggucaagcaauucuccugccucagccucccgaguagcugggauuacaggcgccugccaccaugcccggcuaauuuuuguuuuuuuguucuuuguuuugagauggacucucucucuguugccaggcuagagugcaguggugugaucucucggcucacugcacccucugccucccgggaugaagugauucuucugccucagccucccaaguagcuaggaccacaggugcaugccaccaugcccagcuaauuuuuuuguuuuuaguacagacgggguuucaccauguuggccagguuggucucaaacuccugaccucaggugaucugcccaccucugccucccaaagugcugggauuacaggugugagccaccaugccuggccuuuuuugggguuuuuaaugguugucuuuauauuucaguuuauuaauuugagauaauauaaauugucucuaaacuaugaaugaguaguuuaaaugaacuuauauuuucuuuuaucucuuuccuuaccucuaauuuuuaacgagucuuaauuuuuauuagucaaaaaggcuucauuuuuuauuuagcuuucugacucugugcuugugccuucagcacuuuuacaaugauguucuccuccucgagaaggaaagcacgcuugauccuguccugaacacguuuagcacgcauggaaccaccguaggcucugcugacaugguuuuuguuuuggacaaucucuuaagaacuuuaggucuuggcggggcgugguggcucacgccuguaaucccagcacuuugggaagcugaggugggcagaucacuucagguuaggaguucaagaccagccuggccaacauggcaaaaccccaucucuacuaaauauacacaaaauuagcagggcauggggcaugcaccuguaaucccaguuacuccagaggugaggcgggagaaucgauggaaccugggaggcgcagguugcagugagcugagauugcgccacugcacacuccagccugggagacagagugagaauccgucucaaaaaaaaaaaaaaaaaaaaaaaaagaacuuuaagucucauggcacggaccccucgaagccugccugggccacgccaaugcaaauuuugguguuuucccaaccuucuugguacagagacaaacaauuuuauuaccagggguucgggacagccuaguuuuguuagagccuguauuguaggaagccuaugacgguguauuguaggaagccuaugaugauguauuguaggaaagccuaugacggugugucaaaugcuggaccauucucacuucguguagacaacgucccaagaagagagcuuuuauuuuuauuuuugagauaaagucucuguugcccaggcuguagugcaguggcaggagcucagcucacugcagccucaaccuuuccgggcucaggugacccucccaccggggccucucaguagcugggguuacagguacacgccaugacucccggcuaauuuuuguaguuuuuguagagauaggauuuugccauguugcccaggcuggucacgaacucuuggacuccagcaauccaccugccuccaaaagugcugagauuacaggugugagccaccgugucuggccucaccucuaaauuuuugcugaccguauuauucauuuccuuaaguucuuuuuuuuuuuuuuccauuuccuuaaguacuauuacuauaauugucucccaugggccaguagguggagucuaaucuccaggauuggcagacagacuggauaugugaggggugaggaagaaucaaggaaucacagcagguuuuuggcuuaacgacuggggugcauguaguugccauuaacugggauggggucacugcaggaggaguggguuuccauuuguuaaccuugagaugccugguagacaucagcuggacaugucaagugggcaguugaauaugugggccuggaguucagggaagaguuuggagguguaaauaugggagccuucagcagagaggauacccaggccaccagaugcgauaauaaugcugauggaguugaauagauagaaacaagaugguuccagcucugagcccuggggcacuccaagaagagguccaggcaaagaugagggagcagcagauagucaucgguuuugguggaaaacccagugugugauguccuguaggucaggaagucuuuaaacgagaguuaacugaacagcgguggcgaaagcugcugguggucaggugagaccugagaaagcgcuggcuguagaggccgggaaguagccugauuggaauggggucaagagccugggcggagagggacucacaggcuuaguaguaaaguauuuugcuuugguagaaguuagcuguaaagggaagaaaagaaaugaagcacuaguugcagggauaaguaugaucaggagaguuuuguaauuuuguuaagauggaugaaaaaaacaugcuggaacauggcagaugggaaugauccagaggaagggggagguaaccaugcagcagagagaggagaggcugcuggaacuauguaaguuggcuaccagggauggguccgguucuggcaucauguggccuuaggagcauagccaggucauucauaguggcuagaggaagucccuuggagagggccagaggaaguagaaguuguccucugauuauuuccugcugcacugggaaaugaaaucaaggucgucacugugugggaagcagauagauacgagguggguguggggaauuugaagugaaaggagagaagaaaugagagugggacagcgaacggacuguugugauugccuuuuagucuuuugcagaguccaguagcuggaccaggacugcagaggaggagauggaauugccuguucucaagccuugguuacugaaagugaauguuccagaugcuauggggcagccacauucuuuuuucauuuauuuucagcuuuaucuguuuuucugggacuucaccaccacuguucauauuucuuaugcucuuucuuggauacuucccucccuaucccacccucuggaugugucaguagauucuggaguuguuuuuucacauaagggagauaguaaacuugauuaucuaauuuuguuagauauucuugauuugcccucagugauugauaauugcacacaguguagaaugguugguucaacagacuuuuuucucaaauuguugaaggccuuguucuguuguuuucuaagauccagcauugccgauaggaagccucacacuaggcugcuucucuuuuuuuuuuuuuuuuuuuuuuuugagacacagacacagucucccucugucgcccagguuggagugcagugccacagucuugacucacugcaaccuccaccuccuggguucaagcgauucuugugcuucagccucccaaguagcugggauuacaggcgugcaccacugcgcccagccugcuucacauuucuuuaugguaucuuuauuuucaguguugaugaauugcaagaggacggggcccuuccuucauccucuucuguggugagcugguuccaacugagccuuaccugccucagcaagggccugcucuuccuuuccuuggguugcuuucccaguccuggacuucacagaccugucuucucccuccuuucaacucuguuugcauauguucuguccguguguuuuugcuuuauguuuucagagguugccuugacuugauucuacaucacucaccuggucuagagccagggccuccugcugaauguuuccugugcagucaugucuuaccaggcauuuucuuuuucucuggagucuccugcggaggcagugaaggcucgagagaaagcagaaacugaaaauagacguggauaacuucaggaauacaguuggcaacacuuguugauggguuggauuuuggggcaggagacaaagggaggaaacaauuuaucuucucuggcucacaacugugugaggcuugauuaauuuaguacugaagaaaaaaauaugcauuuuuucaccuuaaaguuuaaauuguugauuucagaguccaacuccccagauuaaaccugaauauuuagccuugaggucuguuggcaucagaagagagaaaaaaaggaaaggccuucaguuaacugagaguacccuuucagcccuggaagaguuagucaauguuuccuguggugaguaauacacauugaucacccugaaugucuguccaccagacccccagaggaagauuagucauaauucgaguccaaggaagacggcuaauucuagcgaucaauguuuguuucccauucagaagaaguagauggcugcccugucauucuaguuuguggaucccaggauguuggaaagucaacauuuaauagauaccugauuaaccauuuguuaaauagguaagagugcuuuucuuauggcuuugacacauugcuagguuuuugucaugaagugggauuuuugauuuggagggaaugcuucuuggcuucuagcuagagauuacauacaggucuaaagcugcccagcugaagcaucugguccucacugccgucugcuuugcaguaugugacaaugcucuagcguaggcugacuuugccuuaccugcaggcagacuuccaagaggagacacuuggucucagagucuguauuuauaaguucugggguggggggcggggggggggugcgugugugcgugcguguguguguguguguuuucagacaggguuucccucaggcuggagugcaguggcacagucauaccucauagucuugaacuccugggcucaagugauccuccugccucagccuccugagcagcugagacuacagccaugggccaccaugccuggcuaauuuuuuuauuuuuguagagaugaggucuugcuauguugcccagucuggucucaaacuccugggaauuuucgcuuaauuuuuuuuuuuuugagaccgggucugacuguguugcccagcaaaaaguguaguggcacaaacagggcuugcugcagccuugacguccuggguucaagcaguccucccacuucagccucccacguagcagggaccacacuagcgcaccaccacaccuggcuaguuguuuguuuuugagacagaguuucacucacccaggcuggagugcaauggcauguucucugcucacugcaaccuccgccucccagguucaagugauucuccuaccucagccucccgaguagcugggauuacaggcgugcgccaccauacccggcuaauuuuuguauuuuuaguagagacaagguuccaccauguugguuaggcugaucucgaaauccugaccucagguuaucugcccgccuuagccucccaaagugcuaggauuacaggcgugagccaccaugcccggccucuggcuaauuuuuuuguuuguuuugcuuuuguagacagaggaucuugccauguugcccaggcuggucuugaacuccugggcucaagcaauccuccuaccuuggccucacaaagugcugggauuacagauauaagccaccaugccagaucugaaauuuuaccuuuacaacaacaacagagguggguuaugguggcuuacaucugcagucgcagcacuuugggaggcaaaagugggaggcuggcuugagccaaggaguucgagucuacagugagcuaugucacaccauugcacuccagccugggcaacagagugacacugugucucuaaauaaauaaauaaauaaauaaagccugggcgcaguggcucacgccuguaaucccaagccuuugggaugcugaggcgggcagaucacgaggucaggagaucgagaccauccuggcuaacacggggaaaccccgucucuacuaaaaauacaaaacauuagcugggcgugguggcaggcaccuguagucccagcuauucgggaggcugaggcaggagaauggcgugaaccugggaggaggagcuugcagugagccgagauggugccgcugcacuccagcgugggcgacagagcaagacucugucucaaaaaaaaaaaagaaaaaaaggcugggcaccguggcuucugccuguaaucccagcacuuugggaagcugagguaggaggauugcgugagcccaggaguuucggaccagccugggcaacguaaugagacccugucucuacaaaaaauuuagaaauuagucaggcaugguggcaugugccuguggucccagcuacuugggaggcuaaggagggaguauugcuugagcccaggaggucgaggcugcagugaguucugaucacugcacuccagccugggugacucggugacacccugucucaagaaaaaauaaacuuauaugaaaaauggcugaguguuagcucaugccuguaaucccagcacuuugggaggccgaggcagguggaucacuugaguucaggaguucaagaccagccuggccaacauggugaaacccugucucugcuaaaaauacaaaaauuagcugggcacgguggcucaugccuguaaucccagcacuuugggaggcugaggcaggcggaucccaaggucaggagaucgagaccauccuggcuaacacugugaaaccccgucucuacuaaaaauagaaaaaauuagccgggcgugguggcacaugccuguaaucccagcuacuugggaggcugaggcaggagaauugcucaagcccgggagacggagguuauagugagccaagaucgcgccacugcacuccaaccugggcgacagagcaggacuccaucucaaaaaaaaaauucagcugggcucagugccucaggccuauaaucccagcacuuugggggaccgaggugggcagaucacgaacgagaucaggagaucgagaccauccuggcuaacauggugaaacccugucucuacuaaaaauacaaaaauuagccgggcaugguggugggugccuguagucccagcuacuccggaggcugaggcaggagaauggcaugaacccaggagguggagcuugcagugagccgagauugugcacugcagcccagccugggcaacagcgugagacuccaucguaaaaaaaaaaaaaaaaucugaaagagcaaguuguuauccguguuacaaauggacauugugaccaugccugcacugcguuucucuggacucguuuuuaaacagcgauugucaucuugaggcuucacuucuaaagugcugugugugguggauuaugccugcgugucacaugaaaucuuuacugugugauuauccuuucuacugaguaaagcuaguuaggauuuucuuucuuuuuucuuuuuuaaaaauuugcagucuucccugcguugacuauuuggaaugugaucugggacagacagaauuuaccccuccugguugcauuucuuugcuuaauauuacagaaccaguucuggguauguauuacauauuucucaaaugucuugguuuuaugaaauucauaugugaugaugcuaacaaaaacucagaaaucgaagaguauaaaauauuaaaagggaacaugcgccuaccaaacucauggucuuuccauaacuuguuccucuaaccuccaaaaaacaaacuauggugcuuucucauuuuaggaaauggaacugcuacucauuuuguuuuaugaaauuaguuggguaugguggcaaaaauuauuuuguuuuauguaaauuagaaacacauguuucccuaauuucaacaucuuauguacaacuaucgagacuaagaaauuaauacugaaucaauacuguuaaucaggcugccugugguggcucacacuuguaaucccagcacuuggggaggcugaggcuggugcaucaccugagguagggaguucgagacaagccuggccaacauggggaaaccccaucucuacuacaaauacaaaaauuagcugggcaugguggugcacgccuguagucccagcuccucgggaggcugaagcaggagaauugcuugaccgggagacggaaguugcaaugagcugaggucaagccacugacuccagccugggcggcagagcaagucuccaucucaaaacccaaaaaaacaaaaauuagcuggguuugguggcacgugccuauagucccagcuacuugggacgccgaggcaggagaaucgcaugaacccagggguggagguugcagugagccaagaucauuccacugcacuccaaccugggcaacagagugagauucuaucucaaaaaaaaaaaaaaaaaaaaaaacgcuguuaaccagucuacagauuuuauugaaaauucaccaguuauccacaguucuacaucacuuaaaaaaaauaauauguuauccuugugcggggcccauugccagucuucucuguaucauuccaguuuuuuaguauaugugcugcuggaguaaguaccaccuugcuugcuuuuuuuuuuuuaagauggagucuugcucugucaccuaggcaggcuagagugcaguggugugaucugugcucacuguaacccccgccuccugaguucgagcuauucuccuguaucagccuccugaguagcugugacugcaggcgcacgccaccaugcccagcuaauuuuuguauuuuuaguagagacagcguuucaccauguuggccaggcuggucucgaacuccugaccucaggucaucuacucaccucugacucccaaguucugggauuguaggcaugagccacugugccuggccacaacuuuuuuguuguguuugcaacguggugagacccugucucuacaaaaaauuuaaaaauuagucgggugugguuuuuugucaucccaaaaugaaaacuguacucauuaaagaauaacucucggcugggcuugguggcucaugccuguaaucccagcacuuugggagaccaaggcggguggaucacgagguuaggagaucgagaccauccuggcuaacauggugaaaccccgucucuacuaaaaauacaaaaaauuagccaggcguaguggcgggcgccuguagucccagcuacuugggaggcugaggcaggagaauggcaugaacccaggaggcggagcuugcagugagcugagcucucaccacugcacuccagccugggcgacagagcaagacucugucucaaaaaaaaaaaaaaaagaauaacucuccuugggaggcugaggcaggagaaucgcuugaacccgggagggagagguugcggugagccgagaucucaccacugcacuccagucugggcagcaagagcaaaacucugucucaaaaaaaagaguaacucccuuaacucccucuuguccuccucuuguccucuuuccuagccccuagagacuucaccucuguucuacuuuuugucccuaugaauuuggcuauucucauguaaguggagucacacaauacuuauccuuugucuggcuuauuucacucagcauaguauugucaaaauccauccauguuguagcauguaucaaaauuuaauuccuggccaggugccauggcucacaccuguaaucccagcacuuugggaggccaaggccggcagauugcuugagccugggaguuugagaccaggguagcauggugaaacccagucccuauuaaaaaaaauacaaaaguuagcugggcuuggugguccaugccuauagucccagauauuugggagucugaggcaggaggaucacuugaaccugggagguagaggcugcagugagcugaaauugcaccauuacacuccagccugggugacaaacagugagauucugccucaauaaauaauaauaauaauaauucuuuuugauggcuggauguuauucaauuguauguguauaucacauuuaguuuauccauucagcuguuaagggacacuuggcuucuuuccacauuuuggcuuucgugaauaauccugcuaugaacauggguauucaaauaucuccuccauauccugcuuucaguucuuucagguguauaccgaggaguggaauugcugggucuuaugguaguucuguguuuaauguuuugagaacugccaaacuguuuuucacaguagcugcauuuuacauucccagcagcaaugcacaagaguucugauuucuccguauccucaccaaugcuuauuuugauuauagcugucugaguuugugugaaguaaugucucauguugguuuucauuuacauucccuuaaaugacuaaugauguugagcauguacuuauuggccauuuguauaucuucuuuggaaaaaugucuguuccaguccuugaauauugcuuguguguuuuuuuuguucguuuguuucugagacagagucuugcucuuucgcccaggcugaggugcaguggcgugaucucagcucacuacagccuccaccucccggguucaagcaguucuccugccucagccucccaaguagcuggaacuacaccacgccuggcuaauuuuuguauuuuuaguagagauaggguuucaccacauuggccaggcuggucucgaacuccuggccucaggcgauccaccugccucagcaucccaaaaugcugggauuacaggcaugagccaccacacccagccugcuuguuuuuuuguuuuuugucuguuuguuuuccuuuuugagacggagugccgaggcuggagugaaguagugugaucucaguucacugcaaccuccgcuuccuggguucaagugauucuccugccucagccucccgaguagcugggauuauagaugcccgccaccaugcccagcuaauuuuuguauuuuuaguagagaugggguuucaccauguuggccaggcuggucucgaacuccugaccucaggugauccaccugcuuggccuccuaaagugccuggauuacaggcgugagccacggcauccggucccagccugcauguuuuugaauuggauuguuacuuuuuguugaguuuaguaguucuucguauuaauaguaguucuuuauauuaauccuuuaugagauguacaaucugcaaauguuuucuccuguucuguagguuguuuuuuugcuuucuugacaauaaccuuugaugcacaguucuuaauuuugaugaaguucaguguaucuauuuuuucacuuguugccuaugcuuuugguguuacauccuugaaaucauuacuaaauccaaugucaucaugauugucucuaauguuuucuuguaagagcuuuauaguuuuuaacuuuuuaaauuuuuuuauuuuuaaauuuuucagccugaauuuguuuguucaguuuuuacucuuuuuuuuuuuuuuuuuuuuuuuugagauggagucuugcuuugucgcccaggcuggagugcagacgggguuucaccguguuagccaggauggucucaaucuccugaccucaugauccaccugccucggccucuccaaagugcugggauuacaggugugagccaccgcacccagcccaguuuuuacucuuaaguuuagguuuuugauccauuuugaauuaauauuuucauauaguguaaggaauugguccagcuucuuucuuuugaauauagauauugagauuuuccaccaccauuuguugaaaagacuaucuugaagauuguuugaucuuauauguaugggcuuauuuccugguuccguuucuguuucaucaguguacaugucuguccuugacccaguaucauauuguuuuaauuacuauagcuuuucgguaaguuuugaagucaguacaagugccuuacccauuuuucaguuggguuauuuguuuucuugcuguugaguuucuuguguuccuuacauauuuuggauauuaacucuuuaucagauggaugauuuacagauguuuucucccauucugaggguugucucuuuggaauuuuuuccuuuguuaugcagaagcuuuuuaguuugaugccaucucauuugucuguuguuaaccuuuguuuucggggucauauccaaaaaauuguuaccuagaccagugucaugaagcuuuuccucuaguagguuuacaguuucaggucuuaauacuuaagucuuuauuccauuuugaguugauuuuuguauaugguguuugauaaggauaucuaguauccuucuucuccccguggauaaccagauuucccggccuuauuuauugaagacuguccuucccccuuguuuuguuauuagcaccuuugucagaagucaauuggcuguaaaugcaguguuuauuuccaggcuuucuaugcuguuccauugggugauaugucuuuuuuuaugccauuaccgugcuugguuuuugagagagacagugucucacucugucacccaggcuggagugcauuaauuagcacaaucauagcucaccgcagccuuggauuccuggaaucaggugaucugccuuagcuucccaaagcacggagauggcagagccaccaugccugauccugccaugcuguuuuacuuaaaaauuaauuuaaaaauauuuauuuauuuauugagaccgggucuugcucugucacacaggcuggaguacaguggcguaaucacagcucacugcauccuccaccuucugagcucaggcuagccuugcagguagcugggaaaacagguaugcaccaccaagccuaacuccauuuuuuuuagacuuuguagaaacagggucucccuauguugcccaagcugcucucaaacuccggagcucaagugauccucccaccuaagccucccacaguccugagauuacaagugugagccacugcaccuggccuuauuuuuuccuuugagacaggaucucagucugucacugaggcuggaguacaguggugugaucauagcuuacugcaaccucaagcuucugggcugaagggauccuccuaccucacuuugaguagguaggaugacagcuauuauuagccaccacaccugucuaacuuuuauuuuuuuauuuuauuuuauuuuauuuuauuugagacggagucucgcucugucacccaggcaggagugcaguggcgugaucucggcucacugcaagcuccgccuccuggguucacgccauucuccugccucagccucccgaguagcugggaccacaggugccugccaccacgcccggcuaauuuuuugcauuuuuaguagagaugggguuucaccacuuuagccaggauggucucgaucuccugaccuggugauccauccgccucagccuccuaaagugcuaggauuacaggcgugagcuaccgcacccggcccacaccuggcuaauuuuugaacaauuauuuguagaggcagugucucacuuuguagcccggucuggaccaugcucuuuuaauuauaacugcuuuugaagucagagaaugugauaccuccaacuuuuuuuuuuuuuuugagauggaguuucgcucuugcugcccaggcuggagugcaauagcacgaucucggcucacugcaaccugugccuccuggguucaagcaauucaccugccucagccucccaaguagcugggauuacaggcacccgccaccaugccuggcuaauuuuuuguauuuuuaguagaggugggguuucaccauguuggccaggcuggucucgaacucccgaccucaggugauccaccugccuuggccucccaaagugcuagaauuauagguguaagccaccaugcccagcugacccugucuuaaaaauaaacaaaaacaagaaaacuuggcucucauuauucugaacacauuaauuuauguguacaauaucccuauguauaagcagccgcucugcccugccggccaccuccuaggaccugucugucuacugagcuccucuuacguccuagguccugacugcacccuuggccugggcucuccagcuguacugacccuggcuacuccauggcuccauccuuuuuugagcacugucuuaacuuucaggaaaaacaggaaguucuggggucaucuuucacuuucucuuccauagccuuggaaugagcuauuuuuccagagagcccuggcuccuuuucauggagagagauugaaaccagaguuucaguacugugcacgcuuguugccucugguguguuauuguuucuagauccccucagugcacagagcuagcauauauugcauauuuaaacccaaacauacauauguauauguguauguaugcauauagaucuguacuucuguagauaccuuuucuaucugucucauuaaaaccaggcacggugcuucaugccuguaauccuagcacuguggcaggccgaggcaggcggaucacuugaggucaggaguuugagaccaacuuacuuggccaacauaacaaaaccucaucucuacuaaaaaaguccaaaaauuagccaggugugguggcgagugccuguaaucccagcuacuugggaggcugaggcaggagaaucaccugaacucgggagguggagguugcagugagcugagauugcgccacugcacuccagccuggaugacagagugagacucugucucaaaaaaauaaaaagaaaaaagagagaaagagagagagacagagagccaugaguuuccgacucauccgauucuggcuuaacaccccaggggucacucucguuagccuucuucacuuucauauuuguaaguugguucucuggugggaagaaaccugccuaugauuauuuacaauauauuugcauauuugcucagucuucucugaacuauacaggccacucccucugcugcuggcuaccccacaucccugcccuuacuggccccaaccuugaaaggagccucgcuggcugaauucgcagcucccaucauaguggccacucugacgguugaguggccuugcugcaaucacacugacccaggccaucucccuucugacccugucacacacaguccuggucacuggccugcugacugugcagacccugcccucauugaacugcucagcucccugucccuggccagaggagauaugucaugauuaggagugugaacgcaggagccggccccucuggguuuaaaccagcuugcuguuuacugacuggcugaccuuguucaaguugaucucuuucccaauuuccucaucuguaaaaaugaggauacuacuaccugccacaggguuaugaaaauuagaggcucuuggcugggcaugguggcucacgccuguaaucccagcacuuugggaggcugagguggguggaucaccugagguugggaguucaagaccagccugaccaacauggagaaaccccgucucuacuaaaaauacaaaauaagccgggcaugguggcacaugccuguaaucccagcuacuugagaggcugaggcaggagaaucgcuugaaccuggcaggcggagguugcugugagccaagaucgcaccauugcaguccagccugggcaacaagagugaaacucugucuaaaaaaaaaaaaaaagaaagaaaauuagaggcuauaugugaagggccucuuagaacagagucauugcuguauugcuauaagacacacauggcuauucauugcccuuucauugggauagaagcccugugaggguggggauguuugucuguuuuguuuacagauaugucccaaaucacuggaacaagcccagcaguuagcagauuuguguguucgcugaaugaauggccauguuaggacauaauuggcauuagccauuuaugugaaagugagcaugucuuuguguuaaguugaaagcuuagauuuccaaaaaauggaauuagaguguuccuguagguaggauggucucagauuuccuaagguucuuugucagugauaacggcugaaacaaaacccucaccaccuuuuaaguagccaggauugaucacucaccuuacucaucugauuacucaucuuuaucuuuuuaggaccaccuuucacucaccugaggacuccacagaagaugguauauuaugggaaaccuucuuguaaaaacaacuaugagaauuauauugacauagugaaauauguguucagcgcuuacaagagagaguccccucucaucgucaacacuaugggauggguuucagguaagccugcaugugcacaucugcaagggaaggacaggcagugugaguacuguugguuucagacauucacguuaaagcccaguguuuuguuuuuuguuuuuaauugaggcagggucucacucugucgcccaggcuggagugcaauggcgugaucucggcucacugcauccucugccucccaggcucaaacaauccucccaccucagcuuccagaguagcugggaccacaggcgugugccacucugcccagcuaauuuuuguaguuuuaguaaagaugggguuuugccauguuggccaugcugaucuugaacuucuggccucaagugauccgcccaccuuggccugucaaggcaugcugggauuacaaacaugagccacugugcccagccgaaguccaacguauugaugguuucuuugucuuagaacaaaugcauccauuugucguaggagcaugucacuguucuugagcgcgucacuguucuugaguguaucagcugugcuaaugucucuuccccacagaccaggggcuccugcuucucauugaucugauccgauugcugucucccagccacgugguucaguuccgcucugaccacaguaaauauaugccagaccuuaccccgcaguauguagaugacauggauggcuuguacacaaaaagcaagaccaagaugagaaaucgacguuucagacucgcagcauuugcagaugcuuuggaauuugcugaugaagaaaaagagaguccaguugaguucacuggacauaaacugauagguguuuauacagacuuugcauucagaauaacuccaagaaauagguaacuaacccucauuuggcugaagaauuauuuuuccuuccgucgaaaaagaccugccauucucaauuccucuaaaggccugaguccucuaagaucuucaggucccugucacagcugugcaugcacaaagacgaaccaguuguuuucugaacuguuauguucccaguggaaauauccagaaguguccccuaccucuggcugccagcaacuuugacuuaaaggagagucuuuacacuuccuguuuuuccaguugggguccgucaagggggggcaguguuggaaagcccaguacucugugaaaaugugaccucugugaugacaggugugggagguggccguugaggguuaaaugucuacuuaccuuguugugauuugccuuucagagagucacauaacaaaauucuucgagaucuguccaucuugaguuaccuuagccagcugcagcccccgaugcccaaaccacuuucuccuuuacauagccugacacccuaucagguaaucugaacuuacaggagaaauugucuucauuuuguuacacacuugugugguuuucugugugcugggcgcucuccuaaccacuacauaacuccucgcucauuuaauccucagaacaucccagugacacagcuugugucguuauucccacuuuacagauggggaaccugagguguagagaggcugagggacucagcacuaggggcugggcuggcaugcaggcccaggcaguucagcuccagugacugcucuuagccaugguucuguacugaggauaaguguggguccgugcuggguuugaaugucccaucuggucgcaggggcugcuccagcacuuccacuuuuccgcuguagagcaggggugcuacugggccucagagagugaacguguggauucagggagcguucacaguggaaccuggcacccagagaacacucuuaaaguacuucacauuagccgggcgugguggcucacaccuguaaucccagcacuuugggaggccaaggcgggcagaucacgaggucaggagaucgagaccauccuggcuaacacagugaaacccccucucuauuaaaaauacaaaaaauuagccaggcaugguggcacgugccuauagucccagcuacucaggaggcugaggcaggagaaucgcuugaacccaggaggcggagguugcagugaucugagaucaugacacugcacuccagccugggugacagagcgagaugccgacuuaaaagaaaaaaaaaagaaguacuucacauuacugucaucaaaaguagauuccaccaccagaguauuugcaacuuggaauccaggcugcuaauaauuguuuugggaggaaagcaugauaguguuaggauucgggaugaugaaaaaacaaaacuagcggcagguagcacuucugaaaugcuuacucugugcaguacucuguucuaagccuguguaacuccacuacuuaccgugguccuguuauuauccccauuuuacagaugguaaaagcaaggccagggacugggagucagcuugcccaaaaugguguagucaaaguugaggcuaggacugaagccgcaggacgcccgacucugagcccaggucugugcucugccgcacagcauguccgguuuugagcgcuugcucugugccaggcacucugcgaagcauggaggggcucagugacuucauggccacccugugagagaaaggcuaagacgugcuucauuuacagcuuugagcauugggcauugucagguggaagcauuugccuuaggucacauaggcugaagcggcagaccugggcagcaaggauauguuucuugggcccgaugguggugugggcuccaggccucugaguuaucuccccuggagagucuaagucacuuugcuaaugggguuuuaguuuaugggucauuuauucaucuggagaugcucuuuaagugaaugugagauuuaucugccaauacuuaaaucugucuuguauuacuucacauuuauuuauuuauuuaucuuuuugagauggaauuucacucuuguugcccaugccagagugcaaugccacgugcuuggcucacugcaaccuccgccucccggguucaagcgauucuccugcgucagccucccgaguagcugggauuacaggcacgugccaccacgcccagcuaaucuuuuguauuuuuaguagaaacgggguuucaccauguuagccaggcuggucucgaacuccugaccucagaugauccacccgccucagccucccaaagugcugggauuacaggcguguccucugcacccggcccacauuuauuuuuuaaauuuaaguguuuuuuguuucuuuuuuuuuggagacagagucucucucuuucaccuagguugaagugcaguggcacaauuuuggcucacuguaaucuccacuuuguggguucaagugauucucaauucuaguaccucagccucccaaguagcuaagacuaaaggcaugcgccaccacacuuggcuaaauuuuuguauuuuauuuauuuauuuauuuuuaauuuuuguuuuugagauggagucuuggucugucauucaagcuggagugcaguggcacgaucucaguucacugcaaccuccgccuccuggguucaagugagucuugugccucagccucccaaguagcugggacuacaggcacgcaccaccaucccuggcuaauuuuuguauuuuuaguagagacaggguuucgccauguuggccaggcuggucucaaauuccugaccucaagugaucaacccaccuuggccucccaauggguugagauuacaggcgugagccacugcgcccagccuaaagaauuuuuuauuuuauuuuuuauuuuuauuuuuuauuuauuaauuuuuuuuugagaccgagucuugcucuaucacccaggcuggagugcgguggcaggaucucugcucacugcaaccuccgccucccagguucaagcgauucuucugccuuagccucccgaguagcugggauuacaggcgccugccaccaugccuggcuaauuuuguguuuuuuguagagacaagguuucaccacguuggucaggcuggucuugaacuccugaccucgugauccacccgcgucggccucccaaagugcugggauuacaugcgugagccacugugccuggcuguuuuuauucuuuagagauacuuuugaguaggcacuuuggcagaccuaucuuuagauagcugguuaaucuaguuguagaaauuaaguggucuuucaaaguagccaugaauagagugagaugcaaauucauuuuccaggucccuuucaaugcagucgcacuccggauuacccacucugaugucgccccuacccauauacuauaugcuguaaacgccagcuggguuggucuuugcaagauccaggaugacgucagaggauacacgaaugggcccauccugcuugcccagacuccaaucugugacugcuugggcuuuggugagucugagaguaaaacauauccauaaaccuacugaaaaggauccacugcuucaacuguagaugacuggucuugaccuuguagcugugucuaagcuacagaggucagagaacccccacucaucuauauagcacgccuuaggggcuggaggccaggaaggaagcagcuauuucucugcuucgucugccagcuccuguaaauguaggcuucccaagggccugggcuuggcccuccucuucuugcucgacacuucuccccuaggcugucucagucacugcuggguucuaaauccauuuuaggcguugccuuuuugcaguguccuccaacacagcuguucgucugcguuccaaacccaucuugucagugugcaucuucacuugagugccugacuggcaugcagaccugggauccccaggacccuccugcccucacccucuccuccuugccccaggcucguacuugguccauuggaagauucacucugacauccaggucagacccuggccccuccuuggcauccccuagccuucauuugguacuuucagcccauuagauggucugguggcuucucucuucaaaauaugucagcuucuuccaccucuucucagcaugcuagucagccaccggcaucuacugaaaaguuucuuaacugaacucuccacuuccucucuuaaaauucaucccuacagccaggaaugaccugaacccaggcgcaauugugccacagccuggcacuucccgucacucagauccagggucuggaccagggcucaaagugcccagcgggauuggguccccacuuccuugaccugcccugguuuccugaggucaauaaauuuggaguuuuggaagggugcuggagcuaaguagucccaaauuagcaaaguccucaaaugcacauuucagauuuggacaacacuguauuucucaaaagcauuuucacagaccauaaaggaggaacagugauaucagguugucuucuguauauuccuuagugguggauuuucccccuggccuguacucaccaacaaucaaggacuuuuuuguuuuguuuuuuuuuccgagacggagucuugcucugucgcccaggcuggagugcaauggugugaucuccguucacugcaaccuccaccucccagguucaaacgauucuucugucucagccuccugaguagcugggauuacaggcaugugccaccacgcccagcuaauuuuguauuuuuaguacagaugggguuucaccacguuggucagccuggucuugaacuccugaccucgugaucugcccaccucggccucccagagugcugagauuacaggcauuagccacugugcccaggcuguuuuuuuuuuguuuuguuuuguuuuguuuuugagacaaagucucucucuauuugggcucacugcaaccucugccucccgaguucaagugauucuugugucucagacucccgaguagcugggauuacaggugcgcgccaccaugcccagcugauuuuugugauuuuaguagagaugggguuucaccauguuggccaggcuggucgcaaacuccugaccucauucgauguacccgccucagccuccacagugcugggauuacaggcauagccaccgcagcuggcccaaucuaggacuuuugcauguagaccauuuuuguuccucguggcugaacacagggaagguacgaacugccccaguguucaaggacuccaucucuugacucuuuguauuuuuuuuuuuuuuuugagacagucucacucugucacccaggcuggaguacaguggcgccaucucggcucacugcaagcuccaccucccggguucaagcuauucuccugucucggccucccgaguagcugggacuacaggcgcccaccacuacgcccggcuaauuuuuuguauuguuaguagagacaggguuucacuguguugcccaagcuggucucgaacuccugaucucagguaguccacccgccucggccucccagagugcugggauuacaggcgugagccacugcaccuggccagcucuuuguauuuucaaaacaaaacagaguugauauaaagacuuauguucaaaaccauucugcaguuucuaacgauggagaaguuugauguuuuccaaaagggugauuuuuguguugugcgcgugucuugaaggcaucuguagaggcauugacauggagaagcggcuguaccacauccucaccccugugcccccggaagagcuaaggaccgugaauugucugcucguuggagcuauugccauuccacauuguguccuuaagugccaggugagccuucccccgggcacagcccuggaaggagccuacucagguccacagaagugaggagcugaaguagggucaggggucaugggaaugggugaucugggaaaccuauacuuuguuguagauccugagugagccgagacggugucagggccgccuccaaggccugagacuaugaaucacugucccucguggugucagugucgcgaucugggcucacugcaacccgugguggagccuuuacauaggaguagguuguguuggagcaagcagaggcccucccagguuugcccuccugaggacagucuucagaggcaucacgggaccaggucaaggcgucugugugccccagagccagccacagggacugcgagugggcucugggaacgggggauauuccuaccauucucauccuccagugucccucauuugaaagggacgcacacugcacccccacucugccucacgcuguuugcuguguugauggaaugggacagaagggaggccuuggcacguuuguuaccgagccaguugauuaaagggggcucugaaggaagggaucaaaugccuuaaaagugagaaguccccacccagaccaucaccaugacacugccuucuaggugugagagagcacuguaaaccccucugggcuggaccuggaguguuuccaugcauucucuguguuuccguuucagcgugggaucgaagggacaguaccuuaugucacaacggauuacaauuuuaaacuuccuggagcaucagagaaaauuggagcaagagaaccugaggaggcacauaaagagaaaccauaccgaagaccuaaguucugucgaaaaaugaagugaugcucgcguuuuuaauaagggaagaaacuuuccuaccagaaagcuuugucucaagccugaccacaagagacaugauggaguuucauggccaugaauggugcccuuauuagcaacaguguuuuuuguguaauucgugaaugucauauaguagucuuaaguuucucuuuuaaagcugcaugagcuagaauuuguucuagucuucugugugauacucauacuugcuguccagagggaguaaaacagcagagaacaguuugugugccauuaaaacagagauuccucagaaaguucuucagggaccugguuauuagaaucaggauaaaaauaaggaaacuggggccauuacaauguaccgagaaggaaggaagaaggccgaccugcaggaucucaagcauaauggauacaagggcucgccacgggccuugccugagccaugugcagagcugggguccagcggucugcuuccuuggagccaguguggaugguuacagcccauccauuuggugcaguuguacuuggucuguuauauucaaucaagguuuaauagauagggcugggcaugguggcucaugcacaccuguaauccuagcacuuugggaggcugaggcgggaggauugcuugagccucggaguuccaggcuggaguacaccaacuacuccagccugagcgacagaguaagaccuuaucuuuuaaaaaagaaaagaaaaauuuaaacggguuugauagauauaaauuuggacccaagagcccuuccuuuuuuuuaauccugagguuuuaugcugaggaaauuucuuucaaaucuggaaaaccucggggccaggcgcaguggcucacgccuguaauuccagcacuuugggaggccaaggcaggcgguucacgaggucaggagauugagaccauccuggcuaacacagugaaacuccgucucuacuaaaaauacaaaaaacuagcugggcgugguggugggcgccuauagucccagcuacucaggaggcugaggcaggagaauggcaugaacccaggaggcggagcuugcagugagccgaggucacgccacugcacuccagccugggcaacaagagcaagacuccaucucaaaaaaaaaaaauaauaaucuggaaaaccucuucugggggcucuuauaaaaguagauuuguccaaauugacuucugaucugaggccagagacaaccacagggcagagcuggagacugggcuguuuugaaggaagaaggacuggcagaccagcucuugggaaagcuccauuauugccugugggaggcuggaccugaacuugcaccuaugaacaacccugccauuuagagcuuuuuccugggggugccggcggcuggugaccagacugccauucuccacguucucccuggugcuuccgacucuguccucuagguuggaagugguuuguguaaacgggugaugggaccaggucacaucauuucugcauuuaagacagcaggauacuuccuggggcugagguucaaacugguauugugaccaccgcuuugacagaauuccaucuucccagcaugaucacauuguaagacuauuaggauguguggguuuuaacacuuauauacacuuauacaacuguugguuaucauugucuuuaguauuuuacaguggccccucagcaccucuuagacccaacagcaaaggacuuaaaauaagcacaggaaaccuugcuauggugauuaguuuugauaccuuugagacaauugagucuagcuucuuaguugccccuuauuuauguugaaaucuggcucauucauaugauguuuuacugugcuggccuuguaaagaauuuuaagacaauccaucaccaucaauguuuugccuuucuccacuuucguguaucuuacaguuauacucacuggaggucauuugcagcaaggcucuggaagaaugaaacuggugcccuguaauugcauuugcauucaaucuagguuugccuucaggcuuuaaaugcggccuguaugaaggucaagucuuuuucuucagucccuaucaguaaagaaaaaucguugccucuagagggagcuaucagcugugggucagguggccguacuggggcuagaguuggcccaggaagcuguacaggguuuagggaaggagguucggagacagggagccaaggccucugucaggucuagcuugugccggucagaccugcagcagcaccauucuccaggaugacaauucaucccauuauugauggcaguggccuuuuuauccuuuuuuuuuuuuuuuuuuuuuuuugagauggaguuucgcucuuguugcccaggcuggagugcaguggcgcaaucugggcucacugccaccuccgccucccggguucaagugauucucuugccucaaccucccgaguagcugggauuacaggcaugcgccaccaugccuggcugauuuucuauuuuuaguagagaagggguuucaccauguuggccaggcugguuuugaacuccuguccucaggugauccaccugccuuggccucccaaaguguugggauuacaggcaugagccaccgcacccggcugguggcaguggcuuuaagggcauuuagaagaaggacaagauuggacuuuuuaucauuuccacagucuguuaugggucagauuagguaguaaggaguucuccauuggagcuauucuuuuuuuuuuuucuuuuuuuuugagacagagucucgcucugucacccaggcuggggugcaguggcacgaccuuggcucacuacagccucuccccucccggguucaagugauucuucugccccagccucccaaguagcugggauuacaggugagcgccaccaugccuggcuaauuuuuauauuuuuaguagagauaggguuucaccguauuggcuaggcuggucucgaucuccugaccuugugauccgcuugccucggccucccaaagugcugaagcaauuucuuuuuuuuuuuuuuuuuugagacagagucuagcucugucgcccaggcuggggugcaguggagugaucucggcucacugcaacuuccgccucccagguuuaagcgauucuccugccucagccuccugaguagcugggauuacaggcguaugccaccacgcccagcuaauuuuuguauuuuuaguagagacaggguuucaccauguuggucaggcuggucucgaacuccugaccucgugauccgcccgccuuggccuccgaaagugcugggauuacaggcgugagccacugcgccuggccugaagcuauucuuuacaaaagcucuuaguuuuuguuuguuuguuuguuuuuuucuuuugcgacggacucucugucgccaaggcuggagugcaguggccugaucucaggucacugcaaccucugccuccuggguucaagcgauucuccugcuucagccucccaaguagcugggauuacaggcgccugccaccacacccagcuaauuuuuguauuuuuaguagagauggcguuucacuuuauuggucaggcuggucucgaacuuccaaccucaggggauccgccugccuuggccucccaagguguugggauuacaggcauaagacacugugccugggccucuuaguaauuuuuguauguaauuuucaaaguauccgggauuacaggcgcccgccacuacacuagcuaauuuuuuuuguauuuuuaguagagaugggguuuuacuauguuggcuaggcuggucucgagcuccugaccucgugauccguccaccuuggccucccaaagugcugggauuacaggcgugagccaccgcgcccggccuaggucauuuguuuuuggguuuggauggcaagaucauggauaagacagcaggcuuugauuauagagcucugaguucaaauccuggcucuaccacuugucagugguguaacuuggaggaagaugcuuagccugagccuguuuuauguuuugaagauuggguaauuguccuuccuucaguguuccugggugaggaguaagugaagucaugucuauaagagauguagcacagucuccggcauguagaaacggucaguaacuccuaguguguagcuagccucugaugagaugguaaacucaggaggcuggcaccacggcugugcuacucacggucaugcuggagggaugcagaaacuaaaugaauccacagcuacuuacucaucuugccucuggcagguucaccuuaaaauuguugcuaccaagcuuccuguggucaaagagcccuugaggaagcaagcuccacggccaccauagauaacccauuccugaaaguuuuucauaaacccccacuuguugcuuuuaaaauuuuauaagcagcuuacacauguagaaaaugauccuccagcccaccaccacauaguaaucacugacacugugaggugucucagcugggguucugcuguguguguguguauuuuacaaaauauguaugguuucuguucagcucuuuucaguuaacagaugaacuuuuguaucauuaaauauuuuugaaaacaugaa

SEQ ID NO: 191437 - RNA, 33252 nt, Homo sapiens
uucauguuuucaaaaauauuuaaugauacaaaaguucaucuguuaacugaaaagagcugaacagaaaccauacauauuuuguaaaauacacacacacacagcagaaccccagcugagacaccucacagugucagugauuacuaugugguggugggcuggaggaucauuuucuacauguguaagcugcuuauaaaauuuuaaaagcaacaaguggggguuuaugaaaaacuuucaggaauggguuaucuaugguggccguggagcuugcuuccucaagggcucuuugaccacaggaagcuugguagcaacaauuuuaaggugaaccugccagaggcaagaugaguaaguagcuguggauucauuuaguuucugcaucccuccagcaugaccgugaguagcacagccguggugccagccuccugaguuuaccaucucaucagaggcuagcuacacacuaggaguuacugaccguuucuacaugccggagacugugcuacaucucuuauagacaugacuucacuuacuccucacccaggaacacugaaggaaggacaauuacccaaucuucaaaacauaaaacaggcucaggcuaagcaucuuccuccaaguuacaccacugacaagugguagagccaggauuugaacucagagcucuauaaucaaagccugcugucuuauccaugaucuugccauccaaacccaaaaacaaaugaccuaggccgggcgcgguggcucacgccuguaaucccagcacuuugggaggccaagguggacggaucacgaggucaggagcucgagaccagccuagccaacauaguaaaaccccaucucuacuaaaaauacaaaaaaaauuagcuaguguaguggcgggcgccuguaaucccggauacuuugaaaauuacauacaaaaauuacuaagaggcccaggcacagugucuuaugccuguaaucccaacaccuugggaggccaaggcaggcggauccccugagguuggaaguucgagaccagccugaccaauaaagugaaacgccaucucuacuaaaaauacaaaaauuagcugggugugguggcaggcgccuguaaucccagcuacuugggaggcugaagcaggagaaucgcuugaacccaggaggcagagguugcagugaccugagaucaggccacugcacuccagccuuggcgacagagaguccgucgcaaaagaaaaaaacaaacaaacaaacaaaaacuaagagcuuuuguaaagaauagcuucaggccaggcgcaguggcucacgccuguaaucccagcacuuucggaggccaaggcgggcggaucacgaggucaggaguucgagaccagccugaccaacauggugaaacccugucucuacuaaaaauacaaaaauuagcugggcgugguggcauacgccuguaaucccagcuacucaggaggcugaggcaggagaaucgcuuaaaccugggaggcggaaguugcagugagccgagaucacuccacugcaccccagccugggcgacagagcuagacucugucucaaaaaaaaaaaaaaaaaagaaauugcuucagcacuuugggaggccgaggcaagcggaucacaaggucaggagaucgagaccagccuagccaauacggugaaacccuaucucuacuaaaaauauaaaaauuagccaggcaugguggcgcucaccuguaaucccagcuacuugggaggcuggggcagaagaaucacuugaacccgggaggggagaggcuguagugagccaaggucgugccacugcaccccagccugggugacagagcgagacucugucucaaaaaaaaagaaaaaaaaaaaagaauagcuccaauggagaacuccuuacuaccuaaucugacccauaacagacuguggaaaugauaaaaaguccaaucuuguccuucuucuaaaugcccuuaaagccacugccaccagccgggugcgguggcucaugccuguaaucccaacacuuugggaggccaaggcagguggaucaccugaggacaggaguucaaaaccagccuggccaacauggugaaaccccuucucuacuaaaaauagaaaaucagccaggcaugguggcgcaugccuguaaucccagcuacucgggagguugaggcaagagaaucacuugaacccgggaggcggagguggcagugagcccagauugcgccacugcacuccagccugggcaacaagagcgaaacuccaucucaaaaaaaaaaaaaaaaaaaaaaaaggauaaaaaggccacugccaucaauaaugggaugaauugucauccuggagaauggugcugcugcaggucugaccggcacaagcuagaccugacagaggccuuggcucccugucuccgaaccuccuucccuaaacccuguacagcuuccugggccaacucuagccccaguacggccaccugacccacagcugauagcucccucuagaggcaacgauuuuucuuuacugauagggacugaagaaaaagacuugaccuucauacaggccgcauuuaaagccugaaggcaaaccuagauugaaugcaaaugcaauuacagggcaccaguuucauucuuccagagccuugcugcaaaugaccuccagugaguauaacuguaagauacacgaaaguggagaaaggcaaaacauugauggugauggauugucuuaaaauucuuuacaaggccagcacaguaaaacaucauaugaaugagccagauuucaacauaaauaaggggcaacuaagaagcuagacucaauugucucaaagguaucaaaacuaaucaccauagcaagguuuccugugcuuauuuuaaguccuuugcuguugggucuaagaggugcugaggggccacuguaaaauacuaaagacaaugauaaccaacaguuguauaaguguauauaaguguuaaaacccacacauccuaauagucuuacaaugugaucaugcugggaagauggaauucugucaaagcgguggucacaauaccaguuugaaccucagccccaggaaguauccugcugucuuaaaugcagaaaugaugugaccuggucccaucacccguuuacacaaaccacuuccaaccuagaggacagagucggaagcaccagggagaacguggagaauggcagucuggucaccagccgccggcacccccaggaaaaagcucuaaauggcaggguuguucauaggugcaaguucagguccagccucccacaggcaauaauggagcuuucccaagagcuggucugccaguccuucuuccuucaaaacagcccagucuccagcucugcccugugguugucucuggccucagaucagaagucaauuuggacaaaucuacuuuuauaagagcccccagaagagguuuuccagauuauuauuuuuuuuuuuugagauggagucuugcucuuguugcccaggcuggagugcaguggcgugaccucggcucacugcaagcuccgccuccuggguucaugccauucuccugccucagccuccugaguagcugggacuauaggcgcccaccaccacgcccagcuaguuuuuuguauuuuuaguagagacggaguuucacuguguuagccaggauggucucaaucuccugaccucgugaaccgccugccuuggccucccaaagugcuggaauuacaggcgugagccacugcgccuggccccgagguuuuccagauuugaaagaaauuuccucagcauaaaaccucaggauuaaaaaaaaggaagggcucuuggguccaaauuuauaucuaucaaacccguuuaaauuuuucuuuucuuuuuuaaaagauaaggucuuacucugucgcucaggcuggaguaguugguguacuccagccuggaacuccgaggcucaagcaauccucccgccucagccucccaaagugcuaggauuacaggugugcaugagccaccaugcccagcccuaucuauuaaaccuugauugaauauaacagaccaaguacaacugcaccaaauggaugggcuguaaccauccacacuggcuccaaggaagcagaccgcuggaccccagcucugcacauggcucaggcaaggcccguggcgagcccuuguauccauuaugcuugagauccugcaggucggccuucuuccuuccuucucgguacauuguaauggccccaguuuccuuauuuuuauccugauucuaauaaccaggucccugaagaacuuucugaggaaucucuguuuuaauggcacacaaacuguucucugcuguuuuacucccucuggacagcaaguaugaguaucacacagaagacuagaacaaauucuagcucaugcagcuuuaaaagagaaacuuaagacuacuauaugacauucacgaauuacacaaaaaacacuguugcuaauaagggcaccauucauggccaugaaacuccaucaugucucuuguggucaggcuugagacaaagcuuucugguaggaaaguuucuucccuuauuaaaaacgcgagcaucacuucauuuuucgacagaacuuaggucuucgguaugguuucucuuuaugugccuccucagguucucuugcuccaauuuucucugaugcuccaggaaguuuaaaauuguaauccguugugacauaagguacugucccuucgaucccacgcugaaacggaaacacagagaaugcauggaaacacuccagguccagcccagagggguuuacagugcucucucacaccuagaaggcagugucauggugauggucuggguggggacuucucacuuuuaaggcauuugaucccuuccuucagagcccccuuuaaucaacuggcucgguaacaaacgugccaaggccucccuucugucccauuccaucaacacagcaaacagcgugaggcagagugggggugcagugugcgucccuuucaaaugagggacacuggaggaugagaaugguaggaauaucccccguucccagagcccacucgcagucccuguggcuggcucuggggcacacagacgccuugaccuggucccgugaugccucugaagacuguccucaggagggcaaaccugggagggccucugcuugcuccaacacaaccuacuccuauguaaaggcuccaccacggguugcagugagcccagaucgcgacacugacaccacgagggacagugauucauagucucaggccuuggaggcggcccugacaccgucucggcucacucaggaucuacaacaaaguauagguuucccagaucacccauucccaugaccccugacccuacuucagcuccucacuucuguggaccugaguaggcuccuuccagggcugugcccgggggaaggcucaccuggcacuuaaggacacaauguggaauggcaauagcuccaacgagcagacaauucacgguccuuagcucuuccgggggcacaggggugaggaugugguacagccgcuucuccaugucaaugccucuacagaugccuucaagacacgcgcacaacacaaaaaucacccuuuuggaaaacaucaaacuucuccaucguuagaaacugcagaaugguuuugaacauaagucuuuauaucaacucuguuuuguuuugaaaauacaaagagcuggccaggugcaguggcucacgccuguaaucccagcacucugggaggccgaggcggguggacuaccugagaucaggaguucgagaccagcuugggcaacacagugaaacccugucucuacuaacaauacaaaaaauuagccgggcguaguggugggcgccuguagucccagcuacucgggaggccgagacaggagaauagcuugaacccgggagguggagcuugcagugagccgagauggcgccacuguacuccagccugggugacagagugagacugucucaaaaaaaaaaaaaaaauacaaagagucaagagauggaguccuugaacacuggggcaguucguaccuucccuguguucagccacgaggaacaaaaauggucuacaugcaaaaguccuagauugggccagcugcgguggcuaugccuguaaucccagcacuguggaggcugaggcggguacaucgaaugaggucaggaguuugcgaccagccuggccaacauggugaaaccccaucucuacuaaaaucacaaaaaucagcugggcaugguggcgcgcaccuguaaucccagcuacucgggagucugagacacaagaaucacuugaacucgggaggcagagguugcagugagcccaaauagagagagacuuugucucaaaaacaaaacaaaacaaaacaaaaaaaaaacagccugggcacaguggcuaaugccuguaaucucagcacucugggaggccgaggugggcagaucacgaggucaggaguucaagaccaggcugaccaacguggugaaaccccaucuguacuaaaaauacaaaauuagcugggcgugguggcacaugccuguaaucccagcuacucaggaggcugagacagaagaaucguuugaaccugggagguggagguugcagugaacggagaucacaccauugcacuccagccugggcgacagagcaagacuccgucucggaaaaaaaaacaaaacaaaaaaguccuugauuguuggugaguacaggccagggggaaaauccaccacuaaggaauauacagaagacaaccugauaucacuguuccuccuuuauggucugugaaaaugcuuuugagaaauacaguguuguccaaaucugaaaugugcauuugaggacuuugcuaauuugggacuacuuagcuccagcacccuuccaaaacuccaaauuuauugaccucaggaaaccagggcaggucaaggaaguggggacccaaucccgcugggcacuuugagcccugguccagacccuggaucugagugacgggaagugccaggcuguggcacaauugcgccuggguucaggucauuccuggcuguagggaugaauuuuaagagaggaaguggagaguucaguuaagaaacuuuucaguagaugccgguggcugacuagcaugcugagaagagguggaagaagcugacauauuuugaagagagaagccaccagaccaucuaaugggcugaaaguaccaaaugaaggcuaggggaugccaaggaggggccagggucugaccuggaugucagagugaaucuuccaauggaccaaguacgagccuggggcaaggaggagagggugagggcaggaggguccuggggaucccaggucugcaugccagucaggcacucaagugaagaugcacacugacaagauggguuuggaacgcagacgaacagcuguguuggaggacacugcaaaaaggcaacgccuaaaauggauuuagaacccagcagugacugagacagccuaggggagaagugucgagcaagaagaggagggccaagcccaggcccuugggaagccuacauuuacaggagcuggcagacgaagcagagaaauagcugcuuccuuccuggccuccagccccuaaggcgugcuauauagaugaguggggguucucugaccucuguagcuuagacacagcuacaaggucaagaccagucaucuacaguugaagcaguggauccuuuucaguagguuuauggauauguuuuacucucagacucaccaaagcccaagcagucacagauuggagucugggcaagcaggaugggcccauucguguauccucugacgucauccuggaucuugcaaagaccaacccagcuggcguuuacagcauauaguauauggguaggggcgacaucagaguggguaauccggagugcgacugcauugaaagggaccuggaaaaugaauuugcaucucacucuauucauggcuacuuugaaagaccacuuaauuucuacaacuagauuaaccagcuaucuaaagauaggucugccaaagugccuacucaaaaguaucucuaaagaauaaaaacagccaggcacaguggcucacgcauguaaucccagcacuuugggaggccgacgcggguggaucacgaggucaggaguucaagaccagccugaccaacguggugaaaccuugucucuacaaaaaacacaaaauuagccaggcaugguggcaggcgccuguaaucccagcuacucgggaggcuaaggcagaagaaucgcuugaaccugggaggcggagguugcagugagcagagauccugccaccgcacuccagccugggugauagagcaagacucggucucaaaaaaaaauuaauaaauaaaaaauaaaaauaaaaaauaaaauaaaaaauucuuuaggcugggcgcaguggcucacgccuguaaucucaacccauugggaggccaagguggguugaucacuugaggucaggaauuugagaccagccuggccaacauggcgaaacccugucucuacuaaaaauacaaaaauuagccagggaugguggugcgugccuguagucccagcuacuugggaggcugaggcacaagacucacuugaacccaggaggcggagguugcagugaacugagaucgugccacugcacuccagcuugaaugacagaccaagacuccaucucaaaaacaaaaauuaaaaauaaauaaauaaauaaaauacaaaaauuuagccaagugugguggcgcaugccuuuagucuuagcuacuugggaggcugagguacuagaauugagaaucacuugaacccacaaaguggagauuacagugagccaaaauugugccacugcacuucaaccuaggugaaagagagagacucugucuccaaaaaaaaagaaacaaaaaacacuuaaauuuaaaaaauaaaugugggccgggugcagaggacacgccuguaaucccagcacuuugggaggcugaggcggguggaucaucugaggucaggaguucgagaccagccuggcuaacauggugaaaccccguuucuacuaaaaauacaaaagauuagcugggcgugguggcacgugccuguaaucccagcuacucgggaggcugacgcaggagaaucgcuugaacccgggaggcggagguugcagugagccaagcacguggcauugcacucuggcaugggcaacaagagugaaauuccaucucaaaaagauaaauaaauaaauaaaugugaaguaauacaagacagauuuaaguauuggcagauaaaucucacauucacuuaaagagcaucuccagaugaauaaaugacccauaaacuaaaaccccauuagcaaagugacuuagacucuccaggggagauaacucagaggccuggagcccacaccaccaucgggcccaagaaacauauccuugcugcccaggucugccgcuucagccuaugugaccuaaggcaaaugcuuccaccugacaaugcccaaugcucaaagcuguaaaugaagcacgucuuagccuuucucucacaggguggccaugaagucacugagccccuccaugcuucgcagagugccuggcacagagcaagcgcucaaaaccggacaugcugugcggcagagcacagaccugggcucagagucgggcguccugcggcuucaguccuagccucaacuuugacuacaccauuuugggcaagcugacucccagucccuggccuugcuuuuaccaucuguaaaauggggauaauaacaggaccacgguaaguaguggaguuacacaggcuuagaacagaguacugcacagaguaagcauuucagaagugcuaccugccgcuaguuuuguuuuuucaucaucccgaauccuaacacuaucaugcuuuccucccaaaacaauuauuagcagccuggauuccaaguugcaaauacucuggugguggaaucuacuuuugaugacaguaaugugaaguacuucuuuuuuuuuucuuuuaagucggcaucucgcucugucacccaggcuggagugcagugucaugaucucagaucacugcaaccuccgccuccuggguucaagcgauucuccugccucagccuccugaguagcugggacuauaggcacgugccaccaugccuggcuaauuuuuuguauuuuuaauagagaggggguuucacuguguuagccaggauggucucgaucuccugaccucgugaucugcccgccuuggccucccaaagugcugggauuacaggugugagccaccacgcccggcuaaugugaaguacuuuaagaguguucucugggugccagguuccacugugaacgcucccugaauccacacguucacucucugaggcccaguagcaccccugcucuacagcggaaaaguggaagugcuggagcagccccugcgaccagaugggacauucaaacccagcacggacccacacuuauccucaguacagaaccauggcuaagagcagucacuggagcugaacugccugggccugcaugccagcccagccccuagugcugagucccucagccucucuacaccucagguuccccaucuguaaagugggaauaacgacacaagcugugucacugggauguucugaggauuaaaugagcgaggaguuauguagugguuaggagagcgcccagcacacagaaaaccacacaaguguguaacaaaaugaagacaauuucuccuguaaguucagauuaccugauagggugucaggcuauguaaaggagaaagugguuugggcaucgggggcugcagcuggcuaagguaacucaagauggacagaucucgaagaauuuuguuaugugacucucugaaaggcaaaucacaacaagguaaguagacauuuaacccucaacggccaccucccacaccugucaucacagaggucacauuuucacagaguacugggcuuuccaacacugcccccccuugacggaccccaacuggaaaaacaggaaguguaaagacucuccuuuaagucaaaguugcuggcagccagagguaggggacacuucuggauauuuccacugggaacauaacaguucagaaaacaacugguucgucuuugugcaugcacagcugugacagggaccugaagaucuuagaggacucaggccuuuagaggaauugagaauggcaggucuuuuucgacggaaggaaaaauaauucuucagccaaaugaggguuaguuaccuauuucuuggaguuauucugaaugcaaagucuguauaaacaccuaucaguuuauguccagugaacucaacuggacucucuuuuucuucaucagcaaauuccaaagcaucugcaaaugcugcgagucugaaacgucgauuucucaucuuggucuugcuuuuuguguacaagccauccaugucaucuacauacugcgggguaaggucuggcauauauuuacuguggucagagcggaacugaaccacguggcugggagacagcaaucggaucagaucaaugagaagcaggagccccuggucuguggggaagagacauuagcacagcugauacacucaagaacagugacgcgcucaagaacagugacaugcuccuacgacaaauggaugcauuuguucuaagacaaagaaaccaucaauacguuggacuucggcugggcacaguggcucauguuuguaaucccagcaugccuugacaggccaaggugggcggaucacuugaggccagaaguucaagaucagcauggccaacauggcaaaaccccaucuuuacuaaaacuacaaaaauuagcugggcagaguggcacacgccuguggucccagcuacucuggaagcugaggugggaggauuguuugagccugggaggcagaggaugcagugagccgagaucacgccauugcacuccagccugggcgacagagugagacccugccucaauuaaaaacaaaaaacaaaacacugggcuuuaacgugaaugucugaaaccaacaguacucacacugccuguccuucccuugcagaugugcacaugcaggcuuaccugaaacccaucccauaguguugacgaugagaggggacucucucuuguaagcgcugaacacauauuucacuaugucaauauaauucucauaguuguuuuuacaagaagguuucccauaauauaccaucuucuguggaguccucaggugagugaaaggugguccuaaaaagauaaagaugaguaaucagaugaguaaggugagugaucaauccuggcuacuuaaaagguggugaggguuuuguuucagccguuaucacugacaaagaaccuuaggaaaucugagaccauccuaccuacaggaacacucuaauuccauuuuuuggaaaucuaagcuuucaacuuaacacaaagacaugcucacuuucacauaaauggcuaaugccaauuauguccuaacauggccauucauucagcgaacacacaaaucugcuaacugcugggcuuguuccagugauuugggacauaucuguaaacaaaacagacaaacauccccacccucacagggcuucuaucccaaugaaagggcaaugaauagccaugugugucuuauagcaauacagcaaugacucuguucuaagaggcccuucacauauagccucuaauuuucuuucuuuuuuuuuuuuuuuagacagaguuucacucuuguugcccaggcuggacugcaauggugcgaucuuggcucacagcaaccuccgccugccagguucaagcgauucuccugccucagccucucaaguagcugggauuacaggcaugugccaccaugcccggcuuauuuuguauuuuuaguagagacgggguuucuccauguuggucaggcuggucuugaacucccaaccucaggugauccacccaccucagccucccaaagugcugggauuacaggcgugagccaccaugcccagccaagagccucuaauuuucauaacccuguggcagguaguaguauccucauuuuuacagaugaggaaauugggaaagagaucaacuugaacaaggucagccagucaguaaacagcaagcugguuuaaacccagaggggccggcuccugcguucacacuccuaaucaugacauaucuccucuggccagggacagggagcugagcaguucaaugagggcagggucugcacagucagcaggccagugaccaggacugugugugacagggucagaagggagauggccugggucagugugauugcagcaaggccacucaaccgucagaguggccacuaugaugggagcugcgaauucagccagcgaggcuccuuucaagguuggggccaguaagggcagggaugugggguagccagcagcagagggaguggccuguauaguucagagaagacugagcaaauaugcaaauauauuguaaauaaucauaggcagguuucuucccaccagagaaccaacuuacaaauaugaaagugaagaaggcuaacgagagugaccccugggguguuaagccagaaucggaugagucggaaacucauggcucucugucucucucucuuucucucuuuuuucuuuuuauuuuuuugagacagagucucacucugucauccaggcuggagugcaguggcgcaaucucagcucacugcaaccuccaccucccgaguucaggugauucuccugccucagccucccaaguagcugggauuacaggcacucgccaccacaccuggcuaauuuuuggacuuuuuuaguagagaugagguuuuguuauguuggccaaguaaguuggucucaaacuccugaccucaagugauccgccugccucggccugccacagugcuaggauuacaggcaugaagcaccgugccugguuuuaaugagacagauagaaaagguaucuacagaaguacagaucuauaugcauacauacacauauacauauguauguuuggguuuaaauaugcaauauaugcuagcucugugcacugaggggaucuagaaacaauaacacaccagaggcaacaagcgugcacaguacugaaacucugguuucaaucucucuccaugaaaaggagccagggcucucuggaaaaauagcucauuccaaggcuauggaagagaaagugaaagaugaccccagaacuuccuguuuuuccugaaaguuaagacagugcucaaaaaaggauggagccauggaguagccagggucaguacagcuggagagcccaggccaagggugcagucaggaccuaggacguaagaggagcucaguagacagacagguccuaggagguggccggcagggcagagcggcugcuuauacauagggauauuguacacauaaauuaauguguucagaauaaugagagccaaguuuucuuguuuuuguuuauuuuuaagacagggucagcugggcaugguggcuuacaccuauaauucuagcacuuugggaggccaaggcagguggaucaccugaggucgggaguucgagaccagccuggccaacauggugaaaccccaccucuacuaaaaauacaaaaaauuagccaggcaugguggcgggugccuguaaucccagcuacuugggaggcugaggcaggugaauugcuugaacccaggaggcacagguugcagugagccgagaucgugcuauugcacuccagccugggcagcaagagcgaaacuccaucucaaaaaaaaaaaaaaaguuggagguaucacauucucugacuucaaaagcaguuauaauuaaaagagcaugguccagaccgggcuacaaagugagacacugccucuacaaauaauuguucaaaaauuagccaggugugggccgggugcgguagcucacgccuguaauccuagcacuuuaggaggcugaggcggauggaucaccaggucaggagaucgagaccauccuggcuaaaguggugaaaccccaucucuacuaaaaaugcaaaaaauuagccgggcgugguggcaggcaccuguggucccagcuacucgggaggcugaggcaggagaauggcgugaacccaggaggcggagcuugcagugagccgagaucacgccacugcacuccugccugggugacagagcgagacuccgucucaaauaaaauaaaauaaaauaaaauaaaaaaauaaaaguuagacaggugugguggcuaauaauagcugucauccuaccuacucaaagugagguaggaggaucccuucagcccagaagcuugagguugcaguaagcuaugaucacaccacuguacuccagccucagugacagacugagauccugucucaaaggaaaaaauaaggccaggugcaguggcucacacuuguaaucucaggacugugggaggcuuaggugggaggaucacuugagcuccggaguuugagagcagcuugggcaacauagggagacccuguuucuacaaagucuaaaaaaaauggaguuaggcuugguggugcauaccuguuuucccagcuaccugcaaggcuagccugagcucagaagguggaggaugcagugagcugugauuacgccacuguacuccagccugugugacagagcaagacccggucucaauaaauaaauaaauauuuuuaaauuaauuuuuaaguaaaacagcauggcaggaucaggcaugguggcucugccaucuccgugcuuugggaagcuaaggcagaucaccugauuccaggaauccaaggcugcggugagcuaugauugugcuaauuaaugcacuccagccugggugacagagugagacacugucucucucaaaaaccaagcacgguaauggcauaaaaaaagacauaucacccaauggaacagcauagaaagccuggaaauaaacacugcauuuacagccaauugacuucugacaaaggugcuaauaacaaaacaagggggaaggacagucuucaauaaauaaggccgggaaaucugguuauccacggggagaagaaggauacuagauauccuuaucaaacaccauauacaaaaaucaacucaaaauggaauaaagacuuaaguauuaagaccugaaacuguaaaccuacuagaggaaaagcuucaugacacuggucuagguaacaauuuuuuggauaugaccccgaaaacaaagguuaacaacagacaaaugagauggcaucaaacuaaaaagcuucugcauaacaaaggaaaaaauuccaaagagacaacccucagaaugggagaaaacaucuguaaaucauccaucugauaaagaguuaauauccaaaauauguaaggaacacaagaaacucaacagcaagaaaacaaauaacccaacugaaaaauggguaaggcacuuguacugacuucaaaacuuaccgaaaagcuauaguaauuaaaacaauaugauacugggucaaggacagacauguacacugaugaaacagaaacggaaccaggaaauaagcccauacauauaagaucaaacaaucuucaagauagucuuuucaacaaauggugguggaaaaucucaauaucuauauucaaaagaaagaagcuggaccaauuccuuacacuauaugaaaauauuaauucaaaauggaucaaaaaccuaaacuuaagaguaaaaacugggcugggugcgguggcucacaccuguaaucccagcacuuuggagaggccgaggcagguggaucaugaggucaggagauugagaccauccuggcuaacacggugaaaccccgucugcacuccagccugggcgacaaagcaagacuccaucucaaaaaaaaaaaaaaaaaaaaaaaagaguaaaaacugaacaaacaaauucaggcugaaaaauuuaaaaauaaaaaaauuuaaaaaguuaaaaacuauaaagcucuuacaagaaaacauuagagacaaucaugaugacauuggauuuaguaaugauuucaaggauguaacaccaaaagcauaggcaacaagugaaaaaauagauacacugaacuucaucaaaauuaagaacugugcaucaaagguuauugucaagaaagcaaaaaaacaaccuacagaacaggagaaaacauuugcagauuguacaucucauaaaggauuaauauaaagaacuacuauuaauacgaagaacuacuaaacucaacaaaaaguaacaauccaauucaaaaacaugcaggcugggaccggaugccguggcucacgccuguaauccaggcacuuuaggaggccaagcagguggaucaccugaggucaggaguucgagaccagccuggccaacauggugaaaccccaucucuacuaaaaauacaaaaauuagcugggcaugguggcgggcaucuauaaucccagcuacucgggaggcugaggcaggagaaucacuugaacccaggaagcggagguugcagugaacugagaucacacuacuucacuccagccucggcacuccgucucaaaaaggaaaacaaacagacaaaaaacaaaaaaacaagcaggcugggugugguggcucaugccuguaaucccagcauuuugggaugcugaggcagguggaucgccugaggccaggaguucgagaccagccuggccaauguggugaaacccuaucucuacuaaaaauacaaaaauuagccaggcgugguguaguuccagcuacuugggaggcugaggcaggagaacugcuugaacccgggagguggaggcuguagugagcugagaucacgccacugcaccucagccugggcgaaagagcaagacucugucucagaaacaaacgaacaaaaaaaacacacaagcaauauucaaggacuggaacagacauuuuuccaaagaagauauacaaauggccaauaaguacaugcucaacaucauuagucauuuaagggaauguaaaugaaaaccaacaugagacauuacuucacacaaacucagacagcuauaaucaaaauaagcauuggugaggauacggagaaaucagaacucuugugcauugcugcugggaauguaaaaugcagcuacugugaaaaacaguuuggcaguucucaaaacauuaaacacagaacuaccauaagacccagcaauuccacuccucgguauacaccugaaagaacugaaagcaggauauggaggagauauuugaauacccauguucauagcaggauuauucacgaaagccaaaauguggaaagaagccaagugucccuuaacagcugaauggauaaacuaaaugugauauacacauacaauugaauaacauccagccaucaaaaagaauuauuauuauuauuauuuauugaggcagaaucucacuguuugucacccaggcuggaguguaauggugcaauuucagcucacugcagccucuaccucccagguucaagugauccuccugccucagacucccaaauaucugggacuauaggcauggaccaccaagcccagcuaacuuuuguauuuuuuuuaauagggacuggguuucaccaugcuacccuggucucaaacucccaggcucaagcaaucugccggccuuggccucccaaagugcugggauuacaggugugagccauggcaccuggccaggaauuaaauuuugauacaugcuacaacauggauggauuuugacaauacuaugcugagugaaauaagccagacaaaggauaaguauugugugacuccacuuacaugagaauagccaaauucauagggacaaaaaguagaacagaggugaagucucuaggggcuaggaaagaggacaagaggaggacaagagggaguuaagggaguuacucuuuuuuuugagacagaguuuugcucuugcugcccagacuggagugcaguggugagaucucggcucaccgcaaccucucccucccggguucaagcgauucuccugccucagccucccaaggagaguuauucuuuuuuuuuuuuuuuugagacagagucuugcucugucgcccaggcuggagugcaguggugagagcucagcucacugcaagcuccgccuccuggguucaugccauucuccugccucagccucccaaguagcugggacuacaggcgcccgccacuacgccuggcuaauuuuuuguauuuuuaguagagacgggguuucaccauguuagccaggauggucucgaucuccuaaccucgugauccacccgccuuggucucccaaagugcugggauuacaggcaugagccaccaagcccagccgagaguuauucuuuaaugaguacaguuuucauuuugggaugacaaaaaaccacacccgacuaauuuuuaaauuuuuuguagagacagggucucaccacguugcaaacacaacaaaaaaguuguggccaggcacaguggcucaugccuacaaucccagaacuugggagucagaggugaguagaugaccugaggucaggaguucgagaccagccuggccaacauggugaaacgcugucucuacuaaaaauacaaaaauuagcugggcaugguggcgugcgccugcagucacagcuacucaggaggcugauacaggagaauagcucgaacucaggaggcggggguuacagugagcacagaucacaccacugcacucuagccugccuaggugacagagcaagacuccaucuuaaaaaaaaaaaagcaagcaaggugguacuuacuccagcagcacauauacuaaaaaacuggaaugauacagagaagacuggcaaugggccccgcacaaggauaacauauuauuuuuuuuaagugauguagaacuguggauaacuggugaauuuucaauaaaaucuguagacugguuaacagcguuuuuuuuuuuuuuuuuuuuuuugagauagaaucucacucuguugcccagguuggagugcaguggaaugaucuuggcucacugcaaccuccaccccuggguucaugcgauucuccugccucggcgucccaaguagcugggacuauaggcacgugccaccaaacccagcuaauuuuuguuuuuuuggguuuugagauggagacuugcucugccgcccaggcuggagucaguggcuugaccucagcucauugcaacuuccgucucccggucaagcaauucuccugcuucagccucccgaggagcugggacuacaggcgugcaccaccaugcccagcuaauuuuuguauuuguaguagagaugggguuuccccauguuggccaggcuugucucgaacucccuaccucaggugaugcaccagccucagccuccccaagugcugggauuacaagugugagccaccacaggcagccugauuaacaguauugauucaguauuaauuucuuagucucgauaguuguacauaagauguugaaauuagggaaacauguguuucuaauuuacauaaaacaaaauaauuuuugccaccauacccaacuaauuucauaaaacaaaaugaguagcaguuccauuuccuaaaaugagaaagcaccauaguuuguuuuuuggagguuagaggaacaaguuauggaaagaccaugaguuugguaggcgcauguucccuuuuaauauuuuauacucuucgauuucugaguuuuuguuagcaucaucacauaugaauuucauaaaaccaagacauuugagaaauauguaauacauacccagaacugguucuguaauauuaagcaaagaaaugcaaccaggagggguaaauucugucugucccagaucacauuccaaauagucaacgcagggaagacugcaaauuuuuaaaaaagaaaaaagaaagaaaauccuaacuagcuuuacucaguagaaaggauaaucacacaguaaagauuucaugugacacgcaggcauaauccaccacacacagcacuuuagaagugaagccucaagaugacaaucgcuguuuaaaaacgaguccagagaaacgcagugcaggcauggucacaauguccauuuguaacacggauaacaacuugcucuuucagauuuuuuuuuuuuuuuuacgauggagucucacgcuguugcccaggcugggcugcagugcacaaucucggcucacugcaagcuccaccuccuggguucaugccauucuccugccucagccuccggaguagcugggacuacaggcacccaccaccaugcccggcuaauuuuuguauuuuuaguagagacaggguuucaccauguuagccaggauggucucgaucuccugaucucguucgugaucugcccaccucggucccccaaagugcugggauuauaggccugaggcacugagcccagcugaauuuuuuuuuugagauggaguccugcucugucgcccagguuggagugcaguggcgcgaucuuggcucacuauaaccuccgucucccgggcuugagcaauucuccugccucagccucccaaguagcugggauuacaggcaugugccaccacgcccggcuaauuuuuucuauuuuuaguagagacgggguuucacaguguuagccaggauggucucgaucuccugaccuugggauccgccugccucagccucccaaagugcugggauuacaggcaugagccaccgugcccagcuaauuuuuguauuuuuagcagagacaggguuucaccauguuggccaggcuggucuugaacuccugaacucaagugauccaccugccucggccucccaaagugcugggauuacaggcaugagcuaacacucagccauuuuucauauaaguuuauuuuuucuugagacagggugucaccgagucacccaggcuggagugcagugaucagaacucacugcagccucgaccuccugggcucaagcaauacucccuccuuagccucccaaguagcugggaccacaggcacaugccaccaugccugacuaauuucuaaauuuuuuguagagacagggucucauuacguugcccaggcugguccgaaacuccugggcucacgcaauccuccuaccucagcuucccaaagugcugggauuacaggcagaagccacggugcccagccuuuuuuucuuuuuuuuuuuugagacagagucuugcucugucgcccacgcuggagugcagcggcaccaucucggcucacugcaagcuccuccucccagguucacgccauucuccugccucagccucccgaauagcugggacuacaggugccugccaccacgcccagcuaauguuuuguauuuuuaguagagacgggguuuccccguguuagccaggauggucucgaucuccugaccucgugaucugcccgccucagcaucccaaaggcuugggauuacaggcgugagccacugcgcccaggcuuuauuuauuuauuuauuuauuuagagacacagugucacucuguugcccaggcuggagugcaauggugugacauagcucacuguagacucgaacuccuuggcucaagccagccucccacuuuugccucccaaagugcugcgacugcagauguaagccaccauaacccaccucuguuguuguuguaaagguaaaauuucagaucuggcaugguggcuuauaucuguaaucccagcacuuugugaggccaagguaggaggauugcuugagcccaggaguucaagaccagccugggcaacauggcaagauccucugucuacaaaagcaaaacaaacaaaaaaauuagccagaggccgggcaugguggcucacgccuguaauccuagcacuuugggaggcuaaggcgggcagauaaccugaggucaggauuucgagaucagccuaaccaacaugguggaaccuugucucuacuaaaaauacaaaaauuagccggguaugguggcgcacgccuguaaucccagcuacucgggaggcugagguaggagaaucacuugaaccugggaggcggagguugcagugagcagagaacaugccauugcacuccagccugggugagugaaacucugucucaaaaacaaacaacuagccaggugugguggugcgcuaguguggucccugcuacgugggaggcugaagugggaggacugcuugaacccaggacgucaaggcugcagcaagcccuguuugugccacuacacuuuuugcugggcaacacagucagacccggucucaaaaaaaaaaaaauuaagcgaaaauucccaggaguuugagaccagacugggcaacauagcaagaccucaucucuacaaaaauaaaaaaauuagccaggcaugguggcccauggcuguagucucagcugcucaggaggcugaggcaggaggaucacuugagcccaggaguucaagacuaugagguaugacugugccacugcacuccagccugagggaaacccugucugaaaacacacacacacacacgcacgcacacacgcaccccccccccgccccccaccccagaacuuauaaauacagacucugagaccaagugucuccucuuggaagucugccugcagguaaggcaaagucagccuacgcuagagcauugucacauacugcaaagcagacggcagugaggaccagaugcuucagcugggcagcuuuagaccuguauguaaucucuagcuagaagccaagaagcauucccuccaaaucaaaaaucccacuucaugacaaaaaccuagcaaugugucaaagccauaagaaaagcacucuuaccuauuuaacaaaugguuaaucagguaucuauuaaauguugacuuuccaacauccugggauccacaaacuagaaugacagggcagccaucuacuucuucugaaugggaaacaaacauugaucgcuagaauuagccgucuuccuuggacucgaauuaugacuaaucuuccucugggggucugguggacagacauucagggugaucaauguguauuacucaccacaggaaacauugacuaacucuuccagggcugaaaggguacucucaguuaacugaaggccuuuccuuuuuuucucucuucugaugccaacagaccucaaggcuaaauauucagguuuaaucuggggaguuggacucugaaaucaacaauuuaaacuuuaaggugaaaaaaugcauauuuuuuucuucaguacuaaauuaaucaagccucacacaguugugagccagagaagauaaauuguuuccucccuuugucuccugccccaaaauccaacccaucaacaaguguugccaacuguauuccugaaguuauccacgucuauuuucaguuucugcuuucucucgagccuucacugccuccgcaggagacuccagagaaaaagaaaaugccugguaagacaugacugcacaggaaacauucagcaggaggcccuggcucuagaccaggugagugauguagaaucaagucaaggcaaccucugaaaacauaaagcaaaaacacacggacagaacauaugcaaacagaguugaaaggagggagaagacaggucugugaaguccaggacugggaaagcaacccaaggaaaggaagagcaggcccuugcugaggcagguaaggcucaguuggaaccagcucaccacagaagaggaugaaggaagggccccguccucuugcaauucaucaacacugaaaauaaagauaccauaaagaaaugugaagcaggcugggcgcaguggugcacgccuguaaucccagcuacuugggaggcugaagcacaagaaucgcuugaacccaggagguggagguugcagugagucaagacuguggcacugcacuccaaccugggcgacagagggagacugugucugugucucaaaaaaaaaaaaaaaaaaaaaaaagagaagcagccuagugugaggcuuccuaucggcaaugcuggaucuuagaaaacaacagaacaaggccuucaacaauuugagaaaaaagucuguugaaccaaccauucuacacugugugcaauuaucaaucacugagggcaaaucaagaauaucuaacaaaauuagauaaucaaguuuacuaucucccuuaugugaaaaaacaacuccagaaucuacugacacauccagagggugggauagggagggaaguauccaagaaagagcauaagaaauaugaacagugguggugaagucccagaaaaacagauaaagcugaaaauaaaugaaaaaagaauguggcugccccauagcaucuggaacauucacuuucaguaaccaaggcuugagaacaggcaauuccaucuccuccucugcaguccugguccagcuacuggacucugcaaaagacuaaaaggcaaucacaacaguccguucgcugucccacucucauuucuucucuccuuucacuucaaauuccccacacccaccucguaucuaucugcuucccacacagugacgaccuugauuucauuucccagugcagcaggaaauaaucagaggacaacuucuacuuccucuggcccucuccaagggacuuccucuagccacuaugaaugaccuggcuaugcuccuaaggccacaugaugccagaaccggacccaucccugguagccaacuuacauaguuccagcagccucuccucucucugcugcaugguuaccucccccuuccucuggaucauucccaucugccauguuccagcauguuuuuuucauccaucuuaacaaaauuacaaaacucuccugaucauacuuaucccugcaacuagugcuucauuucuuuucuucccuuuacagcuaacuucuaccaaagcaaaauacuuuacuacuaagccugugagucccucuccgcccaggcucuugaccccauuccaaucaggcuacuucccggccucuacagccagcgcuuucucaggucucaccugaccaccagcagcuuucgccaccgcuguucaguuaacucucguuuaaagacuuccugaccuacaggacaucacacacuggguuuuccaccaaaaccgaugacuaucugcugcucccucaucuuugccuggaccucuucuuggagugccccagggcucagagcuggaaccaucuuguuucuaucuauucaacuccaucagcauuauuaucgcaucugguggccuggguauccucucugcugaaggcucccauauuuacaccuccaaacucuucccugaacuccaggcccacauauucaacugcccacuugacauguccagcugaugucuaccaggcaucucaagguuaacaaauggaaacccacuccuccugcagugaccccaucccaguuaauggcaacuacaugcaccccagucguuaagccaaaaaccugcugugauuccuugauucuuccucaccccucacauauccagucugucugccaauccuggagauuagacuccaccuacuggcccaugggagacaauuauaguaauaguacuuaaggaaauggaaaaaaaaaaaaaagaacuuaaggaaaugaauaauacggucagcaaaaauuuagaggugaggccagacacgguggcucacaccuguaaucucagcacuuuuggaggcagguggauugcuggaguccaagaguucgugaccagccugggcaacauggcaaaauccuaucucuacaaaaacuacaaaaauuagccgggagucauggcguguaccuguaaccccagcuacugagaggccccggugggagggucaccugagcccggaaagguugaggcugcagugagcugagcuccugccacugcacuacagccugggcaacagagacuuuaucucaaaaauaaaaauaaaagcucucuucuugggacguugucuacacgaagugagaaugguccagcauuugacacaccgucauaggcuuuccuacaauacaucaucauaggcuuccuacaauacaccgucauaggcuuccuacaauacaggcucuaacaaaacuaggcugucccgaaccccugguaauaaaauuguuugucucuguaccaagaagguugggaaaacaccaaaauuugcauuggcguggcccaggcaggcuucgagggguccgugccaugagacuuaaaguucuuuuuuuuuuuuuuuuuuuuuuuuugagacggauucucacucugucucccaggcuggagugugcaguggcgcaaucucagcucacugcaaccugcgccucccagguuccaucgauucucccgccucaccucuggaguaacugggauuacaggugcaugccccaugcccugcuaauuuuguguauauuuaguagagaugggguuuugccauguuggccaggcuggucuugaacuccuaaccugaagugaucugcccaccucagcuucccaaagugcugggauuacaggcgugagccaccacgccccgccaagaccuaaaguucuuaagagauuguccaaaacaaaaaccaugucagcagagccuacggugguuccaugcgugcuaaacguguucaggacaggaucaagcgugcuuuccuucucgaggaggagaacaucauuguaaaagugcugaaggcacaagcacagagucagaaagcuaaauaaaaaaugaagccuuuuugacuaauaaaaauuaagacucguuaaaaauuagagguaaggaaagagauaaaagaaaauauaaguucauuuaaacuacucauucauaguuuagagacaauuuauauuaucucaaauuaauaaacugaaauauaaagacaaccauuaaaaaccccaaaaaaggccaggcaugguggcucacaccuguaaucccagcacuuugggaggcagaggugggcagaucaccugaggucaggaguuugagaccaaccuggccaacauggugaaaccccgucuguacuaaaaacaaaaaaauuagcugggcaugguggcaugcaccugugguccuagcuacuugggaggcugaggcagaagaaucacuucaucccgggaggcagagggugcagugagccgagagaucacaccacugcacucuagccuggcaacagagagagaguccaucucaaaacaaagaacaaaaaaacaaaaauuagccgggcaugguggcaggcgccuguaaucccagcuacucgggaggcugaggcaggagaauugcuugacccugggaggcgggguugcagugagguugaggucgcaccacugcacuccagccugagugacagagugagacuccgucucaaaaaaacgaaccaaccaaccaaccaaccaaccaaaaaagcagggcuggagcaugguguuaauaaaaacccaaaaagcacuuaaccaacuacgauauaaaaugguggcucagguaugaaacuaaggaggggaggaugaacauuuuucacgauacaccuuucuauaauaguuuccguauacacguauuacauucuguaggacugagagcacuagauagaccaacuguucuuccaagacaacauccuacauagucauuugaaaucacuguuuuggugcaaguaauuagcaaaacucugaaugaaaacggguucuaccucuugcacaaaaauguaggaugaacccggauagcugguuaugaaguuuacaguggcaguuuucagauguucuagcaacacaauggaacacugaggagaaaaauucugcaucgaccaacgccugucaucuguaaagagaaaaauaaaccaccuuagaagcaguaacuucauuacauuccacgcccuuuaggacugccaucuccucggcuaaacuauaaacauuaggagaguaggaauuacgguugagagccuuuuucagggggccguacuacauacuaagaacacaucugggaggagaagucaaucgagguuugccacauaauaauucuguggccuugaacaauuuuucuugucaguaaaauggugauaacaauaguacuuucacucucaggacccucguaaggguuuauauagauaccacaacguccuuagcacacugccuagaccauaguaagcaucuaaaauaauuuuuuuuuuuugagauggggucucgcucuguugcccaggcuggagugcaguggcgugaucucggccuacugcaagcuccgccucccggguucaagcgauucuccugucucggccucccgaguagcugggacuacaggcgccugccaccacgcuuggcuaauuuuuugcauuuuuaguagagacaggguuucaccaucuuagccaggauggucucgaucuccugaccucaugauccgcccgccuuggccucccaaagugcugggauuauaggcgugagccaccgcgccuggcccuaaaaauuaugaauuagccuuauuacaguaggcccucaguaaauuacccaguucuuuucauuaccaagguuaagaugagauuugagcaaauuccgggcuucccuuuucaguuccuucuugcuuuucucaggcugugaguagugaagugcauggauacucaagcaagaguggguauacacagagaagaugucuugggcaggcuggccuuggcugaugguaaaaccaaauaccugcaccuggccauagaggcaagucacacgacagaucccacuaaaaguaaaacccuagcagggagagaaaacagaaaaaacauuauagaucaugucacuaaugacugaaacauucuaaaaucuuuuuuuuuuuuuuuuugagauggaguuuugcucuuguugcccaggcuggaguacaauggcacaaucucggcucaccgcaaccuccaccucccagguucaagcaauucuccugccucacccucccuaguagcugggauuacagguaagugucaccacgcccggcuaauuuuguacuuuuaauaaagacaggguuucuccauguuggucaggcuggucuugaacucccgaccucaggugauccauccaccucggccucccaaagugcugggauuacaggcgugcgccaccgcaccuggccaaauucuaaaaucuuaacuugcuauucacacaucaaaaggcagguaaggccaggcacaguggcucaugcuugugaucccaacacuuugggaagcugagacaggaggaucacuugagcccagaaguucaagaucagccuaggcaacagagugagacuucuccuuacaaaacauuuaaaaauuagcagggugcaguggcaugccucugugguccuagcuacuugggaggcugagguggguagacugcuugagucucggagguagaggcugcugugaaccguaauuacaccacuccacuccaucaguaauaaguauugggccaggcacgguggcucacgccaguaaucccagaacucugggagaaggagguggggggaucacuugagugaggccaggaguuugagaccagccuggauaacauggcaaaccccccugcaccccacccccgccaccaccaucucuacuaaaauuacaaaaauuagcugggcaugugccuguaaucccagcuacuccagaggcugaggcaugagaaucgcuugaauccagaggcaaaggcugcagugagcugagaucaugccaguacacugcagccugggcgacagugauacugucccaaaaauaaauaaauaaauaaaaauuaaauaaaauuaaaaaauuuaaaaggcugcagccauaaaaagggaugagaucauguccuuugcagggacuuggauggagcuggaagccguuaucuucagcaaacuaauucagguacagaaaaucaaauaucggccgggugugguggcucacgccuguaaucccagcacuuugggaggccgaggcggguggaucacaaggucaggagaucaagaccauccaggcuaacacggugaaaccccgucucuacuaaaaaaaauacaaaaaacuuagccaggugugguggcgggcaccuguagucccaacuacucgggaggcugaggcaggagaauggcgugaacccgggaggcggagcuugcagugagcccagauugcgccacugcacuccagccugggcaacagagcgagacuccaucucaaaaaaaaagaaagaaaaucaaaauaugguauguucucacuuaucagugggauuugaaccaugagaacacauggauacaugguggguaacaacauacacuggagccugugggggucuggggaagggcgucaggaagaauggaugcugggcuuaauacauaggugauguguugaucugugcagcaaaccaccaaggcacccauuuaacuacguaauaaaucugcacacccugcguauguacccuggaacuuaaaagugcugggauuacaggcgugagccaccacacccggccgauauuugauuuucuguaccugaauuaguuugcugaagauaacggcuuccagcuccauccaagucccugcaaaggacaugaucucaucccuuuuuauggcugcagccuuuuaaauuuuuuaauuuuauuuaauuuuuauuuauuuauuuauuuuugggacaguaucagcuuaccacaaccuccaccucccagguuaaagcaauucuccugccucugccuccagaguagcugggauuacaggcgugugccaccacaucucaaacuccugaccucaggugauccgcccaccuaggccuccaaaagugcugggauuacaggcgugagccacuagacaggguuucgccauauuggccaggcuggucucgaacucgcuaccucaggugauccacccaccucagccuccaaaagugcugggauuacaggcgugagccacugugcccagcucucucuuuuccuuuuccuuucuuucuuuuccccucccuccuuccuuucuuccuuucuuucgagacggagucucacucugucgcccaggcuggagugcaauggcgugaucuuggcucacugcaaccuccagcucccggguucaagcaagucuccugccuuagccuccugaguagcugggauuacaggcgugugcuaccaugcccagcuaauuuuuguauuuuuaguagagaugagguuucaccauguuggucaggcuggucucaaacuccugaccucagaugaucugccagcuucggcuucccaaagugccgggacuacaggccugagccaccgcgccuggcccauacuuuauauuuuuaaacuaagaucauaccccauggcagcuacagagaaagcauggugaccgugaacucggcucugugcuccugguucagacagacucuaccacucuguccuuuuaaagacccacagcuugccaagucucuuccagaacuuccuggguuuugccuucccuccugcauuagacagggaaucuccaggaauggcauccacguuaagaaucaggcugccugaguucgacuccuagcucucccucuacuguguaaguuacccaaccucagucuccucgucuguaaacacuuagagagagggacaacuacuccguaagagagcuggauguuuaaauggguucaaagccuaaaacacuuuuggaacccuuaaauccuggaauuucugagcucucaguaauugcaaccuuuuuuuuuuuuaacuauuaaaaucccuuucagaguuccaggugcggugguucacaccuguaaucccagcacuuugagaggccgaggcggguggaucacaaggucaggagaucgagacuauccuggcuaacauggcgaaaccccguuucuacuaaaaauacaaaaaauauagccgggcgagguggcacgcgccuguagucccaacuacuccggaggcugaggcaggggaaucgcuucaacccgggaugcggagguugcagugagccgagauugugccacugcacuccagccugggggacagagugagacucugucucaaaaagaaaaagaaagaaagaaaacaaaacaaaauaaagucccuuuagcucguaaggccuagggaccccuuagcaggguaccuguuacccugcugcucaggggagccuaguugccaccaaccaucaagaggauggacuugaauccgacuggcagccagagaacaggcccgggggaccacgguccucuccuacccugcagcucucccggggcugccucuccagcccucccugcccucggggacuacuaccggcgccccccaccuaccugcucgaccggcagcagcagcaacgcgcggccggggcccacgggccgcaccggugggaugaggagaggccgguggcaacucgaggcggauucgaguucggguucggacucggguucggaggccggggucgggcuagggaucgggcugggggucgcgguguugggucuccgggccgccgccgcgcgcgacaccuggcgggcucccucccuccaguccacgccggacgccugggcuugcaguaaccgccaccguaggcgccgccgaccgcaccagcgcaggcucccgagccggcggcggggccggcggcugaggaugagcuggggccgggccuugcggacccgcagccaaguggaacggcaggaaccccgcuuuagcagcagucccgaguccgccaugcuggguccucagggccuaccgcgcgagaaucucgcgagaucccgucgguccgccccgcugcccucccagcugccgaaaagaggggccuccgagcc

SEQ ID NO: 191438 - RNA, 45153 nt, Homo sapiens
aaacauuuagugaucuuuuuauuauauuaauauacucugggugaauuaacccuuaagcccuaaaacgacaacaaaaauauauuacuuagauauuuuguaauucugguacuugaaauaaagacaaauagaaaacuauguuaaaauauuaaaaaguugcaaaauuucauuaaaaacauuuacauuuguauccuaaugccaauuuauacauacaauucuuuuaaguuagauuuaauggaauaucuuaacauaugaaaauaauagaaauaaauauuaaauauucagaacauacucaugagugaaaauucaauuaauuaguauuccuaauuuagauauuuauuuaugaaugaccaagggauuuuacaguuccuuuuuaauuuuuuguacuugauucuuggucccuuaacaauguauaacccuguaaaacucucaauagccacuaaucacugguaggaucauuucaacaaaaacacaugauugggccgggcgcgguggcucaugccuguaauuccagcacuuugggaggccgagguggguggaucacaaggucaggaguuugagaccagccuggccaauauggugaaaccccgucucuacuaaaaauacaaaaaaauuagccaggcguggugacacacgccuguaaucccagcuacucgggaggcugaggcaggagaauugcucgaacccgggaggcggagguugcagggggccaagaucgcgccacugcacuccagccuaggcaacagagcaagacuccgucucaaaccccaccacccccgcaaaacaaaaacaaaaacaaaaaaacaacaaaaaaacccccuguaacuaacaaaagaggaaccuguuuuaaaugaacccguuugcuugucaaucacuaaaaaugaagucuuuuuauaaguauuuucuuuaaguuacaauauauagaaggcauguguauauguguguauauauauauauauauuucuuaaaaguguugauuggugagaaaagaauaauuccuugguuaacuuuucucauucuuguucuguuuaaagaaguguuuugucuguauuuuaaaaauggauuagaaaauaauggccaacaucucuuuaaaaccagaaaaaaucauuuuacagacaucuuggcaucuauacucuguuuugucuaauaaacuuuaaaguuauuucucuccuuauacuuuuuuuuuuuuucgagacggagucucgcucugucgccugggcuggagugcaauggcaugaugugggcucaaugcaaccuccaccucccggguucaagcaauuuuccugccucagccucucaaguagcugggacuacaggccaccacgccuggcucauuuuuguauuuuuaguagagaugggguuucaccauguuggccaggcuggucucgaacuccugaccucaggugguccgcccgccucggccucccaaagugcugggauuacagcgugagccaccgcgccuggccuccucucuccuuauaaacacauuuaaccugggcgugguggcucacgccuguaaucccagcacuuugggaggccaaggugggcagauuaugaggucacgaguucgagaccagccuggccaacauggugaaaccccaucucuacuaaaaauagaaaaaauuagccgagcaugguggugugcaccuguaaucccagcuacuagggaggcugaggcaggagaauugcuugaacccaggagguggagguuacugugagccaagaucacgccauugcacugcagcccgggcgacacagugagacuccgucgcaaacaagcagacaaacaacacugagcagagcauauucuuaaagguuccugguaggucuuauaucuuacucaguauucucagucaaccagagguauuaguuuaccaaacguggagauuaauucaugcaaauuuaugguuauuaauguauccaggccagggaguacauuguucaaaucgggauuaguuuuuagauauuuuguuguuucacacgguuggcaauuaaaacauauuuauacacuaauugcauuaaugcaaacuccaucaacccaaaccuuucuaacuauccuuuuugaagucugcccaugcaacaucagcgaggcaagcagaagcccugggcaccaggugggaggggacugcccuucaguccaugguagccuaggccccugggagcacaggcuggggcagcgagaggguggaugcuuccagacagacccugacucccuccacauggcugccuggaugugacacaggcccaaccaaagcuauggacaaaacccccagcucacucccacaggaggggauggcugguuaggagacuguuuuuugaggguugguuucaucauuuuaagcaauguguugauguuuuaaacauccuaucaacucuuugaagaaaguaaacuuauggauccaaucacaacauggauguggaaggggcgggaggcccauaccagugggcuucugccugcugugaacacagggugaucagguggaaauucauuuaacagugacuuccuccacaugucuuuaggaauucgaaaguguggagaaagugaagcgccucugagcaaaggcacgggaagggcccacaccugugucuaccucaguuccagcagggagcugaugccugucacaggggcagcacuacuggagaagcauccagcaaggugcggcugaggugggaccaauucucaaaaaaacuacgauuaaaaaaaagauguucucuuuugccuuuauuucuugcuauagugggaacgugaguucugcuaccuggggcugagugcacugggcagcaggcccagcagacggggccugcagggggaaggcacggcuggaggcccgugcgcaccgccacucuccuggaaccgcugcuggccgagccacagcccugcggaaauucuacugcguguggcagagaccgaugugcaaaagguuucuggugaauguuuuauggaaauugcuccaagcacuaaggaaagcgggaccgugccugugcugaccguggccuugcgcgagcgccucccggcggugcucucuggcucucuccaaacaggacgcuuccuucucugauucuaaggaaggccugagacagcccugaaggcuuaauguacagugcggccagguccuggcacugcacgcaggaucuuugguuagcugcauccauaucguuugcacgagagcugacggcacagacgcguaagaggcgugcacggcggggagcuggggacagcagccagagcauggggccaccaaggccagagaguucuggagagaugguguagaaucaggagacccgcuccaucccucacagagaccaaggagcccgagcgccgcgucagcgcuuggcguacguccugcuggagcucuugcucaguccgcccuucgggguggggaucuugcuuccggccuuugaccccaaggggccugaugcggccacagcugagcuuuucccugcagagcaagcacaggaccugcauuaggaggggcacuccuacccacggaccaggugcagaaccuguggccacagacacccagcaacaacgucccaggcccaugcugauggccgucacccgacuacaggagccagggcugagccuaguagggucuacucuucagcuuccuauuuuuuuuuuuuuuguugagacagagucucacucugucacccaggcuggagggcaguggcgcaauauuggcucaccacaaccuccaccucccggguucaagcaauucuccugcuucagccuccugaguagcuggacuauaggugccggccacugugcccggccaauuuuuuauaggguuucaccauguuggccaggcucaucucgaacuccugaccucaagugaucugccugccuuagcccccaaagugcugggauuauaggcgugagccacugugccuggccagcuuccugauucuaaacacuugagucagugauguagaaagagcggaggacgggagugugaauccuaggccacccguggagccuucgcacugcacagccaguuugcagguggagaaggauuuuggucacacgauucugauuauuagccugcuuacuaaggaaccagaacaugaagacaggcuuggaugcuuuauuuugcuuuuaaagggauggggucuugccauguugcccuggacggggaugcuuuuuugaauaagucaaaauggagggaugcagacuacaccugcucagcggcgcugucccucaccuggcugcagugccggggccuucugcagaaugugugucuugcgcagguucaucgugcagccggcugggcccaucaggugagcuuuccaugccugcagcagaggaggcacacagaguguuaaucaggcgagacggaccuggcacgcuaccugagacccaaaaggacucgcuguguaagcugaaaacgagggcggccgcuccagcaagagccgcagaagaacggcucccucaccugggcaccucccuucggauauguuaugauagccucugcagucugugcaggguacaacucaggaagcaagaaguccugucaccaggcaagccugcaucucgcauccccacccagccacacagggcccuuggugucagugacucugagcacagcagagcgugcacgcaaaugcaagggugagaagcagagcgcccgcgugauuacguuccaggccagaagacagaacgcgccaggcaccgcgggcuccccgccagccugcugcccacgguuccucgugggguucccacucucuucaucccugcucuuccugagccacgccacaugcacuugcccugcagaauguggggcuuaugcaggccugacugccugggcagccagcuucuuuccuuuacgaccagcugugggaccgucugcauggggacagggagcucaucucguccuccuguuggauauaaacgcgggaucgcugguucccugagucuucuggacauucgaguuguuccugguuccuucccuucuauuuaaacaacacucacgaggcugggcgcgguggcucacgccuguaaucccaacacuuugggaggcagagguggguggaucaccugaggucaggauuuugagaccagccuggccagcuuggugaaaccccgucucuacuaaaaacacaaaauuagcugggugugguggcgcaucucguguccccaacagcuaaucccagcuacucaggaggcugaggcaggagaauugcuugaacgugagaggcggagguugcagugagccgagaucacaucagugcacuccagcccgggcaacagggugagacuccaucucaaaaacaaacaacgcuucccagggacacugcuccagccgcucucccauucucugguggaccaguaucuccaccagacacagcccugcuucucccugguuccucucucacucucaccaguggcugucaguuucuggccaccugcggcagcccucaagauacuagagcgcuugcagccccagcccagcccacuccugucccgcuuuagcugcucccggcaggccuggguucuggucucuccaggccacuggcaaccuucgugucccuaaagcuggggcgccuucucaccagaauguggcccaccggcacauggggugcaguugcuucccccucccccguggagggacaugaccugcucuaaggcuccaauuccucccuccccagcacagagguggcaggucccucuccaucccuugaaucugggugacuguggcuugcuuuggccaaugggacaguggcagacacguggcagggcaggcugaaaugaacucaugcgccugggcuugucuugcuguugcccucugcugcugucgcgagaacgccgugcccaggcuggcgugcugggcucagacacagaaagcaaagcugaggugccgcagcugccuccaagaccauucucaaucagucuccggcugcggaccccaggcacacgcgugugugagcccagucagggccagcagagccgccuggccgcccuauggccaagugcagaugcaagagccaggcggcugcgaucagcugaacccagccaggccagcagggcauccucucugaugggcugugcucuggggccuccaggacgccacccucgucaggcuuccuccccagugcauuucuuccccagcgccugguuugccuucuuccucccacucugccuggggcuucuccucugucuacacuugcucuuuagaagagugcucccaguaucaugaccuuaaacccacuucuuauacacgcuuacaaaccccacauuuccaccugcagccaccugucuaccggccugcgcgucugacagggauuuuaacuccacagcuccaggcuaagcuccugagcgcccuggauuccugaccgcaguuacuuccuugccauguugugaggacuccaccggccaaguccugggucugccugcaguguguguccagaaucugaccacuucucgccacuuagcucucugcuacuacccgaccucucugucccacaggcugcucucaacagagcagcaaaacuggcuggcauagggcccgccaggccaugcccacucuuccgcucaaacccugcagggacauugccuuccacucacuuugaagaauaauggucaaugauuuuucauccccagcauugucuuucagucuauuuauguucuuugaugaagaggagguucucaccuuuuacaauuuaauaguuuuauuauaaaaugaguguacaguucaguaguguuaagcauguucacgaugcuuaacuccagaacucuuuucauuuuacaaaacccaaacucugccccaagguucuucauuuuaaucuaauugaauugaucugccucuuccaucaaggcuuaagcuuucuguguccuguuugagaaaucccuuccuauucugaaggcuauucucuuaucucuagcaucuccugagagauucauaauugggccuuucacauuugaaucucagauccacucggagcuuucuucugagcaguguggagggugucaaacuucacuguuuaucccccuucacauucagaaaaauuccagauguuagaauuagcacaaaaggacuuuaaagcagauaccuaguauguucaaggacuugaacgugcaaugaagugcuacugaucuauuagaacccgggcgaaccuugaaaacacguuaagucaaagacacaaaggccgcauagugucugauuccauuuacaggaaauguccacaguaggcaaauccauggagaccaaaacuagacauauggucgccaggggcuggagagggggcuggggagaaaaggggcggcauguaggcaguguugucuuuugggugauggaaaaguuccacacgugugcagaugguugcagaacccugaauacaugaaaacccacuaucuguccacggggagaggcugugcagacuagaucuccaugaagcuguuaaaaacaggugaucuuaaugagugaacagaggugaaucucagcagagaaaugaaaccuguaaagaaaucccagccaaacacaaauacuagaauuggaaaguaccagauugaaaaugaauucacuuaacagaggacuggagauggaaggagaaagggcaggggccauucaacuagaacagaaaggaaacacuggacaaagcccagugacccacagaagauugagcagucuucacacucacgagccugcaggcaggagagaagggagggaacgcugaagagagaaaaaauauuugaagaaugaacggcaaaacaauucacacgaaauuagaaagacgugucucagcaggcuggaguggcagagucuccugcuggccucgaggaagugagcugccagcagagaggcccccggugcugacggugggggccucuaggaguugaguggcuccggguugacagcccccaagaacauauuacugccagcugcugggaugagccuggaagugaguccuucccuagcagggcugacagaugagaaugaagccuggcuccggacccagggaacccgugagguaaugagugaguguguuuucugcuuaugcugaaggguguguggugauguguaaggcagugcagauaaugagauacagggaaagcagaugacacaugagauacgccuggugacagccuuacagguacuaccuguaagaggaugucaauucaaaucagauguugggaacaagaagggaaggaagaaaaggcaguuacaggagaaugugaguacugcuccuaguaggaaaccaauggcaauaacugaaaucagaggggaugaugggcauugcacgggaggacaaguaaagguaacaacucgaaugcaaacacaaaggcucccacauucuggagauaaccaggggaaaagauguaugugcagugaaaacugcuucuauuggguagaaaaggggcaggaugcccuguaggaaaagcagccccuggaggaaggcggauggaagcggggcaggacggcgccucugucugggguggaggaaggcagauggaaguggggcaggauggcggccucuguccaggguucuuccaagaugccugauucuaucgacccggaaacaugucuucuguaauuacagaacuuaauucuuuaaaguccccuagaaauguaauauaaaaugaauguauuuacaguugguggcacugcuagccagggcucacccaagucccuccaacacagggccacugggacccccgucaccaguggcagauguggucaggacaagaacugggaacagaucuaauuuccaguggcaucuccugcuggcggugcaggugccacugugcuggggcugccgcaggugcagugggggccaaggugaacuggucgccuccaauaccugaauucugucuccugggccuuuggaaaccggggcccauggauguaagaaaggagacacagauguugggagagacaagguuaaauaaagccugcagcucagaacgggaaggggaagugugugugcaugagugauggagcuuacuucccuugauuucuccuggcuguguccacugagaguccagccacagcgaacuacccagcagcagugggcaugaggcccccagcgcuguccugagacauccauuccugcuaaugggaaccaggccucugugcccagauggcugauuccagguccggggaaggaaggcaccaaacaggagggagcucucugaggcugcguggcucucauccaggccucaggagcccagcugaagagucugccauaggcuagagcugggauaauucacgcaucacuaagcaugguaacugcugugacuggaacacauugaauaauuuaaauccaugguucauaacgacacuacagacaaaacaaaacaaauuagcugccauggaagaugcuagugacccagcuuacuauucugaaaaccaguaaaccaaggaaaaaaauuaaaccuucacucugccuuuccaauagaaagucuaaccuagggucaccacagaguggacgagcuucugcuuagaggaauaucccagcagaugaacgaaggagggaugacagaaugaggccccuccugagucgguggguuaggccuugagccucagcagcugccaccgucacacauaucacgcgccucccgggggacacaccagcauugccugugaagcggccacacucacaccgagccugugcacaccugaugaggcccagagaucccaccuccuguuuacaggaaauacagggacagagaaacagguuaagcgcccccaagggaacguagucagcagauccagacgaugagaagcccuacggggcaaacagcuccuuccuucaccaagugaaucauaaggaaaaagaacgagagaaugaaccuguucaaaacagaccaaccaggcaccggggccuucuauggaucccgguaaucagaugcuucugaccugaugagauggcggcaaugugacugacgucuggaaggcugaggcugcugcuguggcuguguaaagaagucccgauuccgaaagcuccgacgggaacauuuacagaugcaacaacgugcugucuggguuggcuucaacauuacaagagaggggagcacgugggggcacgggagaaacaagacgggcugaguugcuaguugcgcaagcucagugaccgugacaagggagaguccugaggguuucugucacuuuucuguguacucugugaugcauuucaaacucugagagagagagagacugacagacagacagagggacagacagacagagggacacagagagccagauaacuggguagacaccagcgcugagagcggcugggggcugucuucucuguuuggugugaguuuucuggggucaagagaaagcuacaguggcuggguuggagccauuuugcugguaccauaucccagaaggcugggacaaggggagccagcagcaggacacagugacacacugcagguggcaggagcuaaggagguuggaguggaaguggcugagccagauucccaaacuggguccugagcagggccccagggcucagcauucgcugccuggcauaaagagggcaccgccagcccaucguguuggacagggccagaauaauugccacggagccuugcacgcccaugucccuccucgucgccuccaaugccagaggagccgagcacguggggaaguggagggugggcguguacgaggcggccguccccacuugccugcugagucacugcguagugcacuggggcagggaggagagcuuggaaucagguaggaaagagaaucguuuaaccaaauagggcuggguuuuauuaggcaaaagggaccgcaguguuacagaaucugggcaagaugucacugagggucucauuaucuggauaaaggcaaugaccagaacaaaauaaaaccauuucaugcuguaucccagugacacaggcugggccucagugaguugaggcuccucgauaaaccauucauaaauguacggaaggaaaucaugugaacacguagguaaacggaacgacugcucagacagggcucacuagacgcuguccccucccugaacacucauguacuguacucuguggcuauggucccgcacugacaccaccacugucaccaccacugccauccacaggugugucaccuacuucacuggucccuucuccccaggccccucaccucuucuccagggcugaaguucucaugacacaggggacaccgguuugccagcuucuccgguuuggcagcugaaaugauuuuaaaaagacucagucgcucccugaaugacaggcgacaagacaugcugcuggccugcccgcaggugcccuuuaauucaccaagcccuugcacaggcucaagagcaguggcacuuccuccaagaggaccccuggugacccgagggcacgggagccugggaaggggcacucacgguugcaauccuuguguuuuaugugucugggcagcucuuccuugaaaacagccucacugcaacgguaacacuuuccaaacccgucuuuuuugucacauuccgucagcaagugcuccgucagacuggauaucucgaccaccuggauuucgaaauacagagcaaagcauguugcugagaaagcggcagcgcccuccagccagccugcagagccugugagcgccuccccugcccagggaggucugugccgccugcacaugaaguaagccacaggcuucuaucuucggcauuugcccacagacugucuggagucacuugugauacuuugcugaagaccccacguccuuccuuuccugucaucuuagcaucgggcaggggccacugucaaggauggggaagcuacggucggccugagugugaagcuuggaugagggcgcagaguggcucagugguuacaguguggcccaagguugaaauuguggcuccccacuauuucuaagaaugcacacagaaacaggaccacagaaaagaauuuuaagagauucucucgcuacguuggugucucuggcaggaaugacuuguauauacucuauaacuucaggccgcaggacuugacacacugugagccaguucaaccucuuuucuucauaaauuacccagucuuagggauauauauauuuuuugagauggaguuucgcuccuguugcccaggcuggagugccauggugugaucucggcucaccgcaaccucugccucccggguucaagugauucuccugccucagccucccguguagcugggauuacaggcauacaccaccacgccuggcuaauucuguauuuuuaguagagacgggguuucuccguguuggucaggcuggucuugaacuccugaccucaggugauccgcccgccucagccuccccaagugcuaggauuacaggcgugagccaccugcccagccagguauuucucuauaguaaugcaagaaaggccuaauauaggggauggggaagacuuguuacacaggacacgaauagcaugaaccaugaaaaagacuggcaaggugggcaaugcuaacauuaaaaaugcgucucuuccucaagacacuucagacagcgaagacugcaugcuguggagugggagcagauggucacaauucaugcgacugaccaaccacucacauccacguguauaaagaacggccccaaaucaauaaaaacagauggacaacccgagggaaaccggugagaaaccaggugcuuugcaggacagccaaggccugcagacaaaaggacaggcacuccaccucaucuucaccagggacaggcacagggggaacucaccaagacagcaggaagcauggccgcagugccacugugggaagggggcaguggcacggugggaagggggcaguggcaccgugggaagggaggcaguggcaccgugggaagggcggcaguggcaccgugggaagggggcaguggcacugugggaaggggggcaguggcacugugggaagggggcaguggcacugugggaagggggacaguggcacugugggaagggggcaguggcacugugggaagggggcaguggcacugugggaaggggggcaguggcacugugggaagggggcaguggcacugugggaagggagcaguggcacugugggaaggggggcaguggcacugugggaagggggcaguggcacugugggaagggggcaguggcacugugggaagggggcagugccugugcugcuggcaguggugcccaggcacaaccccuuuggagcacuccugggcagccccacugagcaucagcacaccuggcaaucccacaacacauugugaacccaagaaagugcauuccugugcauccuggaagacaccagaacgcuguggcaacauuguuuaucauggucccaaacuggacgcagcccuggcgcacagcggaagguggaugaaggugcugugguccauucaagcaguggacacuauaaagcaagaaauccaacaugacgccacaugguuccguuucuacaaagcucaaagagcaaggaggacccauuuguggugucagaaaucagaccccugcugacucuggaaggagccccgaggggagguggcggcacagcauguuuccgguucacugggcugucugucauauggaaugacucgcacgcauuugcgggugugugcuuggcuucaguuacuuuucucgcaaccucuccucugaaaauacuaagacuugggacagcuuuuugacucggccuuucaacagccagguguucccgcucaugcaaguagcuggcugcugugccgcuggccugaccuguuugcaguggucacaucuugucagcaugagacagugcuuccaguaguggagauccagaccuuccucugugaaggauucacuccuuuccccacaaaaaauacacaaacugaaagcaaagcaaagcaggaaauaaagguaaggaucuaguuccacugauggccguuccgcucccacgucacgaggaaauucugaauuuccccagucccugugaugugugcacuuucccucucaucuggaacugccucaguuugcucugcagggcccgggcugggccucccuugcagguggcagaggaggcugggugugccauguguuaaagcacgauaggaaaguccucaccaaggaggugccugaaaucaacgggcgaacgauccuucugaaauuucacucagcaucgucaagcagaaaggauauuuuaaguuacaauaaacagagggaaaguugucuugacugacucggaguggaugcugguuagugcagaaggcacauuuccuaccuuuuaugaugacuacgaagggccaacuagggaggacgcauucccuuuccaggguuucuguguggcugguugcccugaccaucguacaauggguggaagacagcgcgacuuacuuaucuagauagugcucauccgggauucccagagcuucagcaggggcugcuuucccuccuugaaugucugaagagauuaaaacaauuuaaauaacuuuuuauagaaauuauuuucaaaauuuuaguaagcaguuugaugugagcucuaaaacgauuauacaaguaaaaagguagcauguuuuccauucagcugggagauggcugaggugcagcaggcgugcagugauacuugcugaauggacagaagccguucccacauggagcuuccaugacaugcauuuacacaccccgauucuuuacacaccccaguucuuugugcaccccaauucuuuacauacccugauucuuuggcuucacagcaucacuuucuuuuuccuaagacacagaaacagugaggucaggggcaaagggcugcagugugagugagugagagccuguugaagauauguuuucaucacgaaagcacauuucuggguuuuguuuuagaauuucuacuggcuggcaagguggcucaugcccguaaucccagcacuuugggaggccaaggugagugguggauugcuugagcucaggaguuaagaccagccugggcaacauggcaaacaaaacccugucucuacaaaaaguacaaaacuuagcugggugugguggcgugcccuguagucccagcuacucaggaggcuggggagggaggaucacuugagccugggagguggaggcugcagugagcugagaucaugccacugcaguuucucucaaacucaaccacugacuguggaaaacacaugcagaagugcaauucuaguuccacagacacccacccugccccuaaaaagagcacaauuuuguucuuauuaucauuauuuuuagacagggucucacucuguugccuagguuggaagugguacaaacacaacucacugcagcuuuggccuccugggugcaagccauccuccugccccagccuccugaguagcugggauuacaggugcucaccaccaugucuggcuaaguuuuuuuuuuaaguuuuaguagagaugaggucucacuauguugcccaggcuggucuugaacuucugaaaucaagugauccuccugccucggccucccaaagugcugcaauuacaggcaugagucacugcgucuggccgagaguaugauuuuagaaccagaaaaggacuuaauauguaaauucugaaaguucuggagauggaugguggcgaugguugcacaacaaugugagagcacuccaugccaccacagugugcacugaaaaugguaagauuuacacucugugcauuuuaccccaacaaaaaaagagaaaaauccaucccaucccgucauucuccugggagaggccuucaccaggcccuguguggggcgcaggucugcgcuggccucgaggcccccacaacccauggcccccagcaccccgcagcacagacccacugccugggucuuucucccucgucugcuccucccuggagccccagcuccaugagggugggacuuugcuuugcugccugcuguauuuccacagccagauggcgccuggcacggagaggcgcuccauaaacaccgagccaaugagcaagagcugcaggcucucaggacagcuguguggaggcugugcagcccaucagcauaggcgaccccgggacagacagugcugugugcccaugagcauaggagaccccaggauggacagugcugggaauagcuccugggcggcugcugcuucuggagccacugccaccagguccugggcuguggugagggaggcgggaggcaggcgccuggcaaugggcuuaguacaugcuagcucauggcuggagggaaaucccuucaguuugcgacauccguguccucguuuguguacuaaucacaaugagugugugcugagccacugagggucacugagcacacgagucauccacaccacgaugcggaccugagccagaggcucacuccucaucccagggucugccugccuccuuccgccuccuguguccuuuucugauugugacucugacguuccagcauuugguggaaaugucacggugacuuuuugccauaggaaguucagccuauauucagccacauuugaucuuuuuuccccauucguacccauuucuucuuuuaaaaaucugugguaagaacacuugacaugagcucugcccucugaauagcucugcgugcacugugcagccacgugggcugcaggccugaggugccagcaggucccagaacucauucaccuggcacggcugaaaacucaggucugcggaacggaaacucccuguguucugccaccuuuauaucuuuuuuuuaaggaaauuuucuuucaacugaaggaaacuucaucauaaaauuaguguuaugaagcuaauucauaucccagaagcugggaggcugaagaggaacacauuuauauucaaccaaauaguauuuguucccaguacauaugacacccccacaggcuuagaguaagggcucauagaaacagaauguuuaccugaaaccuucccuuuuuaaugcgcugaagucagaccuuuauagucaagcugauuuuucuccuuugccucugaagguggcuggagagcuguggaggagagcagcucugggcccacagccccuggucccucccuaaaccucagcagcagcucacaucaauucugacagaggauggaggggcaggaagaguaucugccacccaauuccaccucuccauggagggcuucugucauccaccccaaaacuaaccuaaaaaaccaaaaggaaucaagacgcucauuugcauaaucccaugaaaaauaagucaaguaugauguggaucuauacagcaaaauacauuucagcuaaaagcacacaggugaaagacguguuaacuuccaaccugaacuucagccugaauuucuuucagugcugccagcugcccuuguaaagcuuuuauuucuucuuucuuuuguuuuucugcuucuucuguagccgcuuuucuccgugccugguaagaaaauuauuuuuccauuagaacagcuuguuaggguaaucuuagaaacugggagacaaauuauggcauaucaacuauauuucuuauaaauuauaauauucacuaagacuaauaacaaguuagaauaagucuuuuccauugauuucauuggugucuauugauagauaaacccacuguguccucacggcuaucguuauuccguuugcagccugggaaccuaagggucucacuggcagaaaguggagcagccgggaucugaaugcgggaaccuguguucuuucuuagccaggacgccggggcuucccauacauguggcuccuucaaaugacauauuuacuuauuuacguaccgaguaacugaguaacuucuucaacacaggaugacaucacaacuucaccaaaguuaacucacccucaucucagcaucuguagcucugccaucuauuuuagcaaaucccucaaaaauuguuuuguagagaauguuccugcguguguugcugucgucuggaggaagguacuccaggauggaagccuggugcugucuguacauguccaaaauaauucgaaccgccgucucgcggaccucauacacucuaugcuccagggcacucacugaaaacuaaaguugggaggggcucuuguuacucauucuuaaaauaaaacuaauuucuuccagcuuacaaaaaagguacauuauaaacaugugaaaaauaaaagagaaaacauccguauuaaguauuaugaaauacuucaaacauaaaaccucacggaucuaccgucucaucguaagccguguuauacuuucaucacgcuuguuuuggaucuuuuuuaagaaacagaacgcuguggcuauagugcaauuucaucccugcugugcgucucgggggcccacaguuucucauccuccuuggaggugugcgcuccugcguagccgaugugcagauuucagguuuuuggauuugggauccaaaccaguaaguauaauggaaguauuccagaauccgaaaacaaucugaaauccuaaacacuucuggucuuaagcauuccagauaaggggcuucaaccuguaccugauauucuccaucacacugcuguuauugucucuuaaagacaggccgggcgcaguggcucacgccuguaaucccagcacuuugggaggcugaggcgggcggaucacgaggucaggagaucgagaccauccuggcuaacacagugaaaccccgucucuacuaaaauacacgaaaaaauuagccgggcaugguggugggcauccuguaguaccagcuacuugggaggcugaggcaggagaauggcaugaacccaggaggcagggcuugcagugagccgagauggcaccacugcaccuccagccugggcgacagaacgagacuccaucucaaaaaaaaaaaaaaaaaaagacaaagaaauauuuuuuaugauuuguuucucuccacagauaaagaucugcacacaccaugcaccaccgaguaggauuagacagcaggacgcaugugggggcccccauuuguuggaugaaacacuggcuauuuuucugaaaucacugccucagucauuccuucaacaaaugccgaugagacccucgccacgcuccaggcacuguggugagugcugggccgcguggugugucacacgcgaggucugcuuaccuucaucacguugucaauggugaagcccgagcugccagugcccaggucuuucagcagccgggccaggaggcccaucugacucauugccaggugaacugaagaguuugcuuucaauggcugcaccagguaggauggaauaauuuggagagacuuaacuucuuuaaacaaggccauuuccuaugaaagccaagguaauuuguuaauuuuuacuggaaaaugcuggaggcaguuuaguacaauucagcaugaucuuaaacuaaacacugaagggaaaaacagggaaauacagauugauagugacaaggagcaaugagagcacugauccguaagcuuguauuucuauuuaaagcguaacaaccauuagaaaugaaaaucugagccacaggaaauaaaaucaugaagaauaaaacgauuuuaugucuacugaaagcuuuucagaagcguaauugaaaacuugaagguuucuguucucaguauucucagcuucaaggaaaagguuuucucauuucuaaaauucuaaaagaaauuagagcugcugcuagaaucaccguuauuuuaguauuuauuaaaugucagccaagaguguaugauucugcagugauacggucaccaguggguuaagauggaaaaaauguaaguaccauuacauauuugaaugucucuaaacaaacaagucuuuacguaauuaagauauuuaucacuuaauuaaccggauauagagaaaaaaauaagauguugaaucauuaaguuacaaucagaaauaaaccuguuuccaauaggucugcaggucuuaucaccuaaaauaaucucuuaucgugcuggccugacucacucuggauuugggccugugagugacucuguacaaaucuaaaagcuaagagaagaagagcauucuccagggaaguuuggacaguaaacuccuuaacuacaaacagaugcuguugaguguguauuucguccacuaaccggcacacuggugcacaauuguaacccucgauagauugccuuaagguugucucacauagagagaacauuugagcaccaccaaacugcucagaaauuaauguggcuuaaaaauaauuaaaugaagcaauaacaugugcucauuugcaacauaucuuuugaaagaugaacccuccucacccccaaauucuagcugucauaaccaggaguguauuguagcacauuaggucguaaccaggaguguauuguaaccaggaguguauuguaaccaggaguguauuguaaccaggaguguauuguaggucguaaccaggaguguaguguaggucguaaccaggaguguaguguagcacauuaggucguaaccaggaguguagcguaggucgugaccaggaguguagcguagguccugaccaggaguguagcguaggucgugaccaggaguguagcguaggucgugaccaggaguguagcguaggucgugaccaggaguguaguguaggucgugaccaggaguguaguguaggucauaaccaggaguguaguguagcacauuagcaugacagcauuucuucuuaccuuuuuauuagcauuccuuuuccuuauuuacucugaaaauuuagguuuauuaaaugaaacuagaucugugguuccucauauuuuggagaaaugaccccuuuggauucuucuuuuugagacacugucuuucucugucacccaggcuagaguacaguggcgagaucacggcucacugcagccucaaccaccugggcucaagccucucgccucggccuuccaaguagcugggacuacagggguguaucagcaugcccggcuaauuuuuguauuuuuugcagagauagagucucacuauguuggccaggcuggucucaaacuccugggcccaaaugaucugccugccuuggucucccaaagugcugggauuaugggcgugagccaccccgccuggccuggauucuuuuuuuuuuuuuuuuaagauggagucucacucuguugccaggcuggagugcaguggcgugaucucggcucacugaaaacucugccucccggguucgauucuccugccucagccucccaaguagcugggacgacaggcacgcaccaccacacccggcuaauuuuuggauuuuuaguacagaagggguuucaccagguuggcuaggauagucucgaucuccuaaccuugugauccaccugccugagccucccaaagugcugggauuacaggugugagccaccgugcccagucuggccuggauucuuuuuuaagaaggaucugcacaucacaaaauuuuguguaaaacuuaacguaauucauaagcuucuuaagcccaaaggaggacucuuaagaacuccuagacuagaugaauucauuagcuaguuuaaagauuuucaaauuauggugcauaacugugugccccaaaacucauacauuuaucucuaucucaauauuucccauaauaucuagccuagaggaggcauauuuggugaaagaaugaaaauauuucuauuaagacaguuauauuuuuuauuucuuuacccucagauuuucucuuuugauaucauuuucuguguguuuuuauuuauuuaaaaaauuaauggcauauguuggauaaaaaaaacauuggaaaaacccaacuguagauuuuaacugaaguuuaugucuaagacaaaacugaccuuuuagagcauaaggaaagugugauggugaaucccugagaauaauguuaacugaguagagacagaaucuuguaaaagguguuaagaaagccagagagcuacaggaauauguuuaucaucuacgguuucaaaugccguggugaaguucagaccugaauaaaauuugcagcugugacgcggaggcgggcagaagaaucuccaguucuggugagcaaaacgggaaugguccucuccacacagugagcuguuucaaguuuacucaguuuauguuuaggaauauauuguguaaugaucauuuucaacaauuucaaagaagccugaaaaaccuaagagaaaagugaugaacacggaugaguuacuacggugcaauuccaccaagaggaaacauggcauuuacuaucaguaacacauacgaacauuauaucgaaaaugacaucucgucugaaaggcugaaaauugcaaacugaaaacugcuuucuaaacacagcaccuugcauauagaggacauaugcucuuacuucacucugucagaaaucacuccccaucuucccuucauaccgaguaucuaacaucccugcuucaauggguaagcccaaaucuucccuucauaccgaguaucuaacaucccugcuucaauggguaagcccaaaucuucccuucauaccgaguaucuaacaacccugcuucaauggguaagcccaaaucuucccuucauaccgaguaucuaacaucccugcuucaauggguaagcccaaaucuucccuucauacugaguaucuaacagcccugcuucagugggcuguuagaagcccaacugugcaauguccauucuuaaggcccauucagcauuagaaaaaacaguaauucucaaccucaucagguuucaugcaaagugaaaacacaaacugaagaugugguagcauugaacuaggccucuacaaacgccuggcuuugcagaccauggaaaagcuaacacugcuggagaccagagacaaugacccaagcaaaggcagauuucccagacccuucauguaagaucaguugcacaguauagcucuugcuagagaaccucauuucuuagugauucuauugaguuacaguuggugaccacgucaaugaccaacugguccucucucaagcugcucuggucuucugugguacggcgcaugaucucauccaugcacgcuggagccagcgccagcugagggcacucacggaggucacaauguccuuuauggcucuucuaacgagaaagacggaugcucucaguguguucuuuaaaucuucuuuugggguuccaacaggcauuuccauuaacuucuuagacaaggcaagcagugcauccucucgguaggaccacgucuuacaauaggccucagcaaccuaccacaaaacaggcagcauuucauggcaucacacaaccauccuccaacacuacacaacuugaaggcuuuguuuuuuuuuuaacuaaaaugauucauuucuaagaacagaacuuuuauaaaugaaaaugauucauuucuaauaauagaacuuuuacaaauaaauauguauauuuagagaaauaauuuucucugauaaggaaauuuaagacuauguuaaaauauaaaaaguauuaaauucuccaagagaaauauuuuaaagcugagaacgagggaaaacccuacucauuucuuuuuauuuugagacaaacucucacucugucgcccaggcuggagugcaguggcucggcucacugcaaccucugucccccugcggguucaagcaauucuccugccucagucuuccagcuagcugggauuacaggugccugacaccaugcccagcuaauuuuuguauuuuuaguagagaugggguuucaccaucuuggccaggcuggucuugaacuccugaccucgugauccacccgccuuggccucccaaagugcugggauuauaggcgugagccacugcgccuggccaacucuacucauuucuauaaggagauacuuccaucuuuugcuaugccauccuuuugcgcuggaauuagcugguauucagaagggagcaguuguuuaauacaagcuccaugaaugccagaaggaaacacccaggcugaaaugaguacucacugauacaucuuagcucauguuuuugcuguuucacauaauuuauaauuuacagaagggcaggcacgguggcuaauguuuguaauuccagcacuuugggaggccaaggccaggaguucaaggcuauagugaguuaugaucacgccacuguacuccacccugggugacagagugacacucuguuucauaaaaaaaaaaaaaaggccgggcgcaguggcucaugccuguaaucccagcacuuugggaggccaaggugaguggaucacaagaucaggagaucgagaccauccuggcuaacguggugaaacucuaucucuacuaaaaaaaaauuacaaaaaauuagccaggcgugguggcgggcaccuguagucucagcuacucaggaggcugagguaggagaacagggugaagccaggaggcggagcuugcagugagcggagaucuugccacugcacuccagccugggugaagagcaagacuccgucucaaaaaaaaaaaaaaaaaaaguuaacaaaagacuuuccaauucaggaagaacaaagggaagucaacaauauuacaaaugcaaagccgugggcguuuucccuccuuuauguguaaguacacagaggugugcguaccauauagacuagccuccccucugccaccccguuuuuuuuuuuuuuuuuuuuuuuuaccaagguuucucccaacacaucgauggcagagcuggcuucucucaaggccuucucgguuaagggcucuggcuccccuaacaugccuccccuccgagcaucgcugaugucugcauuacucauuuccggcuccaccacugccuccccauaaugcuuacgaauagcuggaagaggccgcucaucguagggcagggacucugccugcagugagugaaggagagaggaaagugcuggggagcuccauaggucacauucuccagugcaacucucacuggcaggcuuacugcgcuuacuuaccugaucugaaagauguuauuuugcuaaauaucaguaucaucagauuagaauaauuuauacaacaaauaggauguaauugaaaagauuagaugaggcuuucuauuacuuucuaaacucauuacagaccuaauaaaaaaaagcaagguagauuccaccucaaugacuguuuacugguagcaauuucaguucaacugacauggagacuacuaaaguaaaggcuauuacaucuuuuuuucugacaagaucucugauauuuucuuaguuuauugcuuagaaauaagcaucaagccugauuuuaauaaacaugcucacaaggugucauuaggccuauuccuuauguggcuaugcucucacucagcacuauggcuccuagaauggaacagaggugggucuggcuggggagcacucaugcaccccaugcaugggaacagcaccuggcacaacacauguccuuuacaaauacccaaauaaauugaacgccaaucugaaacagaauuaccuacauugaucuuuggaugaggaucuguggcagggaguaacgggucuacugcagaaugcugaggagaaauaguuagagaauaugaugaaggcuuuuccugaaggaaagguucugcaaacugguuuucuguuccucuuucuuccaguugugguagugagggcauuggcuuuugguggcaaggacugccagaacgagcgaggggcuggaggggcaaaucaaaaggucuucgcaucuagagaacaaaaaggaacauuuaauuucaaaugccacugccacgccagauauaucuaucucauuccuucagaugaauaagacuuuagaaagcugugcuggaagaggcuccuuggcacaaugaaaaauuucaaaaccaaagagaaacuuccacagagugaaaucuacuugaaagucccacacaaucaaguugcacucaucucaguugucucuccacauuucuguguugacuacaaaagugacauacacauccaaaaugcuagugaaggaaugagcauuugugcauggagcauguccacacauaugugccccugcaggagcacggugguguggagaaagcaccugggcuggacccaaguggacuuuuauucaaaaucuggcacugcuauucacuguguguacaaaggaaagugauguugugucaucccaacaagcaaagcugacugaccaguugcugcacacuaggcaugguacugaguguuuuggacagguaggcucauuaaugcuuacucuguuuacccccauuugaaagcugauggaaaacugaggcauaaagcugauaagaauuagucugugaucacagagcuggaaugguggugcccggauuugaacccagacaguccagcuccagagugugcucucuuguuuuucagaggcagggucucgcuccaucaccaaggcuggagugcaguggugcgaucguagcucacugcagccucgaacuucugggcccaagugauccuccugucucacucuccugaguagcuaggacuacaggugugugccaccaggccuggcuauuacuuacuuuuuguagagacagggucucucuauguugcccaggcuggucucgaacuccugggcucaaacaauccuccagccuuggccucccaaagugaugggauuacaggcgugagccaccaugccuggccuugagagugugcacucucaaucacuauuccguaucucagaaccuucauuuccuaaucuguaacgugggcugagugccccauuugcaugaguucuaaaaucagaggcagagcaccuuaugggaaauauguucucaauacaccgaagcuguuagcauuacguucucacuugauccuuacaacacugaggggucaguggggcagggucaucacugccuuuuccaaauaaggaagcagcuggagagaugaagggaugcagcagaaaagcagcagggccucgguuuuccugaccccgguuuguucccuuucccacgacugugagucuccugaaagaacaugcugaggcaaagccucccugacguaggcacagagcugaggccauccauaacuguccccugagcacugcagaguguuuuacacuacacuucaaagacaucuauccacuguugugaaccacacaguugaaucucuguucuccuaggcuuuccuccacuccgucugggcuccugcacccaccagcucggcauccaggaggcugugcagcuccagcugcucguacaccucggcacgauacugcuccaucugcugcuucuucuccuuggcgagaucguagucuuccuucuccacggcacagcguuucucuaccucauaccucccaaggcguucaccaaccugaagcacaaaauauuugcuuuuucuuucaaauuuggaucaacucacaucaaaugcaaagcuaauuuuuaagaaucacgcgugaaccgucuugcaaggagagggagugagcacagggaaauggaaggaaugggccacacucagcaaaggucuggcugcuguugcuguaugggcauuuaauaagcucaugguuugguuaugacuuucaggauagcugguuuuccuauuuucccauugggcucaggguccuaguaacgagguagcugacccugacaccugaacgugagucugaagagguaaagcuucugcuuccauuuacauuuuuaaagugcuuaucugucuccguaacuuuauuuugcugagaucuuugaacucacacuaacuucacggcuuuuaguaacugguuucuuuuaccauguaguuauucuaaguauacauaaaaccuauuacaggcauaaauuaggaacuguuuucuccaaaggcaauaccuuuugcaaaucagcaauggcuuguuuuaguuucuuggcauaaucauagcguuccuuuuggacagcuucccguuuucuuucaucuaauuuucguaugaucugugcaacuucuggaucuugguacauaucaaaagcuaagucaucuagcggagagauauagucagauuuccuaaagggaagaaaugcauauuuuagagauaauuucacgcccuaggaguucagugcugaagaugcacgguugagaagaugccccuccccauccugccccaucaugguucacagagcauuuccugcaugagaaaacgggucucagagaaguaaugggccucaggucacaaagcucuuaauugcaagcaggccuuucugacuccaaagcucacgcucuugaccauggaccaaacugcacuucagggcaucugagccuccagugcauucgcucagagugcagacucugggccucgccucguuaugggcccugggaauaggacagugaaugugaaucaacugcagaacaaggagaaaaacaaaaacaaagacaaauggaugaccaggccccacccuaagaaaugugaccagugggcccaagauggaguccaggcgccguauuuuauaacaacacaguauuuuuuucuucuuuucuuuuuucggaggcggagucucacucuguugccuaggcuggagugcaauggcgcaaucucggcucacugcaaccuccaccucccggguucaggcgauucuccugccucagccuccugaguagcuaggauuauagguguguggcaccacaccuggcuaguuuuuguauuuuuuaguauagacggguuuucaucauguuggccaggcuggucucaaacuccugaccucaagugauccaccagucucagccucccaaaguguugggauuauaggccugagccacugcgcccagccuguauuuuuuuauuuuuuucuuugagacagaguucuguugaccaggcuggagugcaguggcaugaucuugggcucacugcaaccucugccuccuggguucaagcaauucucaugccucagccucccaaacagcugggaguacaggcgugagccagcaugccuggcuaauuuuuuguauuuuuaguagagauggaguuucaccauguuagccagguuggucuggaacuccugacgucagaugacccacccaucucggacucccaaagugcugagauuacaggugugagccacugcacccagccagcaucacaguauuuuugaugaacaugauagguuaagaauugcuaccacugagguuuuacucaaaggguuaaguuguauggugucaaccaucauauccuagaggagaucaaaaacauuccuucagaaauaagugaucuuuuguagucaccugaauagcucauuucugauuaaauaugaccucuauuccuccuuuccagcucuacaguagggucuagaauguaaacaguaaaguuagucucaccaagcaacgagaggaugaggauggaagugucccagcugcuguaucaaccccauuaaacaagccagcugcuuacggcgacuugaacacccuucgagacagguacguuuuaaugaaaacacuugucguaaaaguguacuuggugaaucuguauuauaaugaauucaaguggggcauaggaauaggcccccuuuaagcacucacagccccccucuggcaucuccccacccuugaggucacgguacuucgcucacagcagcaccacaggcuggcggcugggacggcaccagcagcucugaacugugucuaaucccaggggugacuaaacagcgaaacauuuuggggugucuacaagaucacauuaacuauuuuuaguguaacacauaugacacuuuaagucacguugccuugcugucccagagaugaacacaaagacuucauuugauuauaaaaauccuucaaagugaacaucauguccugugguacccagucccagcuccuguugauucagcagcagcguggggugccaucuacccacuuugguacagaacccccagcggcaaugaccggauuccauguccagcacaggcccgcacgugccagucacacagcuuuucccaguccuugcacuuaaccuucauaaaaccccgggcguggggcaggacaggcaaaccacagccugccaucccaccuggcugauuggauuaaggcaacagauuuaaagucuaaaucaaaauaacagaaagaagcuuuauuggagauacugagaaacuaaagacuuaaucaguuugguuguuccugcccuacugcacuugcuucaguaagggcagagccccagcugcggucuuuguggagaggcuggcaggagggagguagccauccacucucagcgcuccuuccccacagugcuuccauccaauugccagcuugaaggaugggaagaguacugugauuuuucuauuacacaaaggaggcaucugagggagagacugagaagcugguguuauuuuuuuauuuuuauuuuuugagacggagucucgcucuugucgcccaggcuggagugcaguggugcgauuuuggcucgcugcaagcuccgccucacgccauucucccaccucagccuucugaguagcugggacuacaggugcccgccaccacgcccggcuaauuuuuuguauuuuuuaguagagacgggguuucaccguguuagccaggauggucucgaucuccugaccucgugauccgcccgccucggccuccuaaagugcugggauuacaggcgugagccaccgcgcccggccuugguguuauuuuuuuauagacauuacaugaauagccucuacucucugagcacuccacacucacaagugccugugacagcucuggucugcaccaggccuguggggaggcgguguagccucugcaggagggaaggcucgcuguccaccagugcacaugcucagcaaaucgcauguggcuccugagcaacugcagagagaaucugauccagguugugugcaaauagaagagccuggaucaagaauuaaucacuuucugcgagcagucuguaugcagguaaaagugaaauuacaccaaacacggacaaauuugaaauuucuauuaaaguuuaaaaaguugaucuuuucuuuauugggaagcugcugucagagaagagccaaggauuauuuggaauuccucuuuauuuaaaauuuuuuuugugcgugugugagauggagucuugcucugucccccagacuguagugcaguggcaugaccuuggcucacugcaaccuccaccucccagguucaagggauucuccugccucagccucccaaguagcugggacuacaggugugcgccaccacgccuggcuaauuuuuguguuuuuauuagagaaggaguuuuaccaugcuggccaggcuggucuugaauuccugaccucaagugaucugcccaacucagccucccaaagugcugggauuacaggcgugcgacauaacgcucagccuaaaaaacauuucaauuccucuuuuuuucucacugcggcaacuauggcagcccuucccuucuuuccuuuagaccaggcaccucuggaauggaguccccucauugucauccacagcaggcagguggcaagggaaccacugucccaaagaggugcccaggacagagagggugaccgaggauggcacagcggggcccuuuagcuccccaaaaguggauucacccccgguucuuacacugcuaaaaaaaaaaaaaaagaggaagcggcaacagcagcagaaaaauauguauaauuuuuuuuuuuuuuuuuugagacagggucucacucugucacccaggcuggaauacaguggcaugaucucggcucaagcgaucuuccugccucaauuuccugaguaguugagacuacaagcgugcaccaccaugcccagcuaauuuuuguauuuuuaguagagaugggguuuugacauguuccccaggccgguuucaaacuccugaucucaagcaauccuccugccuuggccucccaaaguggugagauuacaggcguuagccaccacacccagccuacaauuguuaacacgacgaacuuuccccauacccauuuuuuuuuuuagccaaauuuagcagugagaaaaaauauuuuuaacggguagagagagauugguaaaaauugugguguguguuuuuuuuuuugagauggagucuugcucuaucgcccagguuggagugcaguggcacaaucucggcucaccacaaccuucaccucccggauucaagucauucuccugccucagccucccaaguagcugggauuacaggugcgcgccaccacgccuggcuaauuuuuguauuuugaguagagacaggauuucaccauguuggccaggcuggucuugaacuccugaccucgugauccacccaccuuuggccucccaaagugcugggauuacaggcgugagccacugcacccggcaaaauuguguuuuuaaaaacguaugugauacauauuuuucacuccucuaaagaauaaacuuuugaagaggccauaaggugaugucucuagaacugauaaccuggguccauuaauaucuuugauuuuuaccaugaauuugcuugugcugauaaaauaucaaaggacggcugacagaucuuuguucuaaacgcauuuuaggaaacuucuagugauaccugaacacaagaaaggaaguagucucugcugagcaauaaaugaagguguguggcugggcacgguggcucacaucuguaaucccaucacuuugggaggcugaggcagguggaucaccugaggucaggcucaggagaauugcuugaacgcaggaagcagaguuugcagugagccgagaucgugccacugcacuccagccuggcgacagagcaagacuccaucgagaccagccuggccaaccugaugaaaccccaucucugcuaaaaauacaaaaaauuagcugggcaugauggcaggcaccuguaaucccagcuacucaggagacugaggcaggagaaucccuugaacucaggagguagaaguuauagugagccgagauugugccauuacacuccggccugggcagcaagagugaaauucugucucaaaaaaaaaggaaaaaaauaaaugcaggugugcuaaauaaaacagcgaccuuaaucuuuauguaaauuucagacaauccaaucaguggcuuauccagcucuaaacugaauuuagaggcucuaaguccagaauccuuuggaaaugacugacccuuucaggauucugaggaaaguaaaagaaguucauugauggggagcaggacucuuaccuggcguacguuccuucuagagcaggguccucgcuguugugcccaagguaguggucaaucaacuucucucgagaggccuuugggggcaaaacaucugcuuagugucucagagagaaagaggaacaacacaaaaccuuaacuacaagauuuauuucauauaaagcugucagcaagguucaaugauccucaucuuuuggagagacagcuaaaacuguuaaagaaaaguuucauaugcuacagcuccuaaaaaucaucugaaaguuauucacuagucaauuuuaugcagauuauaaaaaugacacauuuuuugggugaaaauaaaugacucccucccauuauaaauagauuuacuuccuuaggaauuaaaacuuuccaaacuuacaguauugcuuucaucacugaaaucugcagggucuccaaugauauuuauggcaaccaaagcaaccuaagaaaguguuaaaauaacagaauuaaauauacaauguuugaaaugacuuaacccuuuuauuuacuuauuuugagacagggucucgucugucacccaggcuggagugcaguggugugaucauggcucacugcagccuugaccucccgggcucaagggauccuucaccuuagcugcccugguagcugggacuacaggugugagccaccaugcccugcuaauuuuuguguuuuuuugcagagauaggauuucaccauguugcccaggcuggacuuaaccccuuuauaacaaacucugaccuacacuguuaucaaaugggaugauguauaucaaagcguauuaauuguuaaaauguuaugccaauauaaauaauuuuuaauaauuaacaaagaauuuuaaauaaauuauguuaguauucuaaugcuaaccaaaugguuauuuuuaaccauuuaaagccugggcgcggugccucaugccuguaaucccaucacuaugggaggccaagguggaaggaucaccugaagucgggaguuugagaccagccugaccaacauggagaaacuccgucucuacuaaaaauacaaaauuagccaggcacaugccuguaaucccagcuacucaggaggcugaggcaggagaauuguuugaaccugugagacagagguugcagugagccgagauugcaccacugcacuccagccuaggcaacaagagucaagagugaaacuccgucucaaaaaaaaaaaaaaaaaaaaaaguucaaaucauaauagcuaaaaacucccaaaguuuuaacauagccucaaaaugagacauccacgugagauucaguauggagcucaucuuugaaggaucuugggaaauuagacaaugaaaaguuaacacagcucaguucccaguuggugagucucaccugagguggggagucacuuuuccauccugcacccccaaccacuguagacuaaccccacaccgcuuccaaaaaugcaaagguucaagacaggcacauuuggggcaggagggcagcuggcacaaacugggaaaccgagcaaguuuugaaaugaaauuuuuuagucuuucaugucagugaagugcugcuuuagauaguuacugcuuuuaaaugcagggcacauauauuaucauucaugacgagauuaucugaacauaaggacaauaaauaaucuauuauuuaaaaaucuuuauuaaaaaaacaaaacuccaaacuguuuaaagaaaaccaagacaacagccaggucauugcugguaaauacaugcagguggguggaggaaggaacaggguuaagacucauucuucuggcuuccuggcguguuaugcugcaaggggccaggcagcuuaauuggaccuuugcgcucuuguccagcucacccgcuuggucuagagauuugauuugcugggugcucacauuccucuuggagggggcagggagaguuguaaaugcuugugcuaauuaacaagauugcuuuggacacaauugauuucuacuacacuaaucaugugagaaaaagaaaaaaagaaggaaagaaagggagggaggaaggaagagaugaagaauuagcagccugaagcuggagagauucuggauuacaugcaacauucauguguccacaauuuccaccagggaauuuaccuugugcacguugggaggguuuauuuacaacugugcuguccuacacaaauaggaugugagccacauaugucauuaagguuaaguaggcacauuaaaaaauuuaaaaaugcaauuaauuuuaaaaauauagguuaacacaacauauccaaaauauuaucauuucaucacauacaauugacauaaaaguucucaugaacucuuucgcguucuccuuuuguacugagucucugaagcccacugucuggugaugcuggcagcagcucugggcacuaggccaguucguggugggcacuggccacgugugcccagaggcugcuggaucagacagcacagcucagagagcucagcagucucccagaagagauccucucuuauaagaucaccuugaaaaugcaucuaagaaaagauacgugaccacauaaucccacaaagaagguaggggcagaaucaaaggcgaagcugcaugcaucuuaccugauuauauauguuguauuuguugacaugguuuuggugaaaaaucaguuuaagaaauuguccuacugcauccacauaaacugauuuuaguucccgggcuuugcaaccugucuuuucauuaucacagagagacacguagcugaaaaacaaaacacaacugaagaauuugaaaaugugcuguucaauaaaacugcucccuacucugauugaacucaauaggcucauuuauguuuauuguuuuauuuuuuaaagcuagacuaccccuaugcaggaucaacagguuugaauaaaagcuaagucuagaaugaaaaaccuaggaaaaaccccuagaacucaaauucuaauuaguauucuucuuuuguuguuguuguuguuguugagauggagucuuguucugcuacccaggcuggagugcaguggcgcgaucuuggcucauuccaaccuccaccucccggguucaagcaauucuucugccucagcuucccaaguagcugggauuauagacgcucaccaccaugcccggcuaauuuuuguauuuucaguagagacacgguuucaccauguuggccagauuggucaucuaauuagcauucuuaagaaaauuuccacaucugaaaaguagaguugaauagcagaauucauagaaauuauagcgcugcuuuuuaagcacauucaauaagaggcagguguuaagaaacuguguacucuugaaccaaauagaaguacauaacacaggaccaaaaguuaagggacaauucauuuuuaagagcuuucagggccgagcgcggugacucacgccuguaaucccagcacuuugggaggucgaggcgggcggaucacgaggucaggagaucgagaccauccuggcuaacauggugaaacccugucucaacuaaaaauacaaaaaauuagccgggcgugauggcgggcaccuguagucccagcuacucgggaggcugaggcaggagaauggcgugaacccgggaggcagaggcugcagugagcugagauugcaccacugcacuccagccugggugacacagcgagacuccaucucaaaaaaaaaaaaaaaagagcuuucagguagaauuagccuaaaagcugccaugauacauuuuaaauuucauucuuacccaagucuucgaaaccgcucugcuugauagggugcaaaauauucaggcaagcuuucacuaauguagaacucaauuuuacuugaaaucauauacuggugagcaaguaacugcaguuuccuuauucgacaucucuccaccauuugaaggacaauuucuuguggaaacuggcaaaaucugaaagcaaacacauuuuuauauuuucugaacaacuucugcagaggguuucuagaugcuagcaucucauucuugcagguaagaagcauuaaccacacacccacuuugaacagaacagucuguagguacugaugguacaaagaugccugcgacaugauuccuguucucucgagcuuuucuuguuggagcugaagcugggaauugaaauuugacuugaucugccuguaacccuauaggaaucauacucuuggcagcuaguaaauggucugaugugaaaccugcaguuuuucauaagauaaaucaaucuuaugaggcggcacuagugggcaggacggagccaaaggauuuuccacaggaacucaaaugcuuaagggccccaagguaucaauauuuaaggagugccugccuuucacgcauaguggucuagggagacaagccuaugcuaugggccaugcuggagcuucuuugcucaaaagugacauaacuuuuuuuuuuuuuuuuuuugggaaaaggucucgcucugucacccaggcugcagcggugugauuauggcucacugcaucuuugaucuccugggcucaagugacccuccuaccucagccuccugaggaguugggaccacaggugugugccacugugccuggcuaaaauuuugcccaggcuggucuugaacuccugggcucaggggauccucccccuucggccucccaaagggcugugauuacaggugugagccacugggcccagcccaaaaguaacacaacguauuaaauaacuaagaguuggguagagaaucacagcagucagcaaagaccccacacugcuuccaaaaaugcaaaaguucaagacaggcacauuuggggcaggagggcagcuggcacaaauugggaaaccaagcaacuuuugaaaugaaauucuuuagucuuucaugucaguaaagggcugcuuuagauaguuacugcuuuuaaauacagggcacauauauuaucauucauggcgagauuaucugaacauaaggacaauaaguaauccauuaguuaaaaaucuuuauuaaaaaaaaaaaacuccaaaacuguuuaaagaaaaccaagacaaccggcaaagcuuugaaguuguauacagucaugcacugcaugagacagcggucccauaagaugacaacacuguauuuugacuuagcuuuucuauguuuagauauacagauaccuacuuguguuacacuugcuaccguguucagcacugucacgugcuguacagguuugcagcccaggagcaauaggcuaugccacagagccuagguguguagcaguaggcuguaccaucuggguuugagggcacucuagguguucgaugaaaucgacugaugaugcauuucucagaaagaauguccccaugauugagugauguaggacuguacuuuaaaaaauccuuccaaaaagggccuaugauuuagcuacucaaauguagcugaugaacacuuuauagaugaaucaaaaauaccuuucaagcugcauaugaaaagaaaccacacagcuaaaaaggcuaguaugcauuuaucccuucaagauaaauugacagauacagauuuuuuaaacuaaaaauaauuugacaaccaaaaaaauggaugcccaggggcuacgguuggugcaaacuuuacgguuucuuggaaaaacgucuugcucugaaggcuucaggcucucugaauucugaggucacaugaacggcacugggggucucccuauaucucuuuaaccgccccgucagugucucuccuggaagugcaucaaucuaugcccugagcuccgacguagagggucccacauuuucuaugaccugugguaacagggugccuuguacugucauugggaggcucggcuucaggguauccuccuuugucuuucugcgaugugccugaccucagggaagucaagagaccccgagccaaacccagugggagucuguggugaccaagggcacacagauccuuuucuuggguacauccucugaaagcacguuacugaagugaguguagguuaugcccuuuaaagcaauaccaugucaaugcacaagagaaccauacuggugugauuuuuauaacuacuaccaaaaaggguggcuguguguauacuugagaaucuucaauccccaaauaacacggaacaugugcugugagcguacaggaccucugcagagggaugcuccugccugggagaggcaugagcagggucauggggagucugggaggagagggcagagcgcugggcugcccccgugggugugcuccuccuccugcccuccagccacaggcuggaccguguuaaugcugccugcaugggcagugcaucggccacggccugggcaguaucaggacgcuggcucgccugcaaucccagcucugcgggugacaaaggcgcugucuggccccuucugcuugacucuugcuucauuucucaguucauucagaacucacuuccgggaaaugcagggacagggggucuuauuuguugcaucuccucaaaaacuccaaaaggaaaauacauuuuaauuguaaaugagauuuacauucaauuuucagcaacuugacuucugaauaaaagcaagacagaauuauaucacugaauuuaaaaugccauacauauuuacgcguucgcggguuaggaauaaauaguaacuucucaggcuugaaagcaagucaugaaaagcacagagcugacgaggugggaugggguggaggguggguuuuuauucacaugacugagggcggagggcagaugccaagugagugcaugaaggggcucagcuguaaagaccaaagcagcagaggcaaaaagacuucaauguuuuaggaaaauaaucaagcaaaacacucaucuaaugaacauuuguuuugagacagcaucuuacuuggucacucaggcuggagugcauggcuaucacagcucauggcagccuuggacuucugggcucaagggauccuccugucucagcauccugaguagcugggacugcaggcgggagccacugugcccaauugaacauuuuaauaaaguauacgcguguuuaagagaaaugugaaagacauaucuuuugguuaaagcuuggugucauauaaaaacaguuagacacacacucuuucagcacaggagcccaacuguaaaagcaaaaaaagcugcacucacaaucucugcacagaaacuugaugagaaugugcagcccagcgugugaucagggaguaugguuagacaguuacggggccucauuucucuuccuucuccuccacauuugcacaucuucuuaagggagugugggugaauguuauaagggaaagagggucaacauauuuucuuuaaaaauauaaacagaaagagaugccugacacugcaugcugacauccuugguccugauguccgagugauaguaaaaucugaggcucugaaugaaaggagccccuguacccuccucagggacccgaggcugccucccagcccaagccccgccccguccaguccucaccuaggugaccgccacccacugacaguuggcgcguggaucaugagcucccgggcacugaagccgucuucguguccagaugagcugacgacuacaaauccaaucuuguggggcauucugcacguuugggcuguuuauaagagcaggaaaaacuucuuuaaaacaaaggaauucacuaacacauggacauuuaaaggguugguucaugccuugcuaacacacacaauaaugcacuaaguauucagaauuuucccaucucuuugaaaagagucuauuuuuuuuuguuaaacacuuuuauagaugcuucugguucugcuuaagauaucauuuaaguuaucuugacuuuucccaaauauguguccaaaaaguuugaccagugcuguggauugugcuccccaaaaggauacgcugaaguuccacgugugguacccgugaaggagaccucauuugaaaauagggucucugugggugugaucuaguuaaaaugagguccucggggugggcccaaugcaacgugacuucuaagaagggaagagacacagccacacaaagggagagcgccauguggugacagaggcagagaccggagcaacgcaucucuaagcgggccggccaaggacggcugaggauggccagcaggcgcccaagguuaggaagaagccaggagggauccugcccuacagccuccagagcgagagugcagcccuguccaugcagccaucugacuucugccugcagaaugaauuucugguguuuuaagccaucuaguuuaugauauuuugcuaugucuagaauauaaacacaaacuucuuucuauuaguuaggaaacuaauacaaccaguauguuaauuaguuauacaauaccaaggggaaaaaggcaacguaagcgcuagcauuaacaacugcuaaaugaauguguaugaccagaaggaagagcaggaaugacaggcaggcauauuaaguacaaaaagguucaugcagaguuagguugagggacugacucacaggacauugagcccaauuugcucagggacucuggguuacuuuucaguuacuaagccagucagauuccuccuaaguaagccaauuuggguuaggucuaaaucaucgggggaaaaaaaaaaaggcuccucacuaaaccaggauaaagaagacuccaucagaaaguucucugggauaagauauacuauuaauugaaauucccaauaggagguaacauauaaacauacccccacauaaaacuguacguauuuugacaugcuugaugcaugaucuagaucuuucuuuuacuuucauugagaauucgaagaggaccacuucaauauauuaauuauuggcuggcauuauugcuaauguuucuuggaauguaugaacaaaagcacuaaaauagaaugauaaaccaucgagauucuaguuauuuuuugcacaaaguucacugcaagauguuacuguauauuaaacaaaaacaaaacuaaaccaacucagaaaauaauuuuuaaaaagccccccagaacaggaugaggcuggguguggugguuccugccuauaaucucagcacuuugggagaccgagguggaaggaucacuugagcccaggaguucgagaccagccuggguaagagagugagaccccguuucuaaaaaaccaaacaaaaaaagaauuuugaaaggaugagugugauuuaacccacuguuagcugcacggccccaccugcacucugggcaaccuaugccagaaacgcacagcccauggcucccacuccuucgugaccuggcacuucugggucgcaugggcucugagccuagagguacuuuucccuuggccacagcaucucucuucacccacuccccauccaacagugugccaggucuuaucaggccugcccuuccuucugaucccacugucuuuucuagacagcaaccaccugguguccccaccugaagcgccucccucagacaaguccuaaguuccuauugugugaacgugccucaggcccagcuccagucaucuccauccauguccuaacuccagagcucuuggugggcuccccaucuagggaucaaugcgccaacucuccccugacccucacuucuuguccugaauucugaaguccagccaaacaaucaaagcucaaaguuaauacccuucagcucugaagcccuccaauccuuucaucagcuuuuuuuccuuuuuugagacaagagucucaaucuaucacccaggcuggagugcaguggcgugaucugggcucauuguaaccucugucucccugguucaugugauucuugugguucagccucucaaguagcugggauuacaggcaugcaccaccaugccuggcuaauuuuuuuuuuuuuuuuuuuuugguauuuuaguagagacgggguuuugccauguuggccaggcuggucucgaacuccuggccaaucugcccgccuuggccucccaaagugcugggauuacaggcauaagccaccaugccaggccccuuucaucaucuuucagggcagggcuugucacucccuauuccaccuugaaaauaccucuugugcccaggcuguuggguuccagucuccaaauuuuuuuuuuuuuuuuuuugagagagggucucacucugucacccaggcuggagugcaguggcgugaucgcggcucacugcgaccucugccuccuggguucaagugauucucccgccucagccucccaaguagcuaguauuacaggugcgcaccaccacacccagcuaauuuuuguauuuuuaguagagaugggguuucaccauguuggccaggcuggucucgaacuccugaccuuaggugauccacccgccucagccucccaaaguguugggauuacaggcguggccaauaagcccagccccgauuuuuuuuuuuuuuuuuuuuuuaauacagguucucgcucuguugcccaggcuguacugcugcaguggcgugaucauagcucacuguaaccaugaacucucgggcucaaaugauccucuugucucagccuccugagcagcuaggacuacaggcacaugccaccaugcacagcuacuuuuuuuuuuuuuuuuuguagggaugggguuucacuguguugucuaggcuggucuugaacuccucccaccuuagugucccaaaguguugggauuacaggcgugagccgccgagccuggcuagucucugaaccuaaccaacacucucuguuacggcucgaagacauaaauauaggaccuuuucagucaaacagaaggguguuuccaguaugcuauacugcccccaacaaaucuaaaacaaaguacuggcauuuaagaaccagcuaagagaaaugcacagggacuguggaggcaaugcuauuaccucagucugguauuugaaaaggauuccuuuuuuagucuacccccucccaaagaccuuccaguuguacccuaggguccccucuguguaaaccuucaaguguuacauaagauacuuggaaugucacugaaggaugccacuuuuaggcucuauaaaaaucaccauuaacaauuugggaagaagcaaagcucuguugaacauccaguuauuggcuggucuuccucaccagaggcaugagggaucccuguugucccaggggcagccaucgacaucccgacaaaugccagaguacaucucuccccaggcagcgaugacuccauggcggucucaucccucacuacacuuuuccuagugcuggcaugguaaaaggcaauuaacuauaaauuaaacggaaacucaguguagcaacuuccauuuuguuacaagacuaggaaacaaaacuugucucugauuuucuuuuuaagaagacuuuuaagugugacugcgcgcgguggcucaugccuguaaucccagcacuucgggaggccgaggagggcguauuacuugaggucaggaguucgagaccagccuggccaacauggugaaaccccgucucuacuaaaaauaaaaaaauuagucgggcuacucgggaggcugaggcaggagaaucgcuugaacccgggaggcggaggcugcagugagcugagaucgugccauugcacuccagccugggcgacagagcgagaccgucucaaaggcuuauggguuucugaucaagucaucuuagcgacugaaagggcuucagagaaaucugaacuuaagugcaaacaaaacaaaacaaacuccaaaacaaaaaacaaccaaccaucagacuuuaaucucuauagggacagagcaauuuuccucaaacuuuugcucagcagaacacaucugaaacuggcccccuaugugcuacgcauccagaagaggaaaagccggaucugaaaacaauauuccacgcuaaaugggccgucccggccggggcaggcggucccagcacccgugcugagcuccccggcauacggcacgacggggccgcgccggcucuucggcgacagcaaggccggcaucuaacuccacaccguccgcgcuugcaccgcgcacccaggcuucguacccagcucccagguggggaccgcgcccccgcggcgcccgcgccccgcgccccgcgccccgcuccccacuccggcccugggccggcgccgcagcggcccggaagguaccugcuuagagggaagggccccgacuggcgcugccgcggccccgguggagagggcggcugggucggagcggugccgcggcccggggaggcggccaggcggcgccucagcacccggaccccaggggcgugcgggacccggcucucguggacuuccucggcagccgccgcuuccucagacggaacucggggggcgccccuuccgccgccccaggccgccuugcaccccaagcugcugcggcagugacagggaagaagcagacccggccaccucugcccauagccccggccgcagccuccacucucaugacaaccaagcccagcccugggccagggccucugcgcgugc

SEQ ID NO: 191439 - RNA, 16285 nt, Homo sapiens
gauggugcauguaguuuuauuuauguguuuucaucuggaaaaccaagugucccagcagcaugacugaacaucacucacuuccccuacuugaucuacaaggccaacgacgagagcccagaccaggauuccaaacacacugcacgagaauauuguggauccgcugucagguaaguguccgucacugacccagacgcuguuacguggcacaugacuguacagugccacguaacagcacuguacuuuucucccauaaacaguuaccugccauguaucuacaugauucagaacauuuugaacaguuaauucugacacuugaauaaucccaucaaaaaccguaaaaucacuuugauguuguaacgacaacauagcaucacuuuacgacagaaucaucuggaaaaacagaacaacgaauacauacaucuuaaaaaaugcuggggugggccaggcacagcucacgccuguaaucccagcacuuugggaggcugaggcggguggaucacguaaucccagcacuuugaggggcagagguggacagaucaugaggucaagagaucaagaccauccuggucaaaauggugaaaccccgucucuacuaaaaauacaaaaauuagcugagcuuaguggcacacaccuguagucccagcuacuugggaggcugaggcaggagaaucgcuugaacccaggagacacaggcugcagugacucgagaucacgccacugcacuccagccuggcgacagagcgagacuccaucucaaaaaaaaaaaccaacaaaaaaacuggggugaaaaucuaacggauaauucagcauugccgcauagaaaccuccgcaaaaccggccaaacaaacgcggacaggcggcccuggcgucagcgcacgacagucacguggggaggggcaguggccaggucggccuuggacggguacaccaccuucaggcucccuuccagauccaccacccggaccugcuccaccaccagaagggagggcccguccuuuccagcacugggauucguugugggaucuggaaguuguccagagacugcaucggcuucaguaucugagagugauccuuccucuuuauuuucuaaaguguacuuuuucauuucugccauuuucugcaaauaaaaaauaccuuuuuaaccuggagaugagaggugacccagggaagacaugcugcugucugccaacacaguaagcaaaaaagaggcaagcaggacgggugggaagucaaggagcagagcaccacucacgcucaaaagcguuucucaggaggagccaccccacacucaccagaaugagggcauccaugacauccuugcaaaucugcagacugguggcacuuguuacuuccaaaaacaaaucagaagucguuuucuuaaccuuaaaagaaaaaaacauuucagaaaagaacaguuaucaaauguagacaucagcaacugcaacauuuguucucaggaaaaaucuacaaaacuguguggccaggcacaguggcucacaccuguaaauccagcacuuugggagguugaugugggaggauugcuugagcucaggaguucaagaccagccuggacaacacagcaagaccccaucucuacaaaaaaauacaaaaauuagccagguguggugccaugcaccuguggucccagcuacucaggaggcugacaugggaggaucgcuuaagcccaagaguuugaggcugcagugagcuaugaucuugccacugcacuccaacuucggcaacacagcaagaccuaucucaaucaaucaauuaagcagauggcgucacacacaccaagcccacuccuuacagaggaagacugcagugcugcacacagcaucccgggccgucacgcagcaccgagcaugaacagugagcuguagcucugagaagccagggggcccuuugaccccucugggcugcguuuucuauugcacacaaugaaaccucacaaugcagcagauacuuguguguguuaauucuuuuucuuucuuccucuucuuuuuuuuuuucuggagacggaguuucacucuuguugcccaggcuggaguggaauggcgcgaucucgacucacugcaaccucugucuccugggguucaagcgauucuccugccucagccuccugaguagcugagacuacagguaugugccacuaugcucagccuuccagguucaagugauucuccugccucagccucccgaguagcugggauuacaggcaugcaccgccacgcccggcgaauuuuguauuuuuacuaaagacaggguuucuccauauuggucaggcuggucuugaacuccugaccucaggugauccgcccaccucggucucccaaaaugcugggauuaccgguguugagccaccacgccccgcagacuuguguuaauucuacagggaacagccuagaagacacaccauguucacacacaugccacccuaccuuugucuucucacuguugguuauuggugggaaggaaaucacaucaccgucugcauccacaagacacggguaauuuucauuuccauccagcaagugaagguaucuguaugggaagaaauacaaauuccaggcauaauuauaaaagaaacacugugcugggugugguggcaugugccuguggucccagcacucaggaggcugagacaggagggcugcaugggcccaggaguuggcuggggugugcugugccaauggagugucuacgcuaagucugucaucacuauggugagcuccugggaguggaggaccaccaggcugccuaaagaggagugaaccagcccaggucagaaacagagcaggacaaaaagcuccggugcugaucaguagugggacugcgccuaugauuagccaccucacuccagccugggcaacauggcgcgaccacaucuuaaaaaaaaaaaaaaagaaaaaaggcacagcugggcgugguggcucacgccuguaauccuagcaguuugggaggcugaggcaggcagacugcuugaagucaggaguucaggaccagccuggcuaacauggcgaaaccccgucucuacuaaaaacacaaauauuagccaggcaugguggcaggcgccuguaaucccagcuacucgggaggcugaggcggcagaaucgcuugaaccuaggagguggagguugcagugagccaagaucgugccauugcacuccagccugggcgacaagagugagaccccaucucaaaaaaaaaaaaaaaagcacacaccugaaaacauaccuaaaggguaaaauggacgacucaaaaaguucuuuacacaaauuaaguguaauaucaagggcccaagcauaacaagcuucaaagaacaaaguauucugaagccuguguuuacagaaaucacugggcuaguuacggaugaucaucuugcuuagagcagcaccaaggacccugacuuggaugauacccaacagcgcacgguauggauaaaaugcuguggguugggcuggcauuuaugucuguuuccuaauggcuaguuuauauccuguccugucccauccugagggccacccgcccccuguggaauggccaauaccuccgcuccuaacaccuuccacuucccucacgucagggccaucuagaugacagacugguuccacaacgucuccuuuggaaagagaaugcuuucuuuguacccuguuaagaagcuucuggguucugguagcauuaggcgguuccugaggagcacagacuaacucagcugaggccagcaugcggcacucccccgggcccggccccaccccaccaggcacgcugcccaccugugcaggcccgacacacucugccgcuucuucugcuuccucugcuccucggccuccagcugcagcugccgcaccagcuccuuggccuuggcuucuuuccgccccaaggggacaaucuaucgggcagaaacccacaaacuccacuagggucacagccacagaacucgcccaucgugucgauuacggccuuaagccucaaugagcccucccgacucccgcccucauucaucucuacagcaggcagggagcaucccacgggaccacgcagcaagaagcugcaugugggcugccacugcagcgucccggggagaccugacgcccaaacacaccgauccuacugaggcagggcuuaaccuuaaagccagcucaugcacaacuguuuccagaggucugccauccucagaaggccaaaagaggagagaaaggcugagcagccgggaccucgugcacuccacagauucaacagcccaggacagcacgacacagcaacucacccuacugccaaccccacgcaaacgguuuuacuaucgggacagagaccaaaauuucugauuaaaagguagugagcgagugaaggaaaccauuuucccaacgacugcucauccgccgaguccucucacagcugugcaccgcuucgaguaaccgcaaacgcggucuguuucauuauuucaugucuuugcaagaacagcaucggauccuacucuaaagaaaauguucaggccgggugcgguggcuuacgccuguaaucccagcacuuugggaggccaaguugggcggaucaccugaggccuggaguuugagaccagccugaccaacauggagaaaccucgucucuacuaaaaauacaaaauuagcugggcgugguggcacaugccuguaaacucagcuauucgggaggcugaagcaggagaaucgcuucaacccaggaggcagaggcugcagugagccgagauugugccacugcacuccagccugggcaacaauggaacuccaucuccaaaaaaaaaaaaaguucgggcugcaguagcagcauggcgucuuucgacaccaaggagacucuucagcagacccugcaaaggaggcugcagcaccuugagguccugugggggccgggcgcaguacagcaggggcccuuugacggcacggagcucguggguggcaaggguggcagccguccucuucucacagagaucuucguggagcuuggucuguaacacagaagcagugaugagcaaggucucuugugcccugaagcccagcgagguguccacacuucacccuuggcugggcugugugccaggaaacccucccgguccaaggucuucacaaccacgccacgccccuuuccgagacagggcuccccuccaacuccucuccacccggccagccaggcacucacuuuguggaaucaccaucaggaaaacuaucuuaaccuaucaaucagcagacuuucuuccuucucuaauucugacauaauauuugagauuucaaagaacccaucuugaacuaaaauguaaauaaaggcugagcuuuaaguuguaaagcccuggcugugaugccuguucccuuccuccccaagcugcaggcaggacucucacgacagucacucucggcccgccaugcucugucgcugccacugcggggcgcacgagacuuuccccugggcacagaggugcuuuauauuuuaaaaguuggucaggugucacagaaaagcaacugggaaguuagucuugccaaaaccuaaacaauucacagaagaaugugcuggcaagaguugaugacuuuaauacugucuuacauaaaacaaaaugugugauuuacugcagaagucagaaaacccaccaaaauaucaaaaaaucaaggaacccugauuuuccuuuuuuuuuuuuuuugagauggagucuugcugugucacccaggcuggaaugcgguggugcaaucuuggcucacugcaaccuccaccucccagguucaagugauucuccugccucggccuccccaguagcugggauuaaaggugcucaccaccacgccuggcuaauuuuuguguuuucgguagagaugggguuucgucauguuguccaggcuggucucaaacuccugaccucaggugaugcacccaccucggccuccugaagugcugggauuacaggcgugagccaccgcaccagcuggaacccugauuuucaacugcaauaaagcuauccagaaauuaggauaggccaggugugguggcugacacccguaauccccacacuuugggaggccaaggcggguggacugcuugaggucaggaguucaagaccaaccuggccaacauggugaaaccucaucucuuuuaaaaauacaaaaaaauuagccagacaugauggugagcaccuguaaugccagcuacucagcaggcugaggcaggagaaucacuugaacccaggaggcggacgcuacagugagauuagacugcgccaccguacuccagccugggagacaaagcgagacuccuuaaaaaaaaaaaaucaggauaaaccguuaacaccauauguggaggagcaagggauacgaccagugaccaggaccaaccaggccagggugcaggcgucugugaagaggccaucuccacgcuggagacaccugccucccggaggggacugaggccuuacccccuccucagcaacaccugagccagaaccugcucuauucccuuuuuggagcugaggaaacugaagcacacagacacccggcugggccccauacuccacugcugcuccuucggacacgcuggccucaggaugugucccagcuugcggcgucucacaccucugucccagucaucugaggacccccacgggcacccaccugcgaggugaggaagcgcuugagugcauucccuggcugcagguccaugccucgcaccacggcccccacaauguagggccgcacaucccggaccucggggcucacucugacugucagagguacgggguuuucagagacgugcaggacccugagcagcagccggccggcaucucccacguccugcuccuccccaucaccaccuucccgccucugcuuccucucccuccucuuccuccggcucucuuccuucuccgagcccucggcacggcccuugcccuucccgccaccacggccuccgacgcgcagguacuccaggauggaucuggucuggcagccgcugaccaucuucuccaggcgcuugucccucagcuuguucccacggaaauugaucuccuugagcuuggggcaguccgcaagcucugcagggaucucgcucagcugguuguucgagagguccaacgucugcaaagagaaacauggacgcgucagacgcccggacucugggaagagaguccaaggucaugcucgagaggcagggagaccacucaucacucacaagagccaccacuggccugucuguggggacgcgucccuggggagccacaagucauucaccuuugagucacuuccccagcucugcaccccacaucaaaggcacuauccgaggagccucuccgaggagaaggcgucagccacgguuaacagugaucucugcaaaagcuucugacucaaacaugucacccucuuuaacaaccacagcagcccugcagcucaaucaucacguuagagaacagaaaggugacaagagacaggggaugucugggugugaaacgugaccucaugucgggaccuagccaggacugcucaggugagaagcagguuccccaaagugguguuauuuuuuuuaauuaaaugagcuaaaaaaaaaauacagcaaaaucucuaagagcauucuucuucauaaugaagugcaaaguugcccgcagugacacacagagugcucucaggguucacgcaggaaggaaaggggaaagccgacuucaacggcgauggguucucagccuucgucugacccaggacaggugcaucgggcccaccaccgugugccacaaagaugcccaggaagccccguggcccacgggaaagcguuuucuaugaccgugacugaucagacuuuggcaaaacgugcaggugaccucacugaaaggauggaagggguacaguggcaccugaugcacucuuaggaugucuuucccagggucugggcagcgcagggaacgugcgugugagggcagccacuuccaugacgugaggcggccgcugcagguucaggcaaaaggggcccauccgccuccacucugcucuuuccuggcuugguacccaggccccacagccuugccugggugguggggcaggcacugcgagcaaacccuucugucccagcuuccucuagggcuggaggaagacccugcucaggaugcaaagccugacccucggggaucucuggcagccucggugccggcucugcccccagagaggaggcaacagcaugugggcccccuggaagccagcacucgcccuuggucaguguggcuggugaguccuaguuacacuggguguggaggagacagguagggcuggacuugauagacucugaacagaguuggggaugggcugauuacucagaggacaccuccugcuucgccuggaauggauggcaggggugauggaauuucucaagccccaaguugugaaggaaaugaaaaaaggaaccugcuggaauccuccggcucaagcaaucaagcugcucagacacggguaagggcagcauggcucagaaaugggauggcgcucagaagcgggaaggguggcacggcucagacaugggagggugcacuggaugaguucccucagggagaacagagacccagggaggaagcgacaacuuaacagucaagcaggaacagcauguguaaaagaaauaaaagggcucgcgugcccucugggagagaauggggcagucuaagcagcagugacgccugcuggggaagaacacaaggcaggggcugagaccaagcccagcugcugggcacuaccugagccacgcguccaucggaucuaacagaacugccacaauucugugcuucucagcacagggugggcugggcugggauagacuuguuggacugguggcuccagcccagaccucccuuccggccccacaugggacgagagccaaucuacuccuggaauccagguggccucacaaaguaccaggagccguaucaccaaugcugucgccagccugcagcaccaggaacagugcggccgugagcucagccuucuagagcuccucaccucccugucagagcccuggcuccagcguuagaaccagccugggccaccagcccagggcacagccugccuggcagaggccaagggaagcucugagguuggaagcucgggggcacaggcaucugagguucugcucuguggguuucugcgcugcccuaaggggcuuuggucaaaaagcuugagaguuccccucaaguggaaccuccuuucugccugcaaacacgcagugcggcgucucccuccgcugacaaagagcaaguuccuucagacccaggagcagcagcagaggcgaaggaggcgggcggggccccaccggggcgcccagagcagccacagccaguucagccugcagccugcagugaguccccgaaaggaugauggcgggcacucggagaagggucuuccuuccaggcaaagacugucagagaaagggcaucugagcagcucaggaccugccuggaggcucuguggggagucaggggacaggaagggaagcgggggaaggagagcaagagggagggcaagagagucaccaucuggguggggcgcaaagccgcacauguuggggaguccuugucagaaaugcaaggcccugcugacgaggucgcacgcuggccccucaggccagcacugggcacccaguggcggccucagcaggaaaugaagccagagauuucacacaugaaggguggaugaggguggcgucaguuuucacuugugugagggagcaagcaggcgcgcccgcaaggaugugaggugcacacuggcuuuggggaggaugaguuacacaggggguggcuagggguccuccugacaccugaugggaugaaaugccgucaccugucacccggagcugacacucuacugcaggaaacacaacccucgcaguggcuaagcugacggcagcaacguggguccugacucuggccuggcauaccggcugccuuccgggcccauggcuuuugcaggggaccugcugccggggaaggauccuaacuucaugguggugacaggcugacauaaaccaacccaauaaggagcgccagccccugagugagccccacucccuccggcagcaacugagaaacucggaagcugggggagagccuuuggcuucaggaggguucacauugaggcugaacuccccugugcagcuuggccuugggaggggaguggcccagggccugaaaggaugucuuuacuaaggcaccguccugcccacaucagcuguucagguaacaucugucccauccaucccucauucccacacggacaccacacgccugcgugauggccacuuacaaugcagucaggagaggugugacgugcccccauccucggcucaccacagcacugccagcugagccccacgggccacagcagcgggaagcagccagggagggccggccgggugcucucaggucucagcaagccacguggcucugaggccaggacacuggggaagccaggcucccacgcaggcagagcuacugcugaggccauaggacagcagaggccucguccccaguggcugggaggaaagagggucagggccuuugcacugcaggucccagcccaggcuugggggugcucccuggggaauggcuguggggaugggcacuaggagccaggccgagcugcuuccauuugcagucucgccccucuggggagggaaaggacaggcagaagcucugugcuguuauuuuggcggccccuaaagagccaguccucccaaagaaccggaacugggcucgcacuuaguuaacccacggaacgcaggaaaguggcaggaagcauguuccagguugaugccugaagaagggcuggcagcugcugcuuuuguacugaggagcccugagcccugugaaagaaggggagggagaggccccgagacgacacacggagaagcccacccaccccggcagcccagcccugagcccacgccagcugagcacagccacgcgagcgaccagcagcaagagcugcagcacuguccacuguucacuguccacugucuggcggagccagcccagagcgcagagccgcugcugcuuuaagccucgugguuucggagucaagcagccacaaugaccagcacuaccucccccaucucuuucccucuucguguacugcguuacccucccagucuuccuacagaggagcaaagagccuucaagacccaacggcacgcagccacagagagacagggcuggagcccgugccuucuguuuuuuuuccuuuccucccccuucuuucucuccuuuuuucuugagacgaaguuucacucuuauugcccagacuggagugcaacagcaccaucuuggcucaccgaaaccuccgccucccagguucaagcaauucuccugccucagcuucccgaguagcugggauuacaggcaugcgccaccacgcccggcuaauuuuguauuuuuaguagagacgggguuucuccauguuggucaggcuggucuucaacucccaaccucaggugauccgcccgccucagccucccaaagugcugggauaauaggcaugagccaccgcacccggccucucucuccuuucuuuaagacagggucuagcucuguugcccaggcuggagugcaguggugugaucauggcucacugcagccucaaccucccagguuuaagcguucaccccaccucagccuccugaguagcugggacuacaggugcacaccaccacacccagcuaauuuuuguauuuuuuauagagacagguuuucaccauguugcccaggcuggucucaaacuccugggcucaagugauccgcccgccucagccuccugaagggcugggaugccaggcaugaaccacugugcccagccugccuucuguuucugagcucaguuuucugguuuucuacacuccccaucuccccacagcaccaggaaggacaucaaaugcauuugccuuugugugcgaaauuccaaugugcguagcuacauugcugggcauaguucugguagccauuccucagaaagguacccaaaaggacaucugagugcaacaagggauuccaauagcucuugcaugacccuccaagaaacaggucuccugauagagagccacuggacgccuaaaauuuacgaacagaauggcccaggggaaagggaacuuggccaccucuuuugggauuuagaaaacaagacacacucuuugacuugaaugacauuguuuugggcaccauaaagaggaaugcuuuaccaggcaggugcuacagagagcuggacgcacacuuuuuuuuuuuuuugagacgcagucucacuuucucacccaggcuggagugcaguggugcaaucucgguucacugcaaccucugccucccggguucaagcgauucuccugccucggccucccgaguagcugggacuacaggcaugcaccaccacacccagcuaauuuuuguauuuuuaguagaaacgggguuucaccauguuggccaggauggucucgaucucuugaccucgugauucgcccgccuuggccuccuaaagugcugggauaacaagcgugggccuggcccacaacacuuuuaagaacuugaauacugaaagacaucuaugaauuugaagagaaauauugcaacugacuggacacuuacaugauguaaggcacaauguuaagauacaugccuaguacaucaacacucuggaaaaccaaaaguaucugucaggugggaaggugggaguagaccaugcuguauccaacaucacaccuuaguccuagagggaugccuacagcccugaggaccaaggaaaaugccagugaacucgccucuuccaggaaaugccaaugaaaccaccuuugcaaaaacuguaacagugagaaaauuaugguggugaaagagaucugaucuaaccaauccccaucuuuggccuuccaacuaccuuuuuuuuuuuuuaaauggaguuuugcucuuguugcccaggcuggagugcaaugguaucaucuuggcucauugcaaccuccgccucccggguuuaagcgauucuccugccuuggcuuccugaguagcuaggauuacaggcaugugccaccaugcccagcuagagauggguuucuccauguuggucaggcugguuuagaacucccgaccucaggugauccgccugccucagccucccaaacugcugggauuacaggcaggagccaccgcgccuggcccuucaaacuaccuuuaauuauuccugggcuugggccaagcuaacuuugggagacauuuguaauuuaaaugauaauacuccuuccguaaaacucaacugccuuuguaaagcuaaugaggguccacgaggauaggaggauggaggaaccugaauucugcuaagggguagacauaaacaacugccagcuauucuucuggaggucacaagauaugcgacuuccccagugacuccugcagauaacagcacuagcagcacuguggaaccuaagaccggccuucugagcugugucuuuucaggguuuuugcaugucugaucaauggcucuaccugaaaccaaaaagagcuccccgcagccccagccagaagugacucaguaagcaggaccguuucccacaccccuaugauugcaccucaaccaaucagcagcaagcacccguugccuagccacccuccccuuuccccaaacuauccuugaaaaaccccgccuccaaauuuuuggggaagcugauuuaguaauaaaacucggccgggcgcgguggcucaugccuguaaucucagcaccuuggaggccaagacaggcagaucaugaggucaggagaucgagaccauccuggcuaacacagugaaacuccaucucuacuaaaaauacgaaaaauuagcuggguguuguggcgggcgcuuguagucccagcuacucgggaggcugaggcaggagaauggcgugaacccgggaggcggagcuugcagugagccaagguugcaccacugcacaccagccugggagacagagcgagacuccaucucaaacaacaauaauaauaacaguaaaacuccagucuccacuuuagcuggcucuacauguguaaaacuuucucuauugcaacccuccugcccugauaaaucagcucuauccggguaguggauaaaaugaacccauugggcaguuacaucaguaaccaugugucacucuacaguggguuuguuuuuuuugccacagggucucgcucuguucaggcugguaucacagcucacugcaaccuccacuuccugggcucaagugauccucccaccucagccucccgaguagcugggacuacaggcacgcgccaccaggcccagcuaauuuuuguauuuuuguagagaugggguuucaccauguuggccaggcugguggugugaccucaagcgaucugcccgccucagcuucccaaagugcugggauuacaggugugagccaccgcgcccggccaggguuugucuauauauccuuauauagauauguuacuuguaaaaugaguugcaaugucuugaggaauugcuacagcaaauaaauagauaagcugcuaaaguguauacguauuuuauuaagaaauguccacauaggccaggcgcgguggcucacaccuguaauccuagcacuuuggaaggccgagacaggcggaucacaugaggucaggaguucgagaccagccugaccaacacagugaaacccgucucuacuaaaaacacaaaaguuagccgggcgugguggugugcgccuguaagcccagcuacucaggaggcugaggcagaagaaccgcuugaacccgggaggcggagguugaagugagccgagaucgcgccacugcacuccagccugggugacaggaccagacuacaucucaaaaaaaaaaaaaaaaaaaagaaaugucugcauaaauucaaagacgaaaaaugggggaagaaaugcaggacugccuuaaggaugaaaccaaaagagaagauggagagaacaucuggcuggguuuaggucgugguucugccauguggcuucccuacuuucuuuuaggcaacagauucaaugggcaccuguuauaggccaagcauuaucgcggggccuggggauccaagauuaauuaguaaacagacgcuggacaauauagucuggagaaaaacccaaguuaccugcugcuuacuuugggcaggcccuuuggcuuucuguaaaacaggaauaaccaccccuaccuuggaaagcugcuauuaggaugaagugaaauauaaucuucaagaucacagcauguggcauuaugcaaaauccagggugcccccuucaccaccagacucacucucaagucacuucacaaguacuagauacaaaaaagacaggucucuacgcucgaucuacaggagaagccagguuugcuaacaauuacaaaauagcguaccacguguaaaaguccaguuaacagaaugcgggggaguucagaggccaccuaguauguugguguggccaggagaagggggaguuggaaggcggcaucugcuucccaggggugaugccccccgcagcuggcuccuuucagccuuguaggaauucccugggcccagugccccagggggcgucacuaggaacugcucggccccgagagggguuccuucuccagggcuacuccaaggccccaucccgccccgcccgggcagcccccgcugaccuugagcgaggccaggugggcgaugucggggcugaguucucggaggcaguugucagcagccgccaguucacugagcaggggcagcgcgccggggcgaaagagcucggcgggaaaggagucuaggcaauugccggugagguugaggcucugcaggcgcggggcgcagcgcgccaggucggcuggcagcucgcgcagccgguugccgcugagguugaggcucugcagcugcggaaggcccggcggcucggcggggcccaggccuuggcccggcggcagcgccuccagcgcguugcccgacaggucgagcacccgaagggcaggcagcggcccgagcucggggcucaggccgggccccagcgcguugcgccgcagcacgaggcugugcagcugcggcaggcccugcgccaggccaggccccggcgcgcgcaagcucccgcagccgcucacuuccaaguagugcagcagcggcagggugaaaagccgcggcggcagcugcccacccgccgcccgcacucgcuccuccagcccgggccccgucagcagcagcucccgccgccgcucgcgcucagccagcuccagcuccggccaagacucugacaccgcugccgccgccauggcgccucagcugcuggcaggcacccac

SEQ ID NO: 191440 - RNA, 22545 nt, Homo sapiens
guguguguggcgccugcgcaguggcggugaccaccggcucgcggcgcguggaggcugcucccagccgcgcgcgagucagacucgggugggggucccggcggcgguagcggcggcggcggugcgagcaugucguggcucuucggcauuaacaagggccccaagggugaaggcgcggggccgccgccgccuuugccgcccgcgcagcccggggccgagggcggcggggaccgcggguugggagaccggccggcgcccaaggacaaauggagcaacuucgaccccaccggccuggagcgcgccgccaaggcggcgcgcgagcuggagcacucgcgugagugcggcggggcggggcggcgcgggcgggcgggcgggacgggccggggaagcgggagcccuggcccuugccgcuccucgccgcugucggcagccacuucccgggcgagacugcgcccccggagcacccccggccggagccgugucgcgugccgggaggaucggacucuuuccgucacccguuugcaccucugcagcugucaggagcgggucaggugcggaaagcggugcggagguggcgcucauagguuacaggggucagggucuggggcuggccguggucuucaguuaccgccgagcgugcgggauccuucugcgcuugccgccuccacguggcacaggccaaggcguggccagauggguagauggguuuguugggugguugcuagcaguuuccacguaacaagggaagcguauuugagaguuacuugauucuaacgagacuagcagauuugcacuucuuguuggaagacguuagcauuugcacggcgaggucugugaagccacaggccaggccgugcugcucagcuugaguaaaccccugacccaaggcccucagggugugagcacucaccauguuguucaggcuggucuugaauucuggccucaggugauucgcccaccucggccucccaaagcgcugggaugacaggcgugagccgcugcucauggccuuccucgguaauuuuaaccaucagguuaggaugggaaucaagggcuggacuucagggcaccucggaggacagcggauguuggugacugacuuucuugcugcaggcuuauuuggaggguuccuuuguguccuaguuccuggggguuuucacccgcuaacuucacuuagagauugaaacuucucccacuuccagaagcugaaucguagugaucagccugcggcccccugcagugguacaggccugguugagcagccucaggccgccuccccauagugcagaccugugccucugaguugcuccaguccuggcggccccggagcuccugacccgcaguccgcucugccggcguugccagugccuuggucugcccucucugugguggagcggggcccggggcagggucuccaggugcaccguggggagcccuccaucaggcuuuuguuuccuguggauuguguuccaggugugggcucuuucauucugaucccuucccuccuuccuggccucacugcuggcaggugagagagguuucuccagaguugacugcccccuuuccccgggugcccccugcccugccccucugccugguagccccucugcaagcccggccccucccgacgcuccuggcuuccuccgugccccuuuccuggcagcgggucgccgagauucggccggagcccauugcuuuguccuugcugcucuccaggcaaacgggcggcuccuccucaccgacugccuccucugucccuugaggcuauagccccaugccgccugguucccagagugcccugaccccuccuccggccuguccuuggaagucacagcaguacauuaucccagaacugucugugagcaccagcgcucgcccugcacuccacagagggggugccuggaggagagccucgugcccugugggugugaauucacgcgcugggacgcacgucccuggcacagggucacaccaaaguggugaaugauuguucucacucuaauaaccgagaggccacacgggcaccugaccugcucuuuccccucuccuccuccccagagucacuggggguaggaacugucaaugagccauuuucaggggagggaguggccucagcuuaauccagccaaagguccccucgggaggaaacaggcagagcuccucaccgugacacccacguuccugucacugcucuguggcaggacccugggugacugacacacccucaguccccucggggucagagugagagugguugagagcccggggucgcuucagcccuuggcuucccgagcuuagcagccaaacccguugaccuggcacugucuucccugagaggcaggucccggucucaucugugcucuguucacuggggcccccgagguuagcuaccaaggcgcuuccugaaaucugacacugaugcccgucagcccaguucgugccuaaccacaggcccaagcagacccaccccaacaccaaagcgucgcugccucugucuaaaugcaacgagugcuccccacggcacuucccccugcgucagucaccuccaaaaauuacaccugagcugagaacagacgcugggcucuaguuagugacguguuugcugcaguugacucugaaggcuuaaaaaagugagacgggcugcgggaggaagagagacgggaacaacgcaccaacccaggagcaucgggggucccugccuacuuuacgugucuuucuguguuagcagauuuauauguuuauuuauuuauuugagauggaguugccguccgucgcccaggcuggagugcaguggugcaaccucgguucaucgcaacauccaccuccuggguucaagcaguucuccagccuuggccucccaaguagcugagaucacaggcgugcaccacugugcccugcucuuuuuuugucuuuuuaguggagacaggguuucgccauguuggcccggauggagauuuuucuuuuuuaagucucucucugucuagcuggagugcagcggugcgaucuggguucacugcagccucugucuccgggguucaagccauccucccaccucagccucagaguagcugggauuacaggcguccgccacugcgcccagcuaauuuuuguauauuuaguagagaugggguuucaccacauuggucaggccggucucuaacuccuggacucaagugauccacccgucucagccucucaaagugcugggaguacaguagugagccaccgcgcccagccaaaagauuuuuaugguaaaguuuuaugaugggaaaacugucaucccagaaaauuuugagaccugaugcugaggccucagcagcucagagaauacguacuucugucccacgacacccaaacaucgaccugugucaguuccccucuaggaacaaaacguaacugaggacguugucagaugcuuguccucgucacccugagcuuguuggcugguauccuauucuuauucauucccuuucuugccugcaugugcuugauagcagaucaaugacaacagccauuggaagcuuaggaaaagcgaauguaacgugaaaaaauagaggacacuuuagccaucgccugacuuucuguugaauugggaaagagccuccucccguccacgugggauggccuuccugauguggcucuccaagaccaucccuggggggauaaaaccucacaaaugcaucaggccgugugcuggggauggugcaucgucacgccaggucugacuaggaaggaggauggggaggcagggcugggggcuuugaggucgaggcguggccguggauuccagaaagccccuuggcuggugugcgugccugcccagcggcauccguguauccuaacaccugcccuccguguccuugcgucugcagguuaugccaaggacgcccugaaucuggcacagaugcaggagcagacgcugcaguuggagcaacaguccaagcucaaagugaguggggccgguguggguggggaggccggggcgcacaugggguucgggcauggagauugguagggcuacugccgguggguagggccggggguguguacaugggcagcaguggggcccagggccaagcuugggcgccucauuucacagaaggaaacaaagggaggugagagacgcugccgcagagccgcccgagagggagggcugguguuggugagggcgucuggucguccggagggagggccgguguuggugagggcgucuggucguccggauggccuggaucuucucauuucauuacacucagcaggauuuuuuuguuuuauuucguuuuauuuauuuauuuugaaacggagucucuguuucccaggcuggaguucuguggugccaucugggcucacugcaaccuccgcuccuggguucaagcaauucuccugccucagccuccugaauagcugggauuacaggcacccgccaccacaccuggcuaauuuuuauauuuuuaguagagucgggguuucaccauguuggccagccuggucuugaacuccugacuucaagugauccaccugccucggccucccaaagugcugggauuacaggcuugugccacugugccugccuuguuucauauuauuauuuuuuuauagacagagucuuagucugucuuccaggccggugugcaguggcgugaucucagcucaccgcaaccucuaccucccggguucaaccucuuuccucagccuccgagcagcugggacuacaagagcccgccaccacaucuggcuaauuuuuguauuuuuaguagagaugggguuucaccauguuguucaggcuggucucgaacuacuaaccucaguugauccacccacuuuggccucccaaagugcugggauuauaagcgagagccgucgcacccgguccacucagcaggauuccuaaaauaagcaugagcucugcccucagugcaguccaaaaggggguguccggccucccucccggggggccuucgcgggcuucugcuggugcuucugugccugugggucuggauuccuccagggccugauccugggugcagaugcggcuggaagcccugagccugcugcacacacuagucugggcauggagucucugccgugccggagccgugcagacacaggagcggcugucaggcagugccagcccugagcaagugccagcuggugagugcugugcucugcaggaguaugaggccgccguggagcagcucaagagcgagcagauccgggcgcaggcugaggagaggaggaagacccugagcgaggagacccggcagcaccaggccguaagagcgcaagaggccgcgagggaggccgcccggcugcggggagcggccuggggcaggacugggagcuggguguggucccggggcacucuggagucagccauuagagcugcccucggaacggccuugcacaaacgccuaagaccuguaaggucccucacugcugagccggacgggagguccccgcgccuccccacguuugugugaggcugauggcgcgucggaguccccggcgcuccgcccagucggcccagacugcagcucccggcugagaugugucuuugccgcccucuucucccccagagggcccaguaucaagacaagcuggcccggcagcgcuacgaggaccaacugaagcagcaggugagcucagccuccccugcgaggcgccugcgucccugagaacguagguggcuuugugggaccagucagugggucagaggccacggggcaagaacgcugggguugcugacggugggugcuagagcaggggaaacuacucggacagacacgcaccagcacacguguacaggcacacaugcagacgugugcacacauguacauggagacacaggcaccuacccacacggacacacacuccucgcacacacacucccagcacacacagacaggugcacccacuucugcacacacgggcacacacacaccccugcacacacgggcccacacacagacacccccacacagaggccugcacucacacacccgcaaacauacccccacacaacacgggcaggcacacacccacauggacacucacaccuguaaacacacccccauacagacagguacgcacauacaccccgcacacacacacacagauacgcacacacacaccacacacagguacguacccccccacacacacacaggcgcacacauaccccccacaggcucacuggcacccgcgcacucgggcacacacacagccccacacacacaggcgcacacccacacacacaugggcaugcccccccauagacggacacacacacacccacacacaugggcgcgcguacaccccccuauacacaugggcacagcccccccgcacacaugggcacgcacacaacccccccacaugggcgcacagaccccacacacacauacgggcacacacgccuucccgucacagggacacacacacacacccgcacaugggcacacacccacacacgggcguacacacccccccccacaggcacgcacaacccccccaccccccgcacggguacacacacacacacacacacacacccaaacgggugcacaacccacccacacaugggcacaaucacccccacacacaugggcacagucacccgccugcacauucgggcaccgucaccccccgcaaacgggcaccgucacaccccgcaaacgggcacacucaccccccugcacacucgggcacagucaucccccgcacacaugggcacagucacagguuuuaaaggcuuuucucuuuuucugcggcuucuucucagcaacuucucaaugaggagaauuuacggaagcaggaggaguccgugcagaagcaggaagccaugcggcgagguaggcugucugcucuccuggcuggggcggagguggcgggggcugcuuguggacccggcgugcacucugagccugaguucugccgcccggccccucauagcuaccagugcagugggcgaggccugcuggggcuccgcgggguggggcugccucucggaagacaccucugucugcgaguggacgccaggaucuguucagggagggcaggagcugcuucacuucaugggaaguacaggggccuuuuuuuuuuuuuugagacggagucucgcucugucacccaggcaggagugcaauagcacgaucucagcucacugcaaccucugccucccagguuuaagcaauucuccugccucagccucccgaguagcugggauuauaggcucccgccaccacgcccagcuaauuuuuuuguaucuucaguagagaaaggguuucacuguguuggccaggcuggucuugaacuucuugaucucauuauccgccugccuuggccuuccacagugcugggauuacaggcgugagccucugcguucugccuagaacaugggucuuuacuguccugguuucaguggggaucacagguauuuggugccauguggcauuuguuggcgagugcuccaggcaaacgucugucaccacucuucaccgugggugggcuuguggcgaggugugugcguuuaauguucaguagccaggcacguggcacgucacgcgugucugaguucugacagcuguguuucugugugaggggggcuuccuucagaacuccgcguucugguuuuuugcuucaaagagcucguccugagaaguugccuaggccucugggucggauuucugcccuaauccaugggcagggccggccuguggcgcugucccuaccaaggucugugugugucuguggcauggaccuguccguggccuuagccuauuggcggcgugggccugucuguggcgugggccuguccguggccuuagccugucagcagugugggccuguccauggcgugggccgguccguggcaugggccugucuguggcguuggucuguccguggcgugggccgguccguggcgugggccgguccacaguguggguggagguggacgcgcugcacugcauggugcugagcugcccugccucucuggggcagccaccguggagcgggagauggagcugcggcacaagaaugagaugcugcgaguggaggccgaggcccgggcgcgcgccaaggccgagcgggagaaugcagacaucauccgcgagcagauccgccugaaggcggccgagcaccgucagaccgucuuggaguccaucaggugagcacugccgaggcccgggccggccacagauggagccccgcaggugugagucgcuggucccagggcgcucuccagcucuuccaggccuugccgccguaggcugacuccuuggugggggcacugccccucuguccuggcaaggccgugccgccaugucagggccucacccucaaccugcucucgcugcguggcacggaucuucguguccuuccuggucacaccacugcuuuccccgcaggacggcuggcaccuuguuuggggaaggauuccgugccuuugugacagacugggacaaagugacagccacgguaaacauacucauaaaacagggcuggcagguggcugaggggcagcaugugggggccuccuggagccccagguccugucccugccggcucugcacagcccuguagcucucccagcagggaggaagcccacguuguaccugcuggccucggcuucuccucccuucucaagcugggagaagaaaacgcaguugccagccugggccacacagugagaccccaucucuacaaaaaaucaaauauuagcugggugugguggcagccccuguggucccacuacucaagaggcugagguaggaggaucacuuaagcccagggagguugcagcugcacugagcugagaucgcagcacugcacuccauccugggcgacaaaguccuugucucaagaaaaaaauugucgauagucguggcucacaccuguaaucccagcacuuugggaggcagaggcagaggcgggcggaucacgauaucgggaucgagaccauccuggcuaacacggugaaaccccgucucuacuaaaaaaauacaaaaaauuagccgggcgcaguggcgggcgccuauagucccagcuacucaagaggcugaggcaggagaaucaccugaacccgggaggcggagcuugcagugagucgagaucacgcuacugcacuccagccugggccacauagugaggcuucuucucaaaaaaaaaaaaaaaaaaaaaaaaaaaaaaaccagaaggcaacccugacuccauuuugcaaaaaccuucuuuauuccuuauaaaacccugagaguuugaaguucacagauucuucucucguuuaaagccucacucuuuugugcccagccuccggccugcugugguggcgccccacgucccacauggcuguguccuccguccccaccccgcccagcacacgguaggugcccggcacugagugggcacuugcucugccguggugccggcgcccagagcugugacugcagcgccugccgguggccuggucagugugacggugaauguugcaggugguguugccaccauguuggugagaccgugucacgugaggacaugacggagcugcuuaaugcgccgaugacuuuuguuuguuuguuuuuagagacagggucuugcucuguggucagacuggagugcaauggugccaucucggcucacugcaaccuccaccuccccaguucaagcaguucuccugccucagccucccaagugacugggauuacaggcucacgucaccacacucagcuaauauaggccugugccaccaggcccggccaauuuuuguauuuuuaguagagauggguuuucaccauguuggccaggcuggucacgaacuucugaccuuaagugauccagccgucuuggccucccaaagugcugggauuacacgggugagccaccgggccuggccuaauucauuuuuuguuuguuuguuuuuugagacagaguuuugcucuuguugcauaggcuggaguguaguggcgcggguccagcucauugcaaccuuugccuuccggguucaagagauucuccugccucagccucccaaguagaugggauuacaggcaugugccaccauggccagcuaauuuuuuguauuuuuaguagagacgggguuucuccauguggguuaggcuggucuugaacucuugaccucaggugauccaccugccucagccucccaaagugcugggauuacagaccugagcuacugugcccagccagccuaauugauuuuuaaaacgaguuagagauuuuggguuagucuuguuuuccaggaauaaaguaccauuuuuaguggccaagaauguaccagaggguguggcccugugacauccggcugggucuguccagggccccgcucagcgaccgaggcuuucuaggauuuaugcugccaguugcagagaaaauggcccugagugagggcgcugugacugccccaccugccuccuguaaccgcguggcugugggauucggggccgggaauucgcguuccuguggggccagugcacggcccugugcuucucccucgggcggagagagggugggggcagccccgugcgucuccugcucuaagagggagggacggugggggccggugcgccagugcggugucucugcugcagguggcugggcugacgcugcuggcuguuggggucuacucagccaagaaugccacgcuugucgccggccgcuucaucgaggcucggcuggggaagccgucccuagugagggagacgucccgcaucacggugcuugaggcgcugcggcaccccauccagguagcagcgcaggccuggcccucccugagugcaguuccuggcugagucccuucugccccacgagcacagcccacgcacacccucccgucccuucccuuuccccggauaacgggcacccgcacacugcuucacggguggguuuuccugucuggcgcuguaccuuaggggucugcaucagugagacccuuccccugucugccucgguguccccugcucagggcucuugauggggccugggagcacaucgggguccuugcaagacccgggacuugggugugcggccgucuaucagggaagcugcuacaggccacggcgucugguggccucccuggggagccgcgccgcucgccgcccccgaggugccugcucuccacaggucacuggguaggugguuaagaaaauaaaagccaauaaggaaccggaaaaugccccuaaucccagcaauagccgccuggucuccgggcggggcaggguuccagcuccgggccgguccuggcugugcuuuggggcagcuccguuucugcguguuaccgagcgugugugugcgcguugguggcuguuccguggcuguggcaggugacccgauggcgcuuccccuuccccuccggcaggucagccggcggcuccucagucgaccccaggacgcgcuggaggguguugugcucaguguaagucggugugccugggaccggggaggcgcagggaggggacccuggagcugggccgggcuguggcccuugcuggcgcucgugguggcacccaggagcuuuuggguccugagaugcgacugcuuggaccgugcuggggauagauaggcugccccugaggugggaggcuucccgaggagccgagucugcacccaggcauucccgcagccccuuccccugaggcuuccaugggugcacagugucuccuccaaacccccgucuuccccggcagcccagccuggaagcacgggugcgcgacaucgccauagcaacaaggaacaccaagaagaaccgcagccuguacaggaacauccugauguacgggccaccaggcaccgggaagacgcuguuugccaaggugagagcgccuggcugaacaggugggccaggggccgcuggggucucaccugccugcaggugucuggggggcucagcugccuggggaauggaccccccuuaggccuuugcccacccucguguaggcucagggugcuggugugggcagcagcgccucccaucuuccaggcgggggacgucuccugucuggcaggcuguggcuuccaggcagggacgcugggcagagccuccacacuccggguggagugugcaggcuuugcagaggcggagggaacaucugcucugucuccccucacucuuccuguccagaaacucgcccugcacucaggcauggacuacgccaucaugacaggcggggacguggcccccauggggcgggaaggcgugaccgccaugcacaagcucuuugacugggccaauaccagccggcgcgggugagacguccccacagcaugcaccaggcccuuggcugcggcccagcaggcugccuucugggaaggggguccaggugucucuuggggacccugucuuucugcagcucuguccuuguggccacgcaggaggcccaguggagggucccucggagggaaaguccccugaguguggacccugguggacacgaggcccccagcguguggaggcugccagugggauacuuggcucagggcagaagggaggugggugggugcagggggagaggagucuucacagcugcaggggaggcuccuccacagccgcccuccccccaacacgccugcaggugggcgugggcacugguugccuuuucuagaaccauuugaaaguuagcugaagacagcauggcacacucccuucaauaggucccacagugaccccgcgcagggcacagcccgggcacccuuguggccucggcuguccucguuggaaccacgaugcucaugguuggcacccuccccucuggccuuugaccuuucacuuuagaagaccugucccugucguggacucuaagcggccaccagugcugcacugggccgggugggggugaagccuguggggcggaguucgucgcccccgugugugguugguuucccacggccuucugaggcugggccguggucagcugcccagaggccaggcugaucggcuucugucgaguccaggacuuagggcugcugauggggcagagccugaccccguggggaucugccugcuuggccugcuccugccgcggccggacgcugcugugggcugcuccuggugucacucucgcccugcuuggccucccucucguucacagccuccugcucuuuguggaugaagcggacgccuuccuucggaagcgagccaccgugagugucacuaagccucuggccacaauggggugguggggugggcacagccgucugccugggccaggcugcagcccucuguucaguuucuuuuucucuguaagcuuugugugaaaaacagcuuuuuuuuuuuuuuuuuuugagaagaaaucucgcucuaucacccaggcuggagugcaauggccccaucucggcucacugcaagcuccaccucccagguucacgccauucucccgccucagccucccaaguagcugggacuacaggcucccgccaccacaccuggcuaauuuuuuguguuuuuagcagagacgggguuucaccguguuagccaggauggucucgaucuccugaccucgugauccucccgccuuggccucccaaagugcugggauuacaggcgugagccaccacgcccagccuuuuaauuaucauucuaagacagggucucugucgcccaggcuggagugcaggggcgaucacagcucacuguugccucgaccucuggagcucaagcaauccuccugccucagccgccugaguagcugggacugcaggggcacaguggaauaccugucuaauuuuuuuguaauuuuaguagagauggaguuuccucacguugcccagacugggcucaaacuucugagcuaaagagauuugccucccuugacguucugaagugcugggauuacagaugugagcccccgugcccggucaggcuuucuuuucuuuuucuuuuuuuuuuuuuuaaggcagaauuuuacucuguugcccacgcuggagugcagcggugcaauuucagcucacuacaaccucugccucccagguuucagugauucucgugccucagccucccacguagcugggacuacaggugcgccaccacgccuggcuaauuuuuguauuuuuaguagagacggggucucaccauguuggccaggauggucucaaacuccuuaccucgugugaucugcccgccucagccucccaaaauccagguuacauucgugagccaccgccccuggcccuggucaggcuuuugagaguagauccaugaaagugucgccaugucccugcucccugcaggagggaggccugugggacuuucugcuguggcuguuuacaaggcuuugcuccuggugccuaaggcuggaaccuucucucugcaggagaagauaagcgaggaccucagggccacacugaacgccuuccuguaccgcacgggccagcacagcaacaagugagggagccccucggguccugggcccccgggcagggcugugcagccgucgcccuugguucccaccgagggaccugaggggcccuggcucacagugcugggcagcugccguggccucaacaugcccaccucggauguccccugggaacggcccagcucgggacagcacggggugucacugaggaacaugcgggggccucccgggcagagcuggggucaguccuguccucacggcccugugcgccgccgccccagcuugcaggucccucugccccuagguuucugcgguccugugccugcaagggagguggucucaucgugugaggcucugcugggucucccuuggagggugugugugcccuggggugggagauggagacaaguuugcucccacgggaaguuggacaccagcagguccugugugucggggcggaaccugggaccuuggucccccgcccggaugcuggccaagggugcacccuccaggcuuggggcccacccgacuuuguguggccucugugggcugccgcccagaggucccccauagggugaccgccccauggccaggcucccuagucccucccaaguccccuaauuuugaguuuucuuggucuccugggccccuccagccccagucacgugucacacggaggaucaaguccugcuggucggccguggcugacuccucaggcacguugggcucccaggucagcugcugccgguggaugcucccuggagcccugacucggguccuucccagagaggcaaggcuggggcccugcugagccuccagugaacccgggccccugagguccugcuccuggcacgugugggcgacuucucgacauggacuccgggucccgaaucccugcucccagcacagcaggggucaggcagcaggagagagugguguucccggcacugccuaucaggcugggcgagggucagcgggaaagcacuauauggagggagaacagaggcccaggaagccaggccgggggacagcugggugcaguggggcagguggccgaccagggcugugcccguguccucguguuucccgccacuuuagguucucccugugggggcugaggaggccccguuccccuuggugcagcucggccggcagccccagcauccucauccucauccccgccccgcagguucaugcugguccuggccagcaaccaaccagagcaguucgacugggccaucaaugaccgcaucaaugagaugguccacuucgaccugccagggcaggaggaacgggagcgccuggugagaauguauuuugacaaguauguucuuaagccggccacagaaggaaagcaguaagugucccgccccaccagcccccguccaggggcccucgcucaggguccaccccgacccacaguccaccaucacuuacaaaccuuuaacauuccuuuuuuuuuuuuuuuuuugagacaaagucucauucuugucgcccaggcuggagugcagugacacgaucucagcugacugcaaccucugccucccggguucaaacaauccucuugccucagccuccugaguagcugagauuacaggcgcccaccaccaugccuggcuaauuuuuuuuuaauuuuuaguagaaaugggguuuuaccauguuggccagguucgucucaaacuccugaccucaagugauucacucuccucagccucccaaagugcagggauuacagaugugagccaccgcgcccggcgucuuuuccauuccucuucacuacgaggagggcugugaggaaaucuugugcucggccacccccaggcccuggcugugaggggaggugauacggaguguugcucugagacccccgugucgggauucgaaggagucucuccucaugagacccccgugucgggacuggagggagaggcuccucaugguccacugcuggcuucuggccuggccucccuccagcugccacacccggcccuggagccucgugguguggggcacggcucuugcugcucacgugccuugaggcugucaggcucccuguugcuggcggugggugcagcaggcacggugggcagagcccuccaggugaugaggggcccuggcaccacacaccggcugccucgggaacacuccagaugagcagaggcugcuccacuucuuggcgucccccgggccccgguuucugaguccuucugugcaccugacccaaaucccugcugucgccagugaugacaaaagagagccugguugccgcugccgccugcuccaugccagcccagcuuuccgggccucaguuucccuaugcccuccccuucccugggcucccccacccccauggcugcucguagcccuggcaccaugacuuggcuucuguggccuccaggcagacgcuuuugcuagaagucggggcuccgccacugccagcauaaaggccaccugcccugcgggugcugagugagcagcugugggcagggcuggugugaggagugguuggggccaucuccaggcccugcagccacucccugcucaguccgggccuggccugcagcagggaggauguggagcugggcugucagaaguagagagccccuccaaagaggauguuuggcgugggugucggccucgcugccugucuuccggccuccaccucguguugugggagcugcugccuuggccggcccacuugggaacuccuuccccaggcgccugaagcuggcccaguuugacuacgggaggaagugcucggaggucgcucggcugacggagggcaugucgggccgggagaucgcucagcuggccguguccuggcaggugagucaggcuccggcacguccacccagacgggaccccagcugcuguggagaugcucaguugcgccaggccugucccagcaccggugucacgcgggagcuucuguugagggguuuucagugcacagaggugacacagggcccccugccccagucaggccacuccacgaggcaucgcgcaccugcucgugcccucaggaggguggagccaugucgguggcugacagucacccggggcucucuggaggccagucuggcaucgccguagcccgagcuuugccagguggggcuggaggcuucugacucucaccuuggccaauaggcaccucccuguguaaauggucguuaggacaggccccaugugaguuggggguucgggguggagggacauuguguuuucuggaccaagucugugggcuugguccugcuugacacaugggugggaguggccucugguugucccacagccaguuguucuucggggacaccccuccugcagcuccguggcugcuccagggcugaggagccaggacucacaggagugugggcguggccauccagaaagcuuuggucuuuggggguugcuggaaaagcaaaaccagguugguggggcagaaggcacccuggccacgcacaggcaucaccaccucugggguccgcagagucuguguaacaaccugguuccucaaucuagcagugcuuuugaaugaacgugugacagcuuaaugaagcagccgaguaccuugauuugaauguuggagccgggguucacagggggcuguauuagucaguacaggcuggguuaugccacugugacaaagagccccagaucucaaaccccguccuugugggucagcugaggucucuguuccaggccauccccacuuggaaccaggucuguuuccacaacuaagaaagcagaggccggguauggugguggcugacgcuuguauucccagcauuuggggaggccaaguuagauuauuugaagccagggguuuaggaccagccuggaaagcaaggcaagaccccaucucuacaaaaaaugaaaaaauuagcuggaccugguggcacaugccuguaaugccagcugcuugggaggcugaggugggaggaucacuugaguccaggagguggaggcugcagugagcugugauugccacugcacuccagccuggauuacagagcaagacccugucuuaaaaacuaagaauaauggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcaugaacccgggaggcggagcuugcagugagccgagaucccgccacugcacuccagccugggcgacagagcgagacuccgucucaaaaaaaaaaaaaaaaaaaaaaaaaaacuaagaauaauuuggaacgagugcgguggcucacuccuguaaucccagcacguugggaggcugaagugagaauaucauacaccugaggucaggaguuugagagcagccuggccaacaaggccaaucucaccuccacuaaaaauacaaaaauuaccccggcacauuugugguguaugccuguagucccagcuacucaggaggcugagccaggagaaucucuugaauccaggaggcggaggaugcggugagcugagauggugccacugcccuccagccugagcaauagcgugagacuccaucuuaaaaaaauaguaauaggccaggugcaguggcucacaccuguaauccuagcacuuugggaggccaaggcgggcagaucacgaggucaagagauggagaccaucuggccaaauggugaaaccccaucucuacuaaaaauacaaaaauuagcugggugugguggcgcaugccuguaaucccagcuacuugggagaaugaggcaggagaaucacuugaacccgggaggcggagguugcaaagagccgagauugcaccacugcacuccagccuggcaacacagugagacuccaucccaaaaaacgaaaacgaaaacuaaaaauaauaauaacuggggcuggacgggcgcgguggcucaugccuguaaucccagcacuuugggaggccgagaugggcggaucaugaagucaggaaaucaagaccauccuggcuaacacgguggaaccccaucucuaauaaaaaauacaaaaaaaaaauuagccagaugugguggcgggugccuguagucccagcuacuugggaggcugaggcaggagaauggcaugaacccgggaggcagagcuugcagugagccgagaucgcaccacugcacuccagccugggcgacagagcaagacucugucucaaaaauaaaaaaauaaaaaauaaaauaauaauuugggcugggcacgguggcucacaccuguaaccacagcacuuugggaggcugaggcaguggaucuccuugaguucaggugaucugcccccuuuguccucccaaagugcugggauuacaggugugagccaccaugcacggcaucuugaauucuuuucucauaaaaggguuuugaauuuggucgaaugcuuuuccugcaucagaugagagggucauguaguuuccuuccuccacucggcuaauauugauugauuuuuguauguugaacauuuuuuauguggaacauugauugauuuuuguacguugaacuauccuugcauuccaggaauaaauccugcuuggucaggguguauaauuuuuuuauuauacuccugaauugguuuugcuggcauuuuguugaggacuuuuccaacgaugcuuaucagggauauuggcaugucauuuuucuuguggugucuuugucuggcuuugauaugaggguaaugcuggccucuuaggaugagugaggaaauguucuucaauuuguccaagaguuugaggagugauacugauucuucuuaauguuuugugaauucacaugugaagacaucagguccaggucuugucuuucaacuuuuauaguuugaagauuuuagguucccagaaaaguugcaagaguagcacagagacuuccugggccugggaccuugccacguggugaacaucaugugucacuguuggacccaccugugacuggguuuugccccagaaucccacccaggacgccacgugacauuuagcugucacuucuggugggcuccugccaggucccgugcuuccuggagggguggccccgugagcaucugcauagccccuuuccucugcugggcccuggguggggugcagccacucggguggacccugagggucccugcaccuguuugcccucucuugggugcgcucaagaccaaaaaugauguugagcaguccugggccccggacccacagugguggugcggcucuggucagugucuccugcgcucccaggccccugacccacaguggcggugcggcucuggucagugucuccugcacuccggggccccugacccacaguggcggugcggcuccggucagugucuccugcgcucccgggcccccgacccacaguggugguccggcuccggucagugucuccccacacaguggcucuuggugaggggugggcgcuugcagaggggacgggcaccacguggucauccccauggcagguuccgucguggcgacgguguugugggaggauggugugcugcugccccugcaccccgugagaugaauccugccucugggagguacagcugggacggggcgagggacccacucagcuguccaggaaggguccccugcccugugcuuccuccagguguccuggugcgcuccugagcacggugcccaguggggguccccacacccugacccugacccugacccacgggugccuccccuuggggacuccacgcccuucgcuggcauugggauggagagugacccguucauugcagaagggcuggaccugaggcugccugaagccacaccaagggccacagccccagcagcuccagccuucacgugccagaugccaagcccugugcucaggaggacagggaggugggggcagagguggccuuggugccaccacucaugugccucaaggugggcaguggcugccucugcccuggaggccugugagggucagggucugagggucugaggugcacuaugacccgggggcacugccuggccacggcugagacucgcagagggucugcaguucccaccugccucucggaagcugcccugggucggcggucagugaggcuccgccuugggcuuucuauuauuagaaagucauugagcaacagcagugcugaggacgcaggcagggcugugggcacugcaggggcugcucccgguguccacacacgugcugggcucugccgaggugcgggaagccuguguuucacgcucaggccauccuggagccccugguuuggucccuccccaccucggggcccuggcgugcauuuggggugggggguucccauggcggccucccucagcugccucucuccccacuaggccacggcguaugccuccgaggacgggguccugaccgaggccaugauggacacccgcgugcaagaugcuguccagcagcaccagcagaagaugugcuggcugaaggcggaagggccugggcguggggacgagcccuccccauccugaguccacagggagauccacagcucacggagccuggccgcggaccccucccaccccugccuugccggccccugcacauuuaggauaugcuccuggguggggacugggcugugcccagggccucugucccccaggaugucuuguggugcgggucggccguucugccccccagggcacccccuguuguaggcacuggcuagggaggggcaggccuccuuccugccccucgagacacucuugggagaugcauuuuccgucuggcucacagggggagggugaggcuuugcaccccagccccugcccaggccacugugagggugggugcuggcugagcccccggggcagcaggagccaggcaggugaugucuuuguucucggcucccacagcagagccaggugagggggcgccugccagggccagacccagguggggcagccugaacccugcuucccccuguggccggcaugccccgaucuuucacacacuggugacccugagagaggagggaggagggaaccuggcgggggugucugaggccgcacugucagcuggccgguccaagccuguggcuggagcuggggucuguuuaccuaauaaagucccacaggugccucauu

SEQ ID NO: 191441 - RNA, 1660 nt, Homo sapiens
augagugagcaggggagggagacggaggaggaggaggggggagguggugcuuccgacacagcgcccaugcugccccggggaccucccgaccaccaggccucagcccugacgugcccaggguggucggggcccccgcugcugcccggccggcugcuggccgggcuccugcugcaccuccugcugcccgccgcagccuuccugcuggugcuccugcccgcggccgccgucgucuaccugggauuccugugccacucgagggugagccugugccccgugggcgggggacuagcugggguccuggggagugggcgugcccugggucugaaggcacugugcccccuuccagaauugccccuuguccucagagacacgugugccccucccuggcagccccuucucccaagcacccccaccagccacagccaaagaagagcuuuuguuuuucacccaagggacagcucugucccuucccugaggccucccagccuuguaccaggggccaccagggccuggacagcuggguggggguggggagagaacgggguuccaggaaaagaagaugaaaaugucguugaaguuucacuaacccacagcccccagccccuccccaaacacacaaggccccucccaggcccuccugccagcguggggcuuccccaccugcagagugggcuguggccugcucugggccccgggccccuuucugcuggcacgggggcuggcgccagcuggugaugagagggcgcaggagggcagaagcgggcagaacgcggcagugggcgcuuuuucugagccuccccucaagggacccugcucagcccuuuaccugcugcgucccggaucuccuguucaccccucagcacugccuggcccacagcggcccgcccccuccccucuccccgcccugccucuccuucgcccaggcccuaauccuucaucccuccaucuccccccucccucuucccgcccugcucagcccgccacggccccucuaccgccccgccccgcucuuucaucucuaucgcccacuccucucucccgcccugcaccccuccgucucccuuugccguggcccugcauccuuuccuccaccccgcucucucuccccuccccgcuccacccugcucccgcccauccaucccucaccguccggcccucaccgccccuucaucacccugacccacccacacccucuccuccgcgccuccccuuccccuccaucacccugcccugccccuuccccuccaucacccugcccugcuccccucuucucccccuucccuccaucaucccgcccgcuccccucuccaccccuccccuuccccuccaucacccugcccagcccccuccccuccaucacccugcccugcccccagcccuccauuaccccgccccgccccccacugacggcccgcccggcccccagguccaccccgcuccggguccccggugccgcgcgcuguucucagaccgcggcuccgcggcgcucaucguguucgggcuucucucgcugccgccgcugcuggugcucgccucggccguccgcgcccgccuagcccggcgccuccgcccgcugcugccuccgcccgcugggacccccggaccccgccgccccccggggcgccccgacgaggacgagcaacucugcgccuggguguga

SEQ ID NO: 191442 - RNA, 13082 nt, Homo sapiens
gagaguaccaaguagucuuuuguucagcuuuuacuggaaacugcugucuaggaccaccugcccuaaccaggaauaaaggcaagacagccuggagaccaguuuguuucuucagcugcaaacagcugccugggcaggcaggugacacaaggccucuguccccagggaugggaccugcagggucuguucacccagggcacccacaguccugaagugcaggcccagggucuguccagcugggagagggcagagguggcggcugggugaguugccggccucagcugggggccugggggaggcccuucuucagcagagaugugaggaagcuccccagcuccucguccuagggcagaggcaaaagcauuguggguggugcaggacagggaggaauguugauaccuguguugaccgcgguggggugggggucaccccuuaccugguagguccaggagaccagcagcaccuuggugccuggguccucagaaggggcggcggccuggaggaggacggacuccacagucacagagccgucugggaggugcugcacacagugguccuucaggacgcuguggggaggcucggugagacccugccuggccuccagggcccaagggaguggggggggggcggggccgggcgcccaccucuugagguggcuguagacgcgcaaugccgucuccugcuccuugcgugugucaugcaggugcacgcggcaggugaagcgcagcuggugcucagccagacccagcucuuugagggcuugcucugaggacaccagccggaaguucuguggggcagggacaggucagugagcgcagcagcggcccuccccccuccagagaccguccuggcacucacgcuguccuucaugaucagggugccgugcaggagccgaggcuucuuggccucagggagcagcccugcggaggagguggcaggagccaucaaugugagggccgcucccagccgccugccccgagcacccugcccugcccugcccagcccgcauacccugcgccaucucccgcuucagcagccccagcgagaugccuacggggaugcuggggcuugugggcagcgucaccgucucgccauuggccggcauguagcaguugaccccuggaccccgggggaagagagagccucagcccaggcugcccgugcugacccgaggugggccccacgccgcccgcccggcugccuacggagcuccugcucgaucuucugcuucaggaacuccaucuucuuggccucgccaugcaccagcagcacgcucuccggcucugccuggcccaccagcugcaugaugcccuuggcguccgcgugugcgcugaaugacauguacuccaccugcaucuugaccuccagcuacagaggccacggggcguggacagugguuaccaccaggaggugccccucggcccugccagcccagugcggggucgagacucaccaccugccgccccuccaucucgagcuuccgcugcccgcugaggaucuuguggccgacggugcccugcacgcaguagccgggcaugaugaccugggggcaggcacagagcucacagccagggaacuccagccuuggcaccucaaggccuugcccgggaugcccccgccugaaccccuggaagcuguuuccaccugccagcggcgcccgaccaagccuagcugcagacuccaaagggcucagguuuuggcacaagacuguccagggcugggcuggggcuguucugcccgagguggacaagcugugucacagagacugagcagcuccaggcggacaucgcccccguuccccagcagcagcagccacgucccuuggccagcacgaggccaagccagugagagcucagagacagcauggguggaaggacaacccgucggccuccagcuuccagauucccacaccucaccaugcccucaccauguucuuuucguuuccggcccauuuccggaagaucugcagggacugcccagcgugcagcauuccuggcguggcaaacacaaccuacaggacacacagggccagguggggggucagggcagcagaugcccccacccccacugcaggcccaagcccagacaccugcggaagacaggagaccgacggguguggaugugcuggccggcccugccgcgggccucaccaucgguccuggguugucagcaaaagcccggucgaaggccuugaugugcuugaacucaaacauguuccucugcacgaaagucuugcggaucuucugguugguccaggggaugaacagcuuguaguagugguuggccuucucggucagccccguggagaaguagaugggcaccuucagguucaugcgcucccuggggaccaccggcccagucagcacaguggccacaggggagaaugcugcagggcaggacucggccgggucacccccaacacccgugucugcacagcccacgcacgggccagguugaguccagucgcgaccacuugucccauuaagcccugcagcagccgggcucagcggagaaccaggaaccccuacaagagccgcacacgguggcgcugacgggaugucacaggcuuccuggggucacacagcacacgagcggccccccaggacagcagcaagcagggccaagaugccaccgcuacgcuggacagggcugcccaccaacuggacuguguucaggccgggccaggggcuccuuaaagagccguccuggcggcaccuaccagaaggucuccaggaggaugcagagcuccugggcgcggcccagcgcgaacacagguaucagcaccugagggggacacaaggcaggagcccugggcacauggccccucgacacagcaggcagcguccagugagggcacggccaggugcccaagagcugcggccucauagggaccuuagccucucaucugcucccagucccgucccagccgcucuccagagacagaagggagccguaugagagacaggagggagccgcaugagagacagaagggagcugcaugagagacagaaggagccuggccagggcuucguccgcaccugagguaggagggaaaaggggcucccuaggaaagggucucugaguuuuccuccucaauguugagcaaaucuucuucccucccugccugaaaaugcaguaccccccacccugagacccugacccaugccaagggcagccaagccugccagaaagaccagcccagcauggccgagggcccauguccccaccccugcugcagcuaccuucccaccacgcuccacggucucguggacuuucuucaggaagucucgcucccggcagcgcuuggagucacggauggucguggcguacguggacucugugaugagcagguuggggcggcacuugucaauccaggcagcucuggaacacgggggugggggugugagccacgaugcacuguccccacgguugcagggcugggugugacaagcuggaccccaguaccacgcccagccgccuuccuaggucacucuggcuggaaagagccagcugguaaaaugcugugggcagcacacuugggaagagagaggagagacagaggcacccacccagacacuucggaagagcgagacagaggcacccacccagagacuugggaagagagagaaggagggacagaggccccugccuggacccugugccuucgcgcauuugggcccagaacgaagggggcucuccaggccgcacaggacaugggagacacugccaggcuggccacucaagggcuggcacccugacaccugcaaggguccugagcuccaggggggcccacgggacaaaaagacaccucagccuacuuacccuaagugucggucuggggucauguuauaaucacccuggugaacgaucaaggaugccaugaggagggugccucccaccccagcagccccucccaagccucaagcccuuccacugaccguguagaccacagacucugagcccacuuuaaucuggaacauggcugcccccagcacguggccugcauaguaggccuugaucuccagcucaucaucuaccuguggaggacagggcugcgcucaggcuguguccucacagcagaggggcggggagugagggaggcgggggacgggaagcgcgggaggcggggguggggagcgugggggaaggggagcgagggggcgggggcgggagcgagggaggugggggcggggagggagggagggaggcgggcagcgagggaggcaggggcagggagugaggggggcgggggcagggagggaggcggggcggggagcgagggcacugcacugagcuuuucagucccuguugcucacacacagcauccaguucacaagggacgggcaacguggacaaagaacgaaagacaacggacaaaaaacugaagggaccugaaauuggaguuuccagcguggacuuugaauacaugacagagaaaagacaagguucagaauguuggcggccaggccuaagguggaucccuuggggucaggaauuggagaccagccuggccaacauggugaaaccccgucucuacuaaaaauacaaaaguaagccagguguggaagugcgugccuguaaucccaacugcucaggaggcugaggcaggagaaucgcuugaaccugggaaguggagguugcaguguacugagaucacgccacugcacucuagccugggcaauggggcgggacuccaucucgguaaaaacaaacaaaaaaauacugggcugggcacaguggcucacaccuuuaaucccagcacuuggggagaccaaggugggcagaucaucugaagucaggaguucaagaccauccuggccgacacggugaaacccugucucuacuaaaaauacaaaaguuagcugggcaugguggugggugcuuguaaucccagcuacucaguaggcuaaggcagaauuacuugaacccgggaggcggagauugcagugagcugagauugugccauugcacuccagccugggcaacaagagcgagagugucaaaaacaaaaauuggcaaaaaacuagacuucuuuuaaauuuaauuuauucauuuaaaacuugccgggugcgguggcucaugccuguaaucccagcacuuugggaggcugaggcggguggaucaccugagguugggaauucaagaccagccugaccaacacggaaaaagcccgucucuacuaaaaauacaaaauuagccggaugugguggugugcgccuguaaucccagcuacucgggaggcugaggcaggagaacugcuugaacccgggaggcggagguugcaguaagccgagaucgcgccacugcacuccagccugggcgacagagcgagacugugucucaaaaaaaaauaaauaaauaaaauugagagacaggguggggcugucacccaggcugcaguggcgcaaucauggcucacucaaacuccugggcucaagcguccucccgccuccaccuccgccucccaaauagcugggacuauaggcacgcacccaccacgccaggcuaauuuaaaaacaaaauuuuggccaggcgcaguggcucacucuuguaaucccagcacucugggagaccaaggcggguggaucaccugagaucaggaguucaagaccagccugaccaacauggugaaacccccgucucuacuaaaaaaaaauacaaaauuaacugggugugguggcacacgccuguaaucccagcuacucgggaggcugaggcaggagaaucgcuugaacccagaaggcggagguucaaggugagcugagaucgcaccacugcacuacagccugggcaaugagagcgaaacuccaucucaaaaaaaaaagaaaaaaaaaaagaauucaacagaugaauuuaacaccauaugacacauaaccagaagagaauccaugaacugaaagacaccagagggaauauccaucaggaaacaggaaagacaaacagaugacggaguuucaagagguugaacgucaggcucucggggucccuggaggagcaggaacggggcagaaacaacacuggaagaaacaugaugaaggccucaagccacagauccaagaggccucaaacucuaaacaggcugaggauacaugucagcccaucagagcacaagcaccaaaaaccaaggcuccugcucagacccuacggcugcccaugcccagagacagaacguuguuugcaaagugcagagacaaaauacugucaaccuaaaaucuuacacaccuaagggaaaaaaaguccuuuaagaacgaggauaaaguaaauccauuugcaggcaaauaaauuuuuuuuuuuugagccggagucucgcgucucgcucugucucccaggcuggagugcaguggugggaucuuggcucacugcaagcuccgccucccagguucacgccauucuccugccuuucagccucccgaguagcugggacugcaggcgcccgcaccacgcccagcuaauuuuuuuguauuuuguuuaguagagacaggguuucaccguguuagccaggauggucucgaucuccugaccucgugauccgccugucucggccucccaaagugcugggauuacaggcgugagccaccgcgccuggccaaggcaaauaaaaauugacagaauucagcaccagcagacccacacucauauucuucaggcagaaggcaaauuaucccaaguaaaaaguagaaaaaaugcaggaagcccaacaaaaaggauaaauauauaaauaaaacuaagcaaauguugguguuaccaggcauuagaaaugaugucuuucuggguuuaaaauguacugagggaguugccagguguggugacucaugccuguaauccgagcacuuugagaggcugaggugggaggaucccuggagcccagcccaggaguucgagagccuuagcaacacauacccaucucuacaaaaaauaccaaaauaaauuagcugggcguaugggcacaugcuuguagucccagcuacuugggaggccgaggugggagaucaccucaacccgggaggccgaggcugcagugagccaagaucacacuccagccuggguaacaaagugagacacugucaaaaaaaaaaaaaaauuaaaguuucacaacaaaaaagauaaacauacuucauuuugacaaguucaaucagaaaauuaaauguuccaaaauacauagguaccuaauauaguuucaagaaauauaaaagcaauacccagagauucgagugagacacagacaaacccauaaucuuugucagaaauggaauuucaccugucacucgcugauuuaaccuucacuucuucccugacccacacccagaaccaggcacccuccagagcuggcccaucuccccuccagccccugccucccugcccggcaacaccccgggagcuccagcgagucucuggccgcuccaagcgcucugagggcaccagccugucccacucuggccauuucaaugccgcucggacagagccugguggguucauaagccggugcauacccccacccugcacgugcucucccgggucggcgcccagucuggucugggacccgcauccucgcgcugacgccuccugguguccccacggugcuggacgcaagagugagguggggugggcucacccugaggccccagccuuccagaaacuguguagaacgggcggagggcaugguuggugugggggugggcagugacugugccagcuguggcccugggaaccugaccuggaccgucugguggagguggacagccaccaccuucuucaugcagucuuugaucaucugggaggugaagaaguuggccucgcccuucuugucuacggcgaucuugcgguaguccuccagcaagauggggcagauggccuggguggggugagucauguagaugggcccgucguagcccaccaucucgcugaaguaggggagugccccgcagugguccagguggaaguggcuagggggacgcagcacaggucagccugggcccacccugccccagccuucacccccgcucugggcuugugggucacuggccccuucauucgccugcugugcgccaggccucaucccgaguaccgaagagucaguaaugagcaaacacaaaacugucucccuggaacuuucagucucaaagucuagcaaggcaauaagcaaacgggaaauugaacacgucggugacggcgacaugcucgcgagacaaugcaaagcugcugagggaaccgcgcauaggggagccgcuggcuuuucaggcagucaggacaggcugaguggagcugcaggugaagguggcacagaccugagggcaagggcagcgccuggcaagccccaggaaggcacuggggaccccaccgugucugagaagaaaccacaaccacgaggggcucaggggcagcugaggacacugccuccggagaggagaaggggcuucuccaggcuucacgggccuggcugcuggggaggacagggcagggaagggcagggggccagcaggagugcuguggccguccagacgaggccacccagaccagcgggucaugagcugcugaacccuaaaggcuggggucagggcagacucgggacucuggaaucgccaacaagacagugggguuuaaagauccugagacagugaaggcaucagagagggugaagccuggagggccggguucagaaaguaggguucagagggcagggccggaagaacagacagagaccaggccaugugugugaccaguaaggcaggcagggagcagauccuggggccuagaagcccccugaggaucaaggauggcacaggccccuugccaaacgcugccgagaccaagcaagguggcccaagccccacaggcacagacaugggacccucaaggcccccaacaggaacccaccuaaugaucacacaguccaggaagucuguuaggcggccguucugggugauguaggagaagucagggaagcgucgcuaggaaggauguggggguuucagguugcacaguggucuccaggcagcaucuggggccacccaugccccagggaggggcccccaggaagggggguucuaugugcagacucaggcugggcacucccaucccgcagguggcaccaggaccccuggcugcucacagcauccggaggggccgagguuacccccaaccucacugacagaugugagcuggaagcugagcccagggucucacggaguccagccuacaggaccccggggcuggggcucagcgccagcacagggggaccccaccaugcaggggcucaccucggccaggcccacccaucccugcuccccacagggugcagccauccaagcacaaccacugcugcccaccaccccacugucccggcucugaggcccaggguccagcuguggauggccggcucucccagccucugggccuccugcccaagggacucacgucgucauugaagcccaugugcauuccacaguccagcaugacauucuugcccgcaauggagaccaggaugcagcuucggcccacguccuggccggccccuacucgagggagggcagaugagucacugcugcgccccccgcccccugugcugccuccccaagcucugcaggaccccagugcacugaggaaaccggaccaagucugcuguguggacagacacaugggccaagaagcagggccaccccuacucacaggaagggggacacaggggaccaugccccacaccaucauguccaggguggaggcuggcagcccacacgcccucccccgccagcuuccccuggccucuuaagguggccacggccugcuggcuaaguagugggcacugugcuguggcccucagccuccaacagagacaacggcuggucuguggggccaacaccucggucagagucacuccugggcuguggcuggacccccagcagagcugcaaaccaaugaggccaccuucuccaggaucuuuccccaggcaggcaaggcaguaagugacuaagugcuggcacuggguguucucugguggugcggcuguggaggggcgccacacagccucagccaugccauagcgaacacggugccagugguccagcaguggccagcguggcaacacgagccucacaccacugcacaccaugcagcccccaacacagacccucaucugcagcccucccacacuccugacagccaagcagcccugcccagcugcuccagccagaggccuuggccagccaaggcacacucagcccccucauguggccugggggcccgagaggaaagggucacggccccugcacagacugugccugggcaggagucugauggcagugaacaguuuuccccuugaaucccacccaccucccccugccagccacucgaaguguccaaagccagcaccacacaucaggaugacggggccacagccgaggggcugccugccacagagaggggaucucagguucucuuccaggccuguuccugcccccgcugggugugagcucucugagagcagggucucagcugucuccucccucugcaucuccuaccccaagccacgccaggcucacagaggcccucuggcaccugugggaagggagggccgccccucuucaugcccagggaccuaaggccacagaggcacuuguggcacacggccccgaggcauggggcccgggcugguuuucugaauuccaaagcccaguccugaaguacuggcagucccgccucccgacaggacccacagugaucccaggaaggaaaguggaaaggugcgggaauagagccuggagauacacgaggggacagggcucagaagacaggaggagauaucccugucagcaaggagacagacggcagacaaacaagacacccaaagcacgccagacgaagguuacuaugacagaaaagagcaaggugagagaaugaggaagccucaaaacuuccagaaccaugacaggagacugcuccgagaagccaacuuuugagcaggggaggggagggguagggugggggagggggagggacgggguggggaagggaugguccaggggaggagaagaagcggggcgggcggagggaggacaggcagcagggagggacaggcaggggggagggaagggaccagcagggggagggacgggcaggguggguggggggaccggcgguggggagggaugggcaggguggguagggggaccggcggcgggggggguagccacacacaggccaaggcgugggagugaccccaaggacacagcagugguccagugagcgcggacacggagcccgaggcagucccuggugcagggaagcggugaaacaggacuucggcuuugaugauaccuuggcugaggugaccuugagaauauacccagguacagauugcggguaauugaagccacaugaaagaucagaaagaucagauguccagagagugggcagaacaggcagccaagaggccaaaugggaaaggggcaggcugggaggaccccacggaggacccagagagcaggggagggcaguggggcccaugcaaacagcugcaaaaugccauggggugugcacaggccagggguguucacagcacaguguccacaccggggcggggggcacccuccgaggaagcgcucacgccaugggggaggacauggaaucccguccuggugucugugcuggaaggugcccucgacccccugcccgguggaaggaccagguuccaggacagcacagggcaggcaccuguggaaaacgcuaaggacaucaggaugacuggccaccaacaccaugucccuccagcuguuucugagacccuggauuuugacuaauuuuuuccuucuucacaucguucuauacuguuacgacuuugacuuucuuuugagacaugguuuugcugucacccaggcuggagugcaguggcacaaucauggcucacugcagccucaaccuccugggcucaagcaauccucacaacucagccucccaaguagcuugaaccacaggcacacaccaccacgcccugccaauuuuagcauuuuuuuuuuuuggagugauggggucuugccauguuggcuagguuggucuugaacuccugggcucaagcgauccucccaccucugccuuccaaagugcugugauugcaggcgugagccacagugcccagacugucaggacuuuuaggaguacauauuugcguuuuuugcuauuuuuuucaguguugcagaaaucagguagaacaagagcuaaagugagaguugauuguaacucgggcgugagcacacagagugguggacagaaagcaagacgugaggaggcagaagcggggcuggggggcugaggggcuugcgggguuaaggggcuugggggcugggggacuggggggcugaggggcuggggggcugagggucugggggucugcugggcugaggggcugggggacugaggggcugggggacugagggucugcugggcugagggucugggggacuggagcgcuggggggcuggggggcugagggacugaggggcugaggggcugggaggcugagaggcuggggagcuggggggcugagggucugcggggcugaggggcuggggggcuggggggcugaggggcuggggggcugaggggcugggaggcugagaggcuggggagcuggggggcugagggucugcggggcugaggggcuaagggacugaagggcugguagggcuggaggcggcagcgcgcggcacggggaggucaaggcaccgacgaaagcgcacagcgagcgcgaaggccccgcggccccaucugcgacguccccucacggccgccugaaccucggggcucgcguucucgcgucacugccggaggcccggggugcagggacuaggccgccucucggcucccaccagggcccgcgcggggaggagaccggaggacgcccgcggcgcgcaccuggcuccacgagaaacgggagggagcggggcgcccagcccgcccggagccgcauacggagcccaccccacagcccucccggcggcucccacucacccaagggcgugacucugaucucaggcaucgucuccgccgcgcucccggacccgcgaggcccgccugcggugaugcacugcgcaggc

SEQ ID NO: 191443 - RNA, 8737 nt, Homo sapiens
gggcggauguuguccucccugcgaggaucaaaguaggcaagauggcgucgagcggcggggagcuagggaguuuauuugaucaccacguccagagggcgguaugcgacacacgggccaaauaucgagagggacgacggccucgugcugugaagguaaagugauuuugguuucauucgcucuccucgguagcuuuaugugagugcuagcgccauaugaccagccuacggaaauaaaggcacgacaaggcuuccgucagaucugucucucguuagagcuggcgugaagaacccucggucaguuaccaaagauucucacgacgccuuuggucaaguauuagaacaucaacuccacgagaauaggccuugguuuuagucauuggaucuucuguguuuacaguacuacuuggcacagguaagcacucagugaauauucguugagugauuguucccagugacuucuaccgacucaauuucuggaaaaaaaugucgacugaagguagucuguuauaugccuuagguagccucucacauggacuguuauucuuuaugcagaaggaauggcagaaauuucauuuuguguucuuuugcugacuggguugaacagauuauuucuuguuuucaaaguucucuuuaaaaaaaaauagaggcagauucguccuaggcuuauuugcgaaauacguuuaauaacucugcauuucuuucagguauauacaaucaauuuggaaucucaguacuuauuaauacaaggaguuccugcugugggagucaugaaggaauuaguugagcgauucgcuuuauauggugcaauugaacaguacaaugcucuagaugaauacccagcagaagacuuuacugaaguuuaucuuauuaaauuuaugaacuuacaaagugcaagguaaugugcaaguuaagaaaugacucauuuccucauuucuuccauucauauuucugucauuuuggccccaaguuucccucauucauaacugaauuaccccaaaacguaaucuagcauaucuuccuccagccuuuuuaaaaguuaacuuuacugaaacacuguauccaucacaucauucccaugcuuaacaauuuaauguccuguagcuugguagaguagaaguuggguuuggccaggcacgguggcucacgccugcaaucccagcacucugggagaccgaggugggcggaucacgaggucaggaguuugagaccagccuggccaacauggugaaaccccccucucuacuaaaaauacaaaauuagcugggucuaguggcgcaggccuguaaucccagcuacucgggaggcugaggcaggagaaucgcuugaaaccgggaggcagagguugcagugagccgagauugcgccauugcacuccagacagggcaacaagagggaagcucugccucaaaaaaaaaaaaaaaaaaaaaauuuggguuugaagccugggcguggugacucacgccuguaaucccagcacuuugggagaccgaggcaggcagaucacuugaggucagggguucaagacaagccuggccaacaugauggaaaccccuccucuacuaaaaauacaaaaauuagccgggugugguggugcggaccuguagucccagcuacucagguggcugaggcaugggaauugcuugaaccugggagguggagauugcagugagcagagaucaugccacugcccuccagccuagaugacagagcaaggcucugucucaaaaaaaaaaaaaaauucugguuugacgccaggcacguggcucacaccuguaaucccagcacuuugggaggucgagguagguggaucaccugaggucaggaguucaagaccagucuggccaacauggugaaacccucacucuacuaaauacaaaaauuagccggcuguguuggugcaaaccuuuaaucccagcuccuggggaggcugaggcacaaguaucacuugaacccagaaaguggagguugcagugagccaagaucaugccauugcacuccagccugggcaagagugagacugucucaaaaaaaaaaaaagaaaaaguuggauuugaucccagcacuuuggaaggccaagguaggcagauugcuugagcccaggaguucgagaccagacuggccaacauggccaguauuuuguauuuuguaaaaauacaaaaaucaagcuggguguguuggugcauuccuguaguuccagcuacuugggaggccgagguaggagaaucaguugagcccaggagguggagguugcagugagucuuaugggccacuacacuccauccugggugauggagugagacucugucucaaaagaaaaaaaaaguuggguuuggaguaaguuuuccauuuccacugcuuacuagcuucaugaucuugggcaaguuauuuaaccuguuuaaguuuuuccucuuccauaaaaucuguaugguaaagggaccuaucuacuucuugggguuguaugaggaugaaaugagauaauccauauaaagguguauccuggucagaauacaguaaacauuagcuauugugguuucuacuguuacuccuuucugcaaacugacucaguuuuuuccagccuucuaugugacauaauccucugcuccaaaaaggcugaaguaugcagugccuuaucuauuuuuauauugaucucuguucuccucacuaaucugcucugagacccauccuucucuggcuauuacaauucauauuuucuuucuugugcuaucaguagaacucauagucuaccacaaaagcacuugauuuuacugggucuugugugguuuucucaggcugcuguuauauguaauuucacuuucuuaaccaaccugccagcucccaugguuagggaaacauuuucuagagcuuuucuguuuucuauaguacguagucugguaggcucugaaguaagacaucuggauuugaauccuugcuccucaaaccagacuaugagcauggcuaaguuacauaaugucccagugcuucaguuucauuacaguguuguuuuuagguguuaauucaagugaagcgcuuaugacauugccuggcauauggugaaaucucaacaaguauuuaucauuaucccuggauauagaaguaguuaaauuuauuguaguaccuggccagucauagauguuuaguaaguauuuauugacugaauaacauucuucucauuuucucauuguuauauauuuaauaguuccucaguuauugaauguuuuaugauuauaguaucuuucaucugauuuuuaaggcaugaaucccaucacagaaauacauagugcugaaaaagcuuaauuggguaugaaccaacucuucagggccacagagaaaagcuccauuuuaugaccacaguuuacauacuucaggccaaccagcuggguccuuaguuguuuaaagacuagggaacaaagaggcucaaagggaaggaaaggggaggcucuacgaguacauacucgaucaaugggaugaauacuguccacaagcagagcaucuuaauucccaauccacaggauauauauacacguagcaaaagcuggacuuugcucuuuagauccagauauugcauacuaguuaagcuuucaucccaaguaaaucuagauuaaaaaacuaugcuaucuuguauuuccauucaggacagccaagagaaaaauggaugaacagaguuucuucgguggauugcuucaugugugcuaugcuccagaauuugaaacaguugaagaaacuagaaaaaaacuacaaaugcggaaggcauauguaguaaaaacuacugaaaauaaagguauggaaagcauauugcuaaaugccuccugugugucaggcacucugccaggugugucaucaugcaauucccagucuagugguaggagaggcaaguaaaccaucacaguauucaguaacugugaaccacaggguucucugcagcacacuacauaaucuggguugagaagggagaaauauugguucauagaagacuuccuauaguaugugagaaguggcugaauuuuaaaggauaaguagacguuaacuaaaugggagaggaaaagauggaaaggcaagccaggcaagauguuuaaauguuuagaggaauaaaugagcaucaugcauuuaaggaacuuuaauuaauacaguauaaccaaagcccaaagguuucagugagagauaaguuuagaaaaguggguaagaagugaaucauggagggccuugugucccaugcuaaggaauuaaggcuuugaccagaaugcagugagaagcaguuaugauuugcaguugucaaaucauauaguugucacugcuaaucauggagaaguucuacuuuugaccagcaauuggcuaaaugcccccacaugccuguucuaccacauagugauggagagaaauaaagugggaaaacucuuggaaaacuuacucagaaaucugguaagagagcuguugagaauccccagucaucugcagacauugaacucuaacuuguaagauaaguaaauaaauagcaccaggaaaacuuguauguuuguguggcaaaggaaauuauaaaauauuaauguggagaaagaccuuugacauuaucugaccuggguccuaauuuuucugggugaggaaacuaagucucagaaaguuugugaccugccuauauuauuagagaugaauuaaagacaaaauaaggguuaaaacccaagcuuuggacucuguccagaguuuacuuuuuaacugcuuuaaucaucucaguguuggugacagccuaggauuaucuucauuauuugcuccccuuccucuuaagaccuuuuugcugugcugcugaccucagaauuaaacuaugacuuguuuggccuuggacacuuuaguuaagcucucuuucaucugcagcauucuagccucuacaagaugcauuuguauacguggucuuacuuuucaaaaacucuuauuauggaaauuucaaaacacacaggcagagagacuaaguuaacauaacucccauguauuaauauuaacauuaacaaucaucaacacauagccaauuucaucuuuaccacaucuuccauacuccauuccuguuguaaucugcuuuugggagaguaaaccagggaagaggcccuugccagcccuagaagugcgacaagcauauugcuuucuuuagugacuaacaaacacaagccaaggagcaugauacauccagauaguggaauacucugaaauuguaaaaaaaaaaaaaaaaaaaaaaccuuucuauauaaugaugaaaaaccucuguaagaucuacagugaaauggaaaaugcagaggugcagagaaaugcguauuacagguuaucuuaaaguggggagaaaaugggaggaaggagguggcaaagugagacauauugaacagauaaauaaaaaacaauagugauuacuuauggggaugaaaccagacccauggagagcaaggaaagggugacacuugaugcuauauaucuuuuuauccguuuuagguuuuaaaccaugugaauauauacccuucucaagaaaugauuuuuuuggaguagaauuuguuaacauuuuuaagugauuuuuuuaaauuauaugauucugaaugaugaaaacaauaaaccacuucuguuucccuuucccucaacuuuuaaauuguaauauaaagaccauuacgugacaaagaagaaauugguuacagagcauaaagacacagaggauuuuagacaagacuuccacucagagaugucuggauuuuguaaagcugcuuugaacacuucugcagggaacucaaauccuuaucuuccguauuccugugaauugccuuuauguuauuucuccucaaaauguauguguucauccgggggaccuguagacagagcaccagacuccucuaaggaugguagaaaccaucauaaaacaauggggcauuauaaccacaaugacucuuugcggaaaacacagauaaacucuuugaaaaacucaguggccugcccuggugcacaaaaggcuauuacgucuucagaggcaguugacagauuuaugccuaggacaacacaacugcaggagcgcaaaagaagaagagaagaugaucguaaacuuggaacuuuucuucaaacaaacccaacugguaaugagauuaugauuggaccucuguuaccagacaucucuaaaguggauaugcacgaugacucauugaauacaacggcgaauuuaauucggcauaaacuuaaagagguaagguuauuuuuaaaaaacuauucuaagacacgauuugguuauaggauuaaauggagaauuauuugugggaacaauaguacuguaauuuuuuuucacuuuuuaguguuuugauguguuuuucuacaguucucuguugaaauaacugaauuuggcuaacauuuuauuugcuuuaaacuguuaauacuugcuuuaaacaaugaacagacauuuuauaucacuguagauacaaaauauuaaagcagugguuucagccaauuaaaucaaucugugagaguggagcccaggccugccauuuuuguuaaaagcuccccagguaguucuaauaugagccaaaguugagaagcaaaaguauuguaaauuauuucucucaaauuuagaguuauuacaguuuauaucaaauucaaaaugcuuaauuugcuuuugugauaaagagcaauagaagguggugagauuucuaaaaauuaggccuccagguaugcauuucaaauguagacuucuuaaaugaucgggaucagauugugcugccuagguagucuguuuuuuuuuuuaaugucauuuacauaaucauuuuccauuuccuaagcacaaaugaaguuaacaucugaguuagcuuuugaaagacaccuuuuugugggguagggacuacuguuacaaaucauaaacugaggguuaugacauucucuuauacuuacuccaagaugcagaaacugcuuuucacauaguuuuacucauauuuuacaaugugauuaagggaggcuaagguaguuuaauuucauauauguacauuuuuuaccuaaaaauaucugauuaaagguauuauuuaauaauaauuaaaauccgugggcacaguuuugaagccuucuuuagcuuuucaguuuaggcugggcccagugccucacaccaauaacuucagcacuuugggaggcugaggugagcagauugcuugagcccaggagucugagaccagccugaccaaugugaugaaaccccaucuuuaccauaaauauacaaaaauuagccaggcgugguggugaacucuuguagcuacuugggaagcuuagguggaaggguacuugagucugggaggcggagguugcagugagccaagaucaugccacugcacuccagccugggugacagugugagacccugucucaaaaaaaaagguuuucaguuugugcugccacccuuacuuccuuccuucaguuacagcugaacugaggcauagacauagauacauaccugucucaaccagagcugauuacauuuucaagauaaacgugugaaguccaaauucuagguccagaaauagaacaacaaaaaaaagauauuaaauacaguuuacuauaguuucuaauaauuuuccauuucaaaugaagacucuuacuuugcuuugacuuauuguauacucuuuguacacucuuuuucugaugguguguuugcuuuuccuuuuucuccaggaaauugaggauuauacugcuuccugcucauuucuccaaagguuuucauccccccaaaucuaucaaacguuaucaguguuucaagaaugcaaaaccaggauaucuaucugaauccguaauauaacaagugucuuuagaucuauaaaggaauguuaaaguagagcauauguucacuuuucuuccuccaaauuuuuuuucuuuuuaaauagcuuuagaaauuuuacugucaucaguauucaaauggaagacuccacucugugccuaggucauaggcuguaccuugaacuuaggcgaacucugccucgaaagugacaucaaggauugaacuauuggauguagucuuaccucuucuaauagcuuauuuacuccugugcuauagaaacuaaguuuuaaugguucuuuuuuuuuuuuaauuagguaauuucaucugugccaaagccuccagaggacaagccagaagauguacauacaagucauccauuaaaacaaagaagaagaauauagagugccagcagcaacuuaguauuuucuaaaaagaacauuuauuauuuauuuuuagccugucauuuuaauucuucaagagauuuuacugcugguauuuuuuaaugcacuccucuuuguaauuucauucaagccauuugucuaaagucauuucuuuguuuuuugggagauggagucuugcucuguugcccaggcuggaaugcaguggcgugaucucggcucacugcaaccuccaccucccggguucaagcgauucuccugccucagccuccugaguaucugggauuacaggcgugcaccaccaugccuggcuaaguuuuguguuuuuuuuaguagagauggguuuucaccauauuggucaggcuggucucgaacuccugaccuugugauacaccugccucagccucccaaagggaugagccaccgcgccuggcccauuucuucuuuuuuugacccauacuuaauguugcagaaacuauucuugucauaacauuaucucucauguacaguaauuauauguaaauuaauugaagcaaauauggaaacuuuacaauagaaauaaagauaggcagcca

SEQ ID NO: 191444 - RNA, 11978 nt, Homo sapiens
gggugaaauucaaucuuuauuuuaaaagaugguacacaaccaucugccaauuuauaaacagaugaucaauuuauagauuuuuaaaagucuacauuuuaauaaauguuuuacauuguguucauuuuauuagccauuuuuugauuuuccuaaaaucuguuacuuauuaaugaugaaucuacuccaaaaucuuuuuuuuuuuuuuuuggagauggagucaugccgucacccagacuggagugcaguggcgcgaucucggcucacugcagucucugccuccugaguuccagcgauucuccugccucagccucccgaguagacuagcugggauuauaggcgcacgccaccacgcccagcuaauuuuuguauuuuuaguagagacgggguuucauguugaccaggcuggucucgaacuccugaccucaggugauccgccugccucagccuuccaaagugcugggauuacaggcgugagccacugugcccggccucuacuccaaauucuaaguacgauacuguuuugguuuuaaauaccauuuuugguuaaagagccccauuuaaauuguuuaaaugaaauaaauacauccaaaguaaaugcacggugaaaaauacauuuuaauccaaaaguuuugaauauuggcacuuagaaaguuauuuacaaucaauuuuacuauacccuuugugaauaaagagauaauuauguacguguagcuaccuauaguuguuucuuuccaacucaaacaccauaacuauguggaaaaaggguaagaguuaaagcugcugcagcucaaaaucauuacaaucaacuuagauucugcaaauuuucccaggguugaaaaaugcugguuaaaucaggacaaaagaggaggcaagugaguacaccccacuccucucccauuuuacguguugcucccuuacuuaaccggcaaagaccugcaccugaauucuagacaauuucauauacaacaggccucuuauuauggguccauagcagaugguuuaggguagauguuuuaaagauaucaaugcuaauggccuaccaaugacuuucaugaccucccaauauucguuuuaaugguagucaagagacuaucaagcaggaagccugaucucgacauguuuccucugcggcuuuggugaagcugacuaucugcaguauaaaaucuuaugguuugaucgaagucucauuuuugacuagaaacaguaaagagcagcuuuauuaagaucaauggaaugguucugaaugccuguuucuacagaaggauuaaauuaaaauuuuuucuuuuuuuucuuuuuugagacagucuugcucuaucacccaggcuggagugcaguggcacgaucucggcuuacugcaaucuccaccucccgaguucaagcaauucuccugccucagccucccgaguagcugggauuacaggcaugcaccauaacacccaacuaauuuuuguauauuuaguagagacaggguuucaucauguuggccaggcugguccugaacuccugaccucaagugauccauccacucaggccucccaaagugccgggauuacaggcaugagccaccgcacguggccuagaugaaaguuuuuaaaagccugggcuaauaaaaucauccaccaaucauuuuucuuaugguuaaagcagccaaaaagcugucacagcauuuuugagaugagaacauaaggcuuguguggcuuuaugauagaugcuguuagucauuuuauuugauuaagcccuuggucagucaucuauaccuuaauuaauauuuuguucuuauagaaaaauacaauccauuuuaugaguuucuagaaauaaauaauggagaaaaauagauacuaccuguuccuaauggucucucuggaaauuacagcuuuugccuaggaagauacacauauagaauauaauuuaaguucaaaauauauuucauuauauucuaucccuuuuaauuuuuuguuuguuucuuugagacggagucuugcucuguccacccaggcuggagugcaguggcacgaucucugcucacugcaaccuccgccuccuggguucaaccaauucuccugccucagccucccgaguagcugggacuacaggugugcgccaccacaccuggcuaauuuuuguauuuuuaguagagacaggguuucaccaugcuggccaggcuggucucgaacucccaaccucaggcgauccaucugccucagccucccaaagugcugggauuaaaggcgugagccacugugcccagccuuuuuuuuuuuuuuuuuuuuccgagacaagagucucacucuguugcccaggcuggagcacagcggugcaaucuuggcucacuacaaccuccaccuccuggguuuaggcgauucuccugccucagccucccaaauagcugggauuacaggcacaugccaccacaccuggcuaauuuuuguauuuuuaguagcgacgggguuucgccauguuggccaggcuggucucgaacuccugaccucaggcgauccacuucccgaccucaggugauccgccugccucggccucuaaaagugcugcaauuacaggcauaagccacugugccuggcccuaucccuuuuaauuuucuaagugaccaguaauaaacaaugauuuguuuauuacuagguagcaggagaaaaacuuuuuagucacuuuuccagcuaagaauuucauuuaaagauaccuaugacauaucuugugguacuaagaauauuagagaacuggaaauccaguuuuuuugugguuuuuuaagaaagagaaucugacuccauugcccagcuuggagagcaguggugcaauagcuggggcuacaggcgugagccaccacaccaggccuggaaacccaguuuuaauuugugaacuacaaaugguuggcaacugauuccuuaauuguuauugcaggaguaggcccaacaugaguccauauguagcccuucucuggucuggugggaacugugggaaauggugaugaccgugacuugaaauacucagaaggugcaugacaaacaaauuccaaguauuccaucuuccuuggaagaucuuccucuggcccuggaaggcagccaagggaaagguuaaauacauuuuugaccauauauaucauuuucauaagauguuaaaauuucuagacacugggagagaccacucugggagcaaccuggcauuagcccuugaaacaugcauuacuuugaaauuauucuuaaucauuuuuucuucuuuaacggcuuaaagaauauggcauucucccaaaaacagugauugaacacuugcaucauguuuauuuuguacccacacugcucuaaguuuacauguaucaauaccuucauuccucacaucaaccuucugagguaggcacuauuauuauucccauuuuacauaugaggaaagugaggcaagagagacuaagaaacuugccaaagucacauggccgguaaauggcaggcugugaaccuagacagucuggcuccagaacugguguucugaccucaugccaugcugccucgcuguaggacaaggaugcauaucagaaucuggggauuagaaagaggaggcaguagaggaaucccgaaggugauucugauacaucacugccucugcugagauccugauccauagauaagguaaauaaaaauucuauauacuuauaagcagaaggcuagaauuguuugguaauguaucaaacuugacauauaggugagaauaacagugguauauuauuugucccuggaguucucuccaaaaacacacuuaugcuuguucucaggaugcaaaaguaaugaugcaugcucacugcagaaagauaaaaagucugaaguaacuguaaaaaucugaaaacuuuaaaaauuguauuaaucaguaaauucuugugagucuaucucacaacuguuuuggcagcuuugaaauuaacaaaagcacagcagcugccauuucaacuaucagccuuuauacuauaaaggccuaagaugacauguguagcaugcagaggcacacauauugagaauuugcaaguaugggauaacugggauaguucuuuccuaaauuauuuuugaauagguuuguauaaauaaguaaccuaaauaaccuaguuccugagcaauacauucuuguaguacaguuuaacccugggucacuccaaaaaaaucuuauccauaccacuucuuaguagaugcacauugcucuaacucaaaauaacugauagcacucacacuccagcuacauaaaaugccucauauuuucuauaaagcucucuaauuuuuuuguacuuaauaauacucaugcuuuuuuuguuauggacugaauugcauccccccccgccacccuccaaauuuauauguugaagcccuaauccccaaugugaugguacuuggagaugagaccuuuagggaggcaauuaagguuaaaugaaaccauaaggguggggcccucaucugacagaaaugguguccuuauaagaagauacaccaaagagcucucacuccaugaaaggccaugugaggacacagcaagaaggugaccaucuauaugccaggaagaaaagccuccccagaaauccguguugccagcaccuugauguuggacuucagccuccacaacugugagaaagugacuuucuguuguuuaagccacucagucugugauauuuuguccugacagcccaagcugacuaacacacucuuuuacauaauauuggagaguuaacuaaguuaaaaaaaaaccugugccauuugucaaacuuaccuaugauauaggaggcgggaucaaauuggucucuggggcuagagaggguaggaaugagccacgucagugcugcacucuucucgcaauacugguccuggauaaaaccucugauuugagcauaguagggcuuuccaucuuguucaucaaucacagaaacaacaucaccaauuugguaauauacucccugggggaaacagaagauaaucccacauugaaaauaaaaauagaacaucacagcuaugaaugaaccuuaauagguaagcaaguuuucaaaguggucaguaaaagguguucgagauagucuaauguaucaguguuuauauguuuggugccaauucuaaaguuguuucacguuugaaugaaaauuauacauacacauacgagggugcauauaugacaguuuacaucuggagaaaagauuuguucauaaaguauuuugauuuuauauugccguaauaccauccccacuuuuuaaaaaauagacuuuauuuuuuacagagguuuuagguuuacagcaaaauugagcagaaguagagagauuucccauauacuuccugcccccacacaugcacauccuccccuauuaucaauaaccccucccaccacuagagugguacacuuguuacacggaugaacguacacugacauagcaucaucaaagaccagaguucacauuaggguucacucuuggugcuguguauucugugggguugggcaaauguauaaugacauguacccaccauuauaguaucauacaaagagaguauuaauaguuucaccgcccuaaaaauccucugugcuccguacuaucccuacuuuguuagccacagucaugaagcaguaguaagguuaaacggcuugcugaaagccauagagacugcagccaaagcuccuacaucagcucagcagucuuuucucuguacugucuugaaaaucaugcugauuugguaagaaugcauucuacaugccacccuccccaaccauccacucaaagaaaauagauaccaugaauucaaaccaaaacaaauucaaaccaaaaauaaucuuuggauuauagucuucaggauauguuuaccucaaccuacuguacaucuccuagacucacugcugccuuucucuuccacucccaguugaguuuuauauccuuccacaacaggacuacuaguauuucuggcauucaaggcuuugugucucauucauuucuguuccacuuuauacccaacuaacuaauguguacauguccuguguuaaauccucccuaugacucugguauccauccuauguccucuucccugggucuugagcuggaaauaaucucuccucugaacacccauaaugguugauccaaaucuuuaugacauccagcaccuccuuaaguggguauaguucuugguaagauauacuguccuugacuacgggaacaguguaauucauugcugcuucccuugaaacagggacuuggcagcagguaaagcuguaggaauguguaccucaaccauaaaaacacuuuugaggaaauacuuccaguaacugaacuguaacauagcaccugauaggccaggaguuuuuuccugguggacccuuuauccaagugucugaggguggcuguuucaucuggaucacuacggaugggucuggucuaugcaggccacaguccgcuacuugcuaguuccuacccaucaauagcugguccuuccucccagccaucaguccaaaguuauuuaucauauaaauaguuugcauuuaugguuuguuuguccacauguauaaucaauauucccaaauucuaaaugagaauacuugcuuaucauaggcuuacuaugcauaacacagcauauucaaauguaugcugaaugaauaugaauccaaaacaucuacuuucauaguguaaaggcagaaaugcaaaguaaaaacaaugucuuagugaaagauuccagugguaggcagugccuggcacauaguagguauuuauuaauaugugcuguguuguguacacauauauaacaccaaacaggacuaagucacugaucugaguagucuccucauuugcugagaggauucaagguuucugguagagaaaagggguccacacgagaacagcacuaguuuaggcaucaccagaucugaguucauggaguuguucugccacugccaugcuccagggaggccacucagccauucugggucuuggguggucacacucuuggccgugauccccaguggcucccacucaggcuccucuugcaugccugaucugggcucuagcucaguggcuggcagugaccucuugaacuugccaccauggugcugccugccaguggcacugcugugauagccacuacaauacugggcauuugcaacauuacuugacuacuuuguugcauuauuguccuuaucauuuaauaaacauggguggcagacaacaauacgaaaguacagacagucacaauaacaggucccacacacccuuccauggagacacacauggaaacuguuaguacacuaaacccguagcucaacaaguugcuucuggccuuaaucuguaaacugugaagguaaugcacaaauacgaagaugugauaacuccuacuauucauugagugcuuacucugcuaagugcuuaacacauaugauuucauuugacccacugagguaguaacuauuuacaauuccuauuuuacagaugagacauuagagagguugguccucgucacauagccagucacuugcuaaagcuguagagccaggaacuaugcucuaggcuuaagcucuggcaugagacugccucacuccaugacuuguuggcuaugugaucuuggacaaguuaauuaaccucgcugugccucaauguucucaucuagaaaauggggauaguaguauccaccucauagagugaacugaaugaaauaaagcaugcaaaaugcucagccacugauacacagcaacuguuugcuaaacuuuagauauuuuauuaacaauguauuaaauguuggaaaaauaagagagauguuugccuguguacagacuuuuuuuguuguugguuuuucccagcccugcugaggaaugccaguguaccccuguugggaggaacagacuucgacuauauagauugugggcuuaaaaaaaaguauacuuaagggcaucaucacuugaguuucucaguccaccugggucaaguauaaaguacuaacucacaccacuguccccuaaaugacaguucagaucccgaaacaccaaauagccuucaaugguugcugccugugccgugccaggccugccgagccuugggggucuauguucuaauuccuuuccuaagacuucugguuuaaacacaacaaucugucacuucucucacugagguaucagauguucauggacuuuggcccugggaaaccugaccuccucauucuuuuaucaaaacaucuuggaauuccucucacuaugaauuucuaguagguguuaauccucacuacugcccuuacucagcucaacuccacuuaaaggcauuuuagaaucucugggccuacucuacccauuugacaccacagucgacaaccucuacuaguccaaauccugucucuguccuucucauucuucaaugccaucgcacuaacggcucagucuuccauggcuccacacuauacaaucagcauuuuaagaauaauuccuacaaucuacacuaaaaaaaaauacuuaagauccucacaucaugugucaguaggcacuuucuccucccacuucagcucuagaugagauguuuuaauaacagccacuuaugggggaaaacagcuaagaagggaacaaaaaguauaaucacaccuuauacaaauaaagaguagcagagaccuuuagacuaauccaacauuuuaguggcacauuacccacuaggcccaacucuuccuucaguaacucuacaaaagcuuaccuuguagaagauugauucugcagugauuauaguggaaacugacucaggagcuuugaugggcuaugaaaauacaaaaaacauuagcacauucauaguauguaugugucuacaggcauuuucccagcccuaugagaguucugcaauuugagaaguacuaaaauguauuguuuggugacaagaacugcaauaaaaagauaaaugauuuucugaauguuguggcaaagcagucuauuuccacugcaauuucugcuacuauuagcuuaaaaauugcugagacaaaggacaaccuucugauuaugcugcugagaucuaaugcaaaguccucucagagcuucacuacacauaaacauuccaguuauaaaaauguaccugcucuaauagccugagcaugacagaaugcaaguaacagaaaauguacagaugaauacaaagugaaaaagugucuccucaaagacauuucccaacucaacuauggaacuagccauaauacucaacauagguuuucuagcaagcugaaacuaaggcuuuagaaacuuugagaguucuuaguaauuugcuaccauccaaccauuuuugagaucucuacuaaagcuucaauacauacuuuuaugccacaacauagaaaguaggccuccccagaugugucuugcuuaguaccauugaagaaagguugcagagaaacgauaaugaaauaauugcugagaacacgguauaccauacuuaaaaggaaaaaaaugugcauaugugauacaaauaucaauaacauguuuuguguaaucaacaaaugccucacuuaacuauaaaaaucuuaaauaaauuagaagcaacuagucugaauaagaaaauacuuuggggaagggaacaucacacacuggggccugucggagaugggggccaaggggagggagagcauuaggacaaauaucuaaugcaugcggggcuuaaaaccuagaugauggguugauaggugcagcaaaccaccauggcacguauaccuauguaacaaaccugcacauucugcacauguaucccagaacuuaaaguaaaauuaaaaaaaauucauuaaauuaaauuaaaaaaaaaaaaagaaaauagucugccaucugcauaagucuacugcagggucccuuuguguuuuagaaauaaauauggccaacuucagaaacgucuuuacggguaagugaaacauuccuguucugaaagaaaagaauaucauacugagacuuaaaaaaauaguccauaaugcacuguccacuguguuugaacauuaucccuuguuuauaaaaacugagaauuuaauugcaauaaaaauaugcuuucaacuacuuccagcacaggucuuucaacaaucucuuuucuuagagcagaagaggagauaaggcuuagcaaaauuuuugacucauauucaucaaauacaucaucaucauaagucaguaagauacauuuucuggggcuuuaauaacaaauaaauaugcaaaugaugaguucuaguguuaauauuuacuuagauuuuuaaagaaugaaaaaaaaaaguuuucuuaguguaccuggccauaucaagaaccauaaucucuccucuuccuuuccauagagaaccccaaaaaaugggcucaagguugauguuucuuuuaaacccauauuuuauauuuuccaggggaaaaaauaaaagcuaaaaaacaaaaaggaaagaguauuauuaacuuuauaaacagugagccuccugcaacagagcucauucccuuuuggggaaucuggaccauuccccagaauacuaaggaagggcuaccaagggcagaguccaaguucaauggugagaaaugaaggcaguggcaggauacacacaacgucauuacaguaaaaggcacuguccacaaauaucuuacauuuuucaauuuaaauauaugucuucucccuuuuccuuugguggagacuuucuuuucagcagccggagcagauuuguauuuaguguuucugagccgagcagaccuccugugaauuuccugcuuacucuguuacacaaacaaauuaaagaacaaaaagagaaagaaguaaaaagugcauaaagguugcaguacaaucaucuuacaaggaucccagaguauguacuuuauaagagcauuuaacaauuaagauugcccuuuugcuuuucaagagaaguaauuacagcaacuaggcuaaguaaaaccggaaguucagcacccggaaucucggagcucgcuggacaggcgucuccagagccuccaaaaggugugagcugcuuguaauagggcaggaggcgggaguaggagucagucuugaccaagacaaacacuauucauuuguugugucuacaauagagaaaaacacuuaacaacuuuacucccuaaggccagagaacguaguagguuauggcgcccccugcaacggaauacuuaagcugccauuuacaauaaugacauaauaaucuuacuucauaaccugauaugacaaaaccuuuaacaaggaaugagguccagcgccugcauuuguggcaugacacuguauacgacuguguagacauguguauauugagauuuucuuaagggcuuuacaucuugguucuuauugcuuugaauuucuuacaauaacaggugcuucggaaugggccaaacgaaagaucucaguaggagguggggaggggcguuccagccagcaggagcacggcgaucggggaagcccgcgcccgcccgcucccagccagcccguccccgcccgccuagcaccuggucggccuccgccggcgggaggggccggaggagcucaccugcuugccgcccccgcccccguugcucugcggagggguggcggaggugcuggcgaaggucgccgcgccgaagccgccgccgccgcugcccccagucccuccagccgcccccgagccugcgcccccgcugcccgcgccgccccggccagugcaaugauggcagaggaucucccccugcgcucccuucuuccacauggaggacgacguggucuugcauacgcugcaggugggcuucaggcccagcggcaugguggccggcucgggcggcccccgcgggcgcagagacacgggaauggcggacgguagcccggccgcccccuggucggcccgccacucccggcgauaggaagagcggugagagcgucggcacggagcugccggugaaaggaccaggccgcuggcgcugccccguggaggcgggaagcggguuccgccggcuccgcaggcggaggccaggauucccuggcccgaggcacugggaagcaggacugggaaagggaucuggccggggugggggggacgcggaga

SEQ ID NO: 191445 - RNA, 22378 nt, Homo sapiens
gugacgcacgggguggcgcgcgugggacccgagggguggggcuggguuuaguaggagaccuggggcaaggcccccuguggacgaccaucugccagcuucucucguuccgucgauugggaggagcgguggcgaccucggccuucaguguuuccgacggagugaauggcggcggcggcugggaugcugcugcugggcuugcugcaggcgggugggucggugcugggccaggcgauggagaaggugacaggcggcaaccucuuguccaugcugcugaucgccugcgccuucacccucagccuggucuaccugauccgucuggccgccggccaccugguccagcugcccgcaggggugguacguacauucuuuagggucugaguggggcgcgcgccgcagcugaggcggccgaagggcuggcgugggcggcuccguggccccgaccggcucaguggauggcaagggcgggggcgacugcggccaugcuuggcguggcuuugguggcaggcgcgcugggggcuggaguaguggcugcggcggcggcacugcugcugguggcgcuggcuguagcacccgccauugccuuguguuggggggcggugcuggccuccccggcuguguaucugauccuagacggggucgugguugcggcauuugugguuguagcggucuguacugaccgcagcaguggugccccuaguggcgguggcuggauuggcggcuguggguuugaacgacccgguggucguuggggcccuugguggggguccugacggagaugcuguuggcagcuggcccgucauccuggaggcugcccugugugguucaguguucugugggcuguagcagugccccuaauggugguuuauacccauauuaaggaggauguguagagugugguaaugguagugacuggagugugguaagggccuuccucugaugcuaauaauguaacaguuucucggccgggagcaguggcucacgccuguaaucccagcacuucgggaggccgaagcgggcggaucaccugaggucaggaguuccagaccagccugaacaacauggagaaaccccaucucuacuaaaauacaacaaaacaaaacaaaaauuagcuggaugugguggcacacgccuguagucccagcugcuugggaagcugaggcccgagaaucacuugaaccuaggaggcggagguugcaguaaaccgagauugcgccacuggacuccagucugggcgacagaaugagacuccgucucaaaaaaaaaaaaaaucauuuucuucaauuuaacagccuuauuaaccuagcuuucaaucucccaaauguuauuugauugugccuuuuacagucagcaauaaguagcuuuugaaaacuacccuuuuacugacaaugcaauguacaaacuuuugaccaaguagcuuuuaaaauaauuuuuguuugaaccauaccaggcauaagaaagaguuauuuauuuauuuauuuuuuuccuacacaugggaucuuuaaggaaaugauauuugucucugggaagacaaaguuacuuuuaguguuuaaagauaguucuauuagcugagguguacugugagguuguggugcuccuuucuauuugagaccaccagagaauugaggaguauuacccuuuuucauuauuuuguuugauuuucaggauacuuaauguuguaaucugcaggucucauuuuguggcaucuaaagaaacuuuuaugaagaaugcuagaguucuugcuagagcugaucuacucucuuaaaaacucuaaaaucaguggcucuaguucacuugcagugagagaagcaugagauugauuguuuacugagaaguaaauauagcuucuuaaacauuucccuucuuucuauacuacaaguuacugcuugucuuuuucuauaccuucuuuaagcaaguaucugggacuaaaauugugaguaguaguaguaguaaguagugaagaaacaauauagugggcccucuggggacacgaauuccacauuugggaauucagccaaguguagaucuaaaauacccaggggaaaaaaacccaauacaaaauaacacaacaauaaaaaauaauacaaauaaaaaaacacaguuuaauaacaguuuauauagccuuuacauuguauuggguauuguaaguaauauagaaaugguuuaagguauaugagaggaugugcauagguuauacgcaaauacuuugccauuuuauauaagggacuugaggaucccuggauacaaaucugugaggggguccugggaccaguucuccacaaaugccaagggacaaguguaguuugaccuuuuugguuuuuugcuacuaaugguuagaaaaguugccuggagacaccaauaauaauuggacauauucuggacaguguccaucauuuaaauuuacagugccuuaguguuuaucuggucguuuaucuuauaccguguuuugaguuucuguucuuuucuacaauagcuacucucuugagguauuugcaauuuggcuguucucaaguuacuucugaugcuuccuuuuuuuuugguaacuuuuuuuugaagucuuaauagcuauuuuguuuaauuguuuggucaugaaacgaaacuggguuucucucuugaaaugaaacacgaauugaauuuacuauuuuuuucucuuguagaaaaguccuccauacauuuucuccccaauuccauuccuugggcaugccauagcauuugggaaaaguccaauugaauuucuagaaaaugcauaugagaagguaagucuuccaaauaauuagaggaaaaaaaaaaaaacaacuagagaagugcuuuuuaaacuuuuuuaaaaaaguggcagaacauuuaaaaacauuguaaucauauacauauccucaguauaggaaacaaaauggaaacugcucugguuuaagagauggugucuuauagauaccuauccuuuuagcuuuucccauguccuggggucgucuuugagacaccauugaggaaaccuguaguucuggcaacuaugguuuaaaagccacuguucugaguuuucuauucacuuauugucauuaaaauugauauuaauuaacccucauuuuucuuuaccaugcaucugugggguuuucuaaccugcucuauacaucuucugugauuucacuguccacuugaaugacccacaugacaccauagcuacucaauuauuugcccgucuucucucuaaugagcuucccugugccaguuaagccauuuacuucacagucucgcuuuggacuugucacucuuaacuguuucacuuccacaauauuaauuuagauauccuauucguagaccauaccgucuccugguuugcuugugcaacuccuuaaauuauaacuauucuuugaccucauuggaucuugcauuccauuuacuuucuccugauccaucagccuucauucuucacuuuccucuuuccgcuuuggguccauggcaugucguuucuguuacacucuuggcaauacuguacuuuaaauuuccucgaccccgcaucuuuucauuguguucagcuggcagaagucacccuuggaggcagccaguuauugucuccuucugcaccagauuaguuucuuccugauuuuaugauugccuaccuuaaugauauuugaacacugcuccacaguccuauuauguucuugugauugggccuacuuuuccacucauuacagugacuaauucaaaccuucacuuuucuaaacuucugaaucuuucuaccucuccaucaaagcagaugauuuuuucuccuguuuaggagacaaugauuaaaaacguugauuuaggagacaauuauuaaaacauucaaagaaaacuuccucauuuucucaauuucaaauaugcaaaccuacuuguauuuauauaguaauccuauucucuuucuuccuaucacaguaauaauuaucaaacacuuacuuuaugccaguacuuagugcuuuacaaagaucaucucacugaagcuccacaaaaacccuuucagguauauuuguuuuauagaugacaaaacugagaagcagagaggauauauaauuucuucuuggacucacugcuagacaguggccaagccaggauuuacacauggucugauuucugagccuauacuuuuauuaaugauaacaauaauggaaaacaagucauuaagaugcuaaguaagccaagguacucuucucugcccuguauauaaaauuuggcagcagcucugugaagaacugcuauuauuauuauuaccauuuuauaggugagagaaacgaaacacagagagacuaaguucucugacuauaggaccaaagucauacagcaaguagguggaggagcugggauuugaacacggacagucuggcucacugcguucuaccacuuugauuuuauuacaacuauauuuugccucuuaucggaggcugaacucuccaucccucuuuugucucaggaacuuuuuacuuuuauuuguuuucucaguguauuguugacuucuuuuucaauggcaucuuuccuuuuucucugaaaaauucuugucacccguuuaaaaacuuccucaaaauggcuuaugaggcucuguauggucuagcacugccuaaugcucaacucucaucuccuccuuucucuuucucuuacuuuuagggccuuuguguauguuuagcuaccaaaccagcuccucauucuucuggucucaaccuaguugucuuuuccucuauuaggucucccuuuuuuagauucucucaucacagaguugcuuuccuuucuguaauacuugucacauuugcaguuuuauguuuguuaaugugauuauuugauuaauuuguauuuuuuccaauagacuaagcuuggugaguugggacaguauuuuuuuucaugauuauacccccagagucuagucuucaaucauaaccagaaaacugcaagggaaaguauuuaacaucuaaccaaauuaauauaaaauaaaaaaugaagucauuuaguguaggugagauagugcuaaaauagauaaauaaacuuguagugucuucacauagcagguacuauagaaaaggucaaauucuuuggcuagucuuguaaaauuuguuuuuaaccaaagggggaagaagucuauauuuucagagguguucaucacagaauuagcuguaauaacuaaagaaaacccugacauaucacccauauguccaauaaugaaagaguagucaguaaauuaacauugugauguuuauauagacaauagaaaacauugucaauauaaacugaaaaaagcauaauaaacaguuauauuuauacuacauuugcaacuaaaugaacauaauuauaaauuuggacaaaggaaggaggaguauggcaagaugaaaagaauugcuuuaagguuuauauauguuuuuauuuuuuuaauaaugcauuauuuugugauuuuaaaaaguuacugucguaguguugcauauuuuuuguaacaucacuauauguacuuuucucuuuuuaguauggaccuguauuuaguuuuaccaugguaggcaagacauuuacuuaccuucuggggagugaugcugcugcacugcuuuuuaauaguaaaaaugaagaccugaaugcagaagaugucuacagucgccugacaacaccuguguuugggaagggaguugcauacgaugugccuaauccaguaggugacacuguuaccauaaauaaagacaaaucuauaccucaguaguuauagcuaauagugagacauuauacauuuaaaauguagaaacagccaggcaugguggcucauuccuguaaucccagcacuuugggaggccaagguggguggaucacucaaagucaggaguucaagaccagccuggccaacauggugaaacccugucucuacuaaaaauacaaaaauuagcuggguggggcugguggugcacaccuguaaauuccagcuacuugggaggcugaggcaugagaaucgcuugaacccaggaggcggagguugcagugagccgagaucacaacacugcacuuuagccuuggcaacagagugagacccugucucaaaaacagaaacaaaaaaccaaacacacacacacacacgcacgcgcacacacacacacacacacacacacacagaaaccaaccaaacaaaaauguaauaaaauguagaaccaguuuauuccuugguucaaaagucugaagaaucaugagaagaaaggccauggauaacugauaaguaauggguauuuaguuuuauauuugcugucauggcuaaacaauauuaaagggcuuccuguacaaauaauggaaucaaugauaacuuagcauacugggauuuaauuugaaaggguuauuagacaaugcuguuacuucaucaaaaggacuuccugccuacccauuccugccugaaauucuaacauaagcgcuguuuagagauugcugacuucagaaguccucuuuuaaugcaacaacuucacgugugggguacaucuauguguauguuuuacccucaaaagccaaauacgaaauuguuuuaaguugauauagaacacaaaucagacaauuggccccaaugcuugguaugggcucuggcugugaauguaacacacauuagccaguacccuaguauagcaguuaagaguuaacauuaaaucuuguuucuagugauggggaaugagggaaugaaugccucuccuuaaggccaaaaaacagggcccuggaaaaucccucuguucagauauauauauucauuuagacucuauucauuuagagucagauagaucuauucauuuagacucuuaaaauguaaaugcccaaaggguuaaaaccauuacuuguguuaguguuacauaauuauaauaaccuaaauggauuuuaugauaaaacaaaaauguguuuuaaugccguauccccguuuugaauuuuuuugaagguuuucuuggagcagaagaaaauguuaaaaaguggccuuaacauagcccacuuuaaacagcauguuucuauaauugaaaaagaaacaaaggaauacuuugagaguuggggagaaaguggagaaaaaaguaagcaaaauguuuuauguuuguccuaacauuucuacuucucugugaauagaaaaguagaguauauauguguguaguauauaaaaaacaaauuacaguguauguaaaacuaccuuagauuuaugggaggguuauguaaugauuaccaugaaguuguaacugagaauccaguuuuuauacugggcugcaaguuaaguauugccuucagaagcaauugcugugcccauaguaggaagcaacaucugcccacagggcagcaggacccagggcagcaggucacuauauucugggucuggccuuuggccucuguaagaguuccagaaucuuuguuuuugguauacuuaaguugauauugauauauuuucuaaccauacaagaaacugauguauaaauuagaaugccaauguaauaaugcaugugagacauauaauuacagcaccaagaaauccagaauauuuacugauauucuuuuuauugacaaauauaauuggaaagccagaugaucauuggaaguucauuuagugaauguggaauuaacaggaaauuaauuggauaauuuuuauuaguugucaucaaauuaugcuugccuggugcauuugucuccaguguugggauauacuaauuggugauuauaguuuucuuuuacauaucgccaguaauuccauuuuggcccugaucuuccuacuuuuaaccugggaaauaaucugaucuuuggcuacuauuccuugggaaguaccuuauuauugucauaugcacuauaaauaaccuuuuuucugcuuuuguuauugugaccuggaaaucaaauaaccacauuuauucuuuucaugaugaagugcucaugagugggguuuugagauguguuucugggaucuguuuuggcuguuuagagggacagggugcuucacauuguuugguuuauugccccucuuuguuguuguacauagucacaugucugucuacagacuuuuuuugaugauaugaauaggaucuuguuucuucuugaguucuguuuuuaauucucaauuuucuuucacuuuuuggaaauaguaaugagaauaaucuuuuuuuucucccuagauguguuugaagcucuuucugagcucauaauuuuaacagcuagccauuguuugcauggaaaggaaaucagaagucaacucaaugaaaagguagcacagcuguaugcagauuuggauggagguuucagccaugcagccuggcucuuaccagguuggcugccuuugccuaguuucagguauggauaaagaauauauuacacuagguuauuuaacuuuguauaauuauuguaguguugguaugcuuugccuuaacaaagauaaaaauuaaacaaguaaaacauacaaaauggguaagauuaugaauccccuuucuucuauaagaauucaagacaaauuuucuuuauauaaugagcucauuuaaaguaaguuucaguuuauuaaaaaggugauuuguugucugucuagucuaauauuuuauuuauguuuuuguuuuugagauggagucuugcucuguugccccagcuguagugcaguggugugaucucggcucacugcagucucugccuccuguguucaagcaauucuccugccucauccuccugagagcugggacuacaggcacgugccaccaugcccaacuaauuuuucuauuuuuaguagagacaggguuucaucauguuggccaggcugguuucaaacuccugaccucaggugauccaccugccucagccucccaaaguguuaggauuacaggcgugagccacugagcccagccuaguuuaaaagccugcuuaccucacguauuccuuauccucaggaaagucucugaacuauaccuaaaagugauacagcucuucucuagcacuuguuugaaaucuuugguggcuuuuuauuguauugugaaguuucuuuguuuuaaauauuugugccuuuauuuaauuuucuguuucuuaaggacagggacugccucugauauaaagaaauauugcucuuaggacuugaucuauagcuuagugcuuaguguuuugcauauuaguaggcuuucuguacuuuuguugauuuauugguguuuaggugacagauggggaggagauagauugcuagucccuuuucuucuauuucugcccccucuaucuaguuacagauuggaagaggggugggaguaaaaggaagagccaggagagauucccuaaaguucucuggaacucaucauaccuuauauuugcaaggagcuuugcaguuucaaaauguuuucauauaucuuauauuagaacacccagcacagcccuggacucauaguggguucuccauaaaugugcauuucuuuuuuuuuuuuuuuuuuuuggugauggagucuugcucucucgcccaggcuggagugcaguggcaugagcucggcucacugcaagcucugcuucccagguucacgccauucuccugccucagccucccgaguagcugggacuacaggcacccgccaccaagccuggcuaauuguuuuguacuuuuaguagagaugggguuucaccguguuagccaggauggucuugaucucccgaccuugugauccgcccgccucggccucccauagugcugggauuacaggcgugagccacugcaccuggcccauaaauguacauuucuaccugccuguuucuaccugcucugucucuuggaugaagucagagcuugcuauguuaggcccuucacauucuggcccagucuuucuuucuucuacucauaccaacuaauuuaaccagauuauucaauucacuuucuuaaacaggccuauguuuuccugguucgacuguauucauacaguuaagccccaacaucuucucuucuguacacaugguuucaguugauccucaauaacagauuaacagucuuguaaaugaaacagaguaggaguuuuuuuuagaaggcuugauuuaagagggggcuugggagucagacugccuaguuuuaaauuccagcuccaauguuugcuuucugugugaucuuaugcagcuagcuauaacuugagguuaauaguauguaccucacaggaagauaaaagugaguaauucauguaaaacacuuaacaugguaccugcuacauagugaacauacuauuuaaagguaaaguuuaggaguugaagcuuguuuucugaaucugcuaguauuuucacccccuacaaaaaacuauuguauuagaaagugaaaaguagaaccagauuccauggaagaaccagagugacucuucugcuuuaagacuugauuugguauuaaaauuggaauuuuauguuaauuuaaaagaguauccuacuuucuguugaacuggaaaauacuucuaaaggaauuucuugcuuguuuuaggccuuuaguuugaacacaggcaauguguuaagaaucugggauauauauguuaaauaaagcacaguucuugcccuuagggacuauggacauuuuuaacaauguaagauuuucaugacuuccaguauguuccugguucugauuuuuuugucaauuauuuuagagucauuaaaguugguuaaauaagaugcuuuaugcucgguccugguucucaaaaugaauuugauccuagaagguuauuucuuuauuuaagaaaaucaucuuuaucuuuuaauuacagacgcagggacagagcucaucgggaaaucaaggauauuuucuauaaggcaauccagaaacgcagacagucucaagaaaaaauugaugacauucuccaaacuuuacuagaugcuacauacaaguaagagcuauucagauaacauauuaagcugaagcaggaaauuacacauuaaaacacaguuaaauaguauuuccaguuaaaaaacagugaugcuggcaaaauaaguugguagcugugaucuuuggacucuuuaaauuguugagacauaaacuauuggcauccugugucuuacuguaaucccagugacuggguaugguaaaaguuugcuaaugaacuguaauggagucuuuuguaaucaaaaucguuuugugcuggucugucucuucccuaagagaaaaaaaacucuugacuugugauagucaaauauaagagaccacuauaccugaaaaauguauucauuaugacacuuuauuuaaagguugaggcaugaaauguaucugccaaaauguuaaauuugugucuuugguucauuccuuagggaugggcguccuuugacugaugaugaaguagcagggaugcuuauuggauuacucuuggcagggcagcauacauccucaacuacuagugcuuggaugggcuucuuuuuggccagagacaaaacacuucaaaaaaaauguuauuuagaacagaaaacagucuguggagagaaucugccuccuuuaacuuaugaccagguuuguuggauuuuucaguuucauugcugccuuaugacuuugaggaucuguggcuaauuuuuaaaagggacaauuugagauuuucuauauacuauagcuuaaauugaucagcuucucuauuuuuagcaaauucccuauaaccuuaccuaaaauaucuuaauguuauugcuucuugccauuaagcuuuaucagauauguuuuggguugauggcuuagagauccuuggggauguuucuuugguacuuacuuccucugcuucaaagucuggcuucuguacauagaggauauuaugugcauguugugugucuuaugaaguguagaagccucugaauuacuuagaauucuguauguccagaguggccugggcaugagcagagacuucuaaaaguaguaguaguaguaguaaugaggacaagacauuuacaaauacuacaugcaacuugcuggguggaaaggaagagaggacaacucacugcacaaccugacauuccaucuuggaagcaaaccuuggugaugucaucuuccuguuaucuuuugugcuuuugguccuauauuaauauggcacauuacacugauuuucagauguuaauuguauuccugggauaaauccuacuuugucauggugcauaguucuuucuauauguuacuacauauaaacuugcugguguuuuguugaggauuuuugcaucuauauucauaaaggauauugaucucuaguuucacugugaugucuuugacugguuuugauaucaggaucauacucaucucauagaauguauuuggaaguauucuuuuuuucuucuaauuuuuggaagaguuuguggaugauugguguuaauccuuuuuuacauauuugcaaaaauucagcagugaaaucaucuagaucugugcuuuucuuucugagaagacuuuacuuacuaauucaauuuauuuguuacagguuuauucagauauuccauuucuucuuaugucaguuucaguaguuuauaucucucuaggaauuuguccauuucaucuagguuaccuaauuuguuggcauacaauuguucauaguauucucauaauccuuuuuauuucuguaagcucaguagugaugucucaacacucauucuuguuuuuaguaacuuaaaauaacagcuuaacugauauauuuacauagcauaaauccauccauuuaaaauguacacuuugugguuuuuagcauauuaagaguugggaaaccaucaucauaauuuaauuuuagaacauuuacaucacucccaaaagagagcugguacccauuagcagucaugcuucauucucccugacugcugccccuggcaaccauuaaucuccuuuugccucugugaguuugccuauucuggauauuucauguaaaugggaucauacaauuuguagucuuuugugacuaccuuguuucacuuagcauguuaucaggguucuuccauguuguagcauguaucaguacuucagucuuuguuauuaccaauaauauuccauuauauggauagaccacauuuuguuuauuuguucaucaguugauggacauuugaguuguuuccaccuuuuaaacuauuaugaauaaugccgcucuaaacguuuguguacugauuuuauguggacauguguuuucaauuuuggggggucauaccuaggaguagaauugcuggguuauaagguaacuuugaagaacugccagacuguuuuaaaaaguggcugcaccacuuucaaaucucacuaaacaguauauguugguccugacuucacccccucaccaaacuuguuacuugauuuuuuuauuauaauaggugugaagugauacuuuuuuuuuuuuuuuugagacagagucuuggugugaugcccaggcucuagugcaauggcgcgaccuuggcuuacugcaaccucggcuucccagguucaagcuauucuccuuccucagccucccaaguagcuggguacacaccaccacgccuggcuaauuuuuguauuuuugguagagacaagguuguaccauauuggccaggcuggucuugaacuccugaccucaagucaucugcccgccuuggccucccaaagugcugggauuacaggugugagccaccaugcccaguugguauuuuguuuugauuuugcauuucccuggugacuagugauguugagugucuuaugauguguucuuuggcuuugguauacuucuuuggagaaaugucugcucacauccuguucccauauuuaaaaugaguugucuuuuuauuauugaguuguaagaguucaucuauuuuuuuuuaaugugcuuuuggugucagagaaacuaaugccuaaucaaaguguaugaagauuuauuucuguguauucuucuuaguguuuuguaguuucauaucuuacauuuaggucuuugauccauuaugaauuaauuuauguauaugaugugaggucaucauucuuuugcauguguuuauccaguugucccacacuguuuguugaaaagacuauuuuuuccacguugaauugucuuuguaaaaaaaucuauuauagccaggcgcaguggcacgugccuguauucucagcuacugagaagcugagaugggaaggucgcuugagcucaggacuugggguccagccugggcaacauagcgaaacccugucucugaaaaaauaaauacauuuuaaaaagccucuugaccauaaauuuaaggcuuuauuucuggacucaguucuauuccauugauauguuuagucugaugccauuacguaguuuuguaauaaguuuugaauucgggagugugaguccucugacuuuguccuuuucaaggcuguuuaucuacuccuagucccuuuaguuuccauaugaauuuuggggucagugugucaguuucugcaaagaagcuagcugagauuuuugacaaugauugcauuguaucgccauauuaauuugggagcacaauuuuagucuuuaaaucugugaacaugagaugucuuucucuuauuuuaguucuuuaauuucuuucaacaauguuuuauaguuuuuggugcacaauguuuaaacuucucuuguuaaauguauucuuaaguauuuuauuauuguuauuuuuuugauguuauucuuucuucugccaguccaaaucugcuguugauccccucgggugaauuuuucauuucaguucucauacuucucaguucuugaauuucuauuugguucucuaaaaaaauaauauauugauauucuccauuuuacuagagauaucuaggcauauuuugcuauaguucuuugaaccuguuuauaauagcugauuuaaauucauuaucuaguaaguccaaugucugggcuucuucauggauaguuucuauuaaacugcuugcuuuuucuauguacuggccauacuuuccuguuuugguguguuuuuuguaauuuuuuuguugaaaacuguacauuuaaaauaauguggcaacuguggaaaucagaugcccuccucccuggguuuauuguugcuggcucuuuguuguuguuguuguugcugcugcuguuuguuuacugcguuuccuggauuaauuaugucauuccuuguucagugaggucacugaaaucucugcuugcuuacuuuagugggcaucuaauauuuggacagagauuuacugaagugcuuugaacagccagucuccuagcuuuugcugaaaggcucuguauguguguguuaggggauguuauuaacacuccaacaggcaguuacaagucugccuucacuaccuguguguacaggucagccagagguaaaagauuacagccucuuagaucuuaccugggcauaugcauggucuuauacauauguguggccuucaagauucucuuauguuggaacuuuucaaagucuccuguggacaucuuacuccccaguuuucccuuuuaaacuucuuguucugucucuuagcaccaacugauaucaccaucucaggcgccuucaguguuaaacaauuuuugcuaaauauuuuuggaaaauuugcucuggcuccucuaauaguuguuaggcuucuggcuuucacagcugcuauaguugucaugcuguugguuuccggggcuaccauggauuuggggagaggaggaugaaagaaauacaacuuacacuaccacaaagcuuacucuucuuaccaagauucagauuucuuuuucuugaauuaacucuccuuagauuguugcaagccuuugguuaaucuuccagaauuuugaaaaaguugacauuaagauuguugcuacuguuuucauuuuuuggaggagugaauuuuuguagguucuuacuucauucuucagggcaaucgcuucuguuaccuugcccuccuuuuucaccauggacagugguagagcaugauaaccccagccacccugaaccaguuaccucuguacuuuuagcuggaaugcaagcugucuuguacuaacuaagaaguuaaacuaauuuuuuguacuguugaaguauguuauuuauaacaaucaggaaaugcuuucucauuuuagcucaaggaucuaaauuuacuugaucgcuguauaaaagaaacauuaagacuuagaccuccuauaaugaucaugaugagaauggccagaacuccucaggugaguaucuuggcuacaucuuccccucuauacccccaguuuuuaucaaaaagaagaaauagguggguguggugguucacaccuguaaucucaacacuuugggaggcugaggugggaggaucacuugaggccagaauuugagaccagccugggcaacauagugagacugaccucaucucuacaaaauuuuuucuaaaaauuagcuggccauaauggcacaugccuguggucccagcugcuugggaggcugauguggguagauugcuugagccugggagguugaaacugcaguaauccaugaucacgccacugcauugcugccugggcaacagagcaagacccugucucaaaaaaaauaaaaauaaaaaagaaagaaaaagaaaagaggaaguagaguagcauaaaagagauuuuuuuaaauuaaaaaaguagaauaaucacuucuaccuaaucuucaguuuuauauacucuaaaaacauauuuuuaccuaauuguagauaguauacgugcuaaucuguuuuuuuuuuuuuugagacggcauuucacucuuguugcccaggcuggagugcaguggugcgaucucagcucacugcaaccuccgccucccggguucaagcaauucuucugccucagccucccaaguagcugggauuacaggggcaugccaccaugccuggcuaauuuuuuguauuuuaguagagaugggguuuauccauguuggucaggcugaucucgaacucccgaccucaggugauccacccgccuuggccucccaaagugcugggauuacagguguaaucccgcgcccggccuacaugcuaaucuuuaaugcuaaucauguucugcauuuuucuuuaacaauugggguuuuaaaaaucaaaguacauauuuuucuugguuuuaaaaauaacauuuuguuguaaaaaauuguuaauaugaaguguacaaauugauagugaaagccucucugaaauuccaacccuaccuccaaggcauuauggguuugauuuguguacuguguacuuccaacccaacgcuggcucacuggaaaucaucuugaguuaaaauaauuuuuaguuugccuauuaucuagccaguuuuuaaauauauguacagaugguucuugauuuaugugauucaacuuauaauuuuuugacuuuaugauggauuuaucaggauguaaaccuaucauaagucaaggagcaucugaguaucccauguauauucaugcuuuauuacacaaugaucugauuauuugucagcacauuuuuaaauucucuaaugaaauguguggcuuuuguuuauagacuguggcaggguauaccauuccuccaggacaucagguguguguuucucccacugucaaucaaagacuuaaagacucauggguagaacgccuggacuuuaauccugaucgcuacuuacaggauaacccagcaucaggggaaaaguuugccuaugugccauuuggagcugguaagaugauuauauuuuagauuggaaauguuuguucugauaacauauuugucucugucaaaauauuccgaauuguguuuacaaauuaucucucccuuuccucauagggacauuuuugcaaacuuuuuuaggagaagaaucuuuauaaguuggagaaaaauauuuccuuuguaccaaauggaauuguuccauaaauccuuauauaaugcuucacuacuuccuaaccugucugguuuuauuaggucuaauuuuuauagaacauccuuguuuucccuuacaaugguauuuaaagcucuuuguggauucucuuuuaaagaaccauuggagucagcacaccauucagggaauaacagauuacuagcauuucacaaaaaagcaaaggcagucuuuuaaaauuaaagcucuucucgaucguuagucaacauuuuugcucucugaauauccguaugagaaaauggucuuuaaauuugggcagguuguguguaggcuugcaaauuucauuuccaguaagauccuaaaauaauuuagcuauacccuuguuucuccaguaauuucucuguccauugguucucuguacugauuaaacuauauucuaugcuuuagucuuuccaaagggaucauuuaaaugacagaugacuugucauuggucacacuuuuuccacauauaaaggaaaauauaaaguccuuugggaacuucagaucuuaacuuuauguaauaaauuuaauacugugguguauaacacaauauauaaaagaaucauaguuuuuuuuuugagagagucuugcucugucacccagucuggagugcaguggcacaaucucucagcucacugcaaccuccaccucuggguucaaguaauucucgugccuuagccuccugaguagcugggauuacagguguguaccaccacgcucagcuaauuuuugagcuuuuaguagagacuggguuuugccauguuggccaggcuggucucgaauuccaggcuugaagcaaucugcccaccuuggccucccacagugcugggauuacaggcgugagccaugccaccuggccaaagaaucagauuguuaacagaugggaagagcauuaguucuguagcccaaauucugccccaaagaggaaucguuucuaaacuaguaauuaucugguuuccacuugaacuuuacuagaaauggguuguggguuguucaguuaccuuuuaugauggcucauucuauguuuggacagcugucauuuuuagagccuuauguuaaagcugaaaucuguuucuuuuuaacaucucauuuauaguugguccuaaccauagucucugaacuuauauuguaugagguauuugaguacagauauaaugucuccuccaucuuuuuuucaaucuuuguguuaguuuccuagggcuucuguaacuaauuacaauauggguggcuuaaaacaauagaaauauauucuaucacaguuuuggaggcuggaagugugaaaucaagguauuggcaggaccgugcuccuccuuaagguucuacaggagaauccuuccuugcaucuuccuagcuucugguggcucuuggcaacccuuggcuuguaacuacauuguuccaauuacuaccccugucuucaacaggcuuucuucuuguucaugucucuguaucuuaacauggcauucuuauaaggacaccagucauuggaucuaaguccuacccuaagucagggucaucucaucuuaaauaauuguguauauaaagauccuauuucccaauuaagaucacauucuaagguucuggauggacuugaauuuauggggggauauaugaucuuacguuaaucuuguuaaauaucacauuacaugucucuaauuucuuuacucauucuuuuaccucguaauugugcuguuuauuuauguuggugcauauaguucauucauuuucauaauauuacauuuugugaaucaucagaauuuaucuacucuuauguugauucaauuaggauacuucuugcuuguugcgauuaaauccuuggacuauucuuccuguaagccaagcuucucuuuaguuguuauauuugaaauauggaccaauuuguaaaugcucaucuuaaaugucacuccuagaaauaaguacaguuaugggccaagcaagcacugugcuaagcacuaucaguuuagguuuuuucuuuugaugaaaaaucuugcaaugaaaugcccaaaucuuaagucaacauucauugaguuuugacaaaugaauaaccuuuaguuuaguccaauguaucaaucuuuuaaaugguuauugcuuucuggcccugucuuaaaauuuuugcuuagccccugagucaugaagauauucuccuguucuucucuacugaaauuuaugcuguuagcaucaugguuugugacccuucuugaauuaguauuugauuauggugugacauaggaguugaauuucauuuuucccccauguaauaucuaguuauuccuggaccuuauguugaaaagacuugcuuuuccucauuggcuugcuuuggugucuguacugauaaucaaauaaccauaaaaauauucuguucugggcucucugcucuguuccauugaucuauuuguugauccuuaccuaguaccacucuguuuuaucuuuagucuugaagucagauuugaaaucaguuuuauguccuccaacucaguucuuuuuccaagauugcuuuggauauccuagguccuuugcauuuuuauaugcauuuuagaaucagcuugucaguuucuacaugggugugacuuuuuaguauauuauuuuggguucauuaaaucucauuuucuuccauacauuuauaaugacauuugagguuugauuggaagguuuucauauugacuuuuaacuagggcuuucuugggacaaacagaauauucuacuauauucccaaacuagauuaccaucuuaugauucaaacuuuccauauauuuaacccagauauauauuuucagaaaaaguaauuggaaaaguuaugugaucagucaaguacuguuuuccuaaaaugugguauugaaaaucuccuggaauuuuuaauaauucauguuguuuuaugugaaaagaaugucaucuuuuuauuauauuaucuguacauuugcuguucaucuaaaauguagauaauaucaccccaggcuaaaaaggaugagaaagaauuuaaacugauucuuauaacuuuuucuuuuuuuuagggcgucaucguuguauuggggaaaauuuugccuauguucaaauuaagacaauuugguccacuaugcuucguuuauaugaauuugaucucauugauggauacuuucccacugugaauuauacaacuaugauucacaccccugaaaacccaguuauccguuacaaacgaagaucaaaaugaaaaagguugcaaggaacgaauauaugugauuaucacuguaagccacaaaggcauucgaagagaaugaaguguacaaaacaacucuuguaguuuacuguuuuuuuaaguguguaauucuaaaagccaguuuaugauuuaggauuuuguuaacugaaugguucuaucaaauauaauagcauuugaaacauuuucuaauaguuaugauacuuauacaugugcuuucaggaaguuccuuggugaaacaauuguugaggggggaucuagguaauuggcagauucuaaauaauauaauuuccagauaguaauuuuaagaguacucaucgcucuugccaaauaaguucaggguauucaaaucuuggacuaguccugcaagguauaaagaauaaaaaucccagugagauacuuggaaaccacaguuuauuauuauuuaucugggcaauuauugugugugugaggauggaaggguagggaauaaucgaacaucuaaagccuugaauaagagaauacuaauuguuuugguaugaugauacucagaaauggagauauuauaggaaaaagaaauccuuuggaauuuuaacuaaaaucacugcauaugggaaauuaagagauccaggaccauauuugauaagaguuccuaaaaauaauguaauuauuaaugcuaaagacugcucauguaucuugaucuaauuacuaaauaauuacauauuuauuuaccugauaaauauguaucuaguucuacaaggucacauuuauguggaaguccaaagucaaguccuuaggggauaauuuuguuuuggcucaguuguucccugcuuccuuuuuuuuuuuuuuuuuuugagauggagucucgcucuguugcccaggcuggagugcaguggugcgaucucagcucacugcauccucugccucccggguucaagcaauucucugccucagccucccaaguaguugggauuacaggcaccugccaccaugccuggcuaauuuuuuguauuuuuaguagagacggggguuucacuauguuggcuaggcuggucuugaacuccugaccucgugauccacccgccuuggccucccaaagugcugggauuacaggcaugagccaccgcaccuggccuucccugcuuccucucuagaauccaauuagggauguuuguuacuacucauauugauuaaaacaguuaacaaacuuuuuucuuuuuaaaaugugagaucagugaacucugguuuuaagauaaucugaaacaagguccuugggaguaauaaaauuggucacauucuguaaagcacauucuguuuaggaaucaacuuaucucaaauuguaacucggggccuaacuauaugagauggcugaaaaaauaccacaucgucuguuuucacuaggugaugccaaaauauuuugcuuuauguauauuacaguucuuuuuaaaacacuggaagacucauguuaaacucuaauugugaaggcagaaucucugcuaauuuuucagauuaaaauucucuuugaaaaaauaca

SEQ ID NO: 191446 - RNA, 209461 nt, Homo sapiens
aaacacuuguauuaccauuuuaaaggcuaucauuacucuuuaccugugaagaguagaacaugaagaaaucuacuuuauucagauauucuccagauuccuaaagauuagagaucauuucucauucuccuaggaguacucacuucaggaagcaaccagauaaaagguaagguacaaauacucuuucuaauuguuuguauuuuacaaaucuaaucuuaugaauauauuugucuugacuagaaguuugcaaucaaauuuaauuagaauuaagaauuucuuugguuucaucucaguaaaaaaaauuaguguaaauagggggagaaaaauaagauuuuuuugccgcauuuuuuaguuaacuucuaagauaaaaacuuugaaauaacucccuacuuacuuccuuucuuaagaguuccaaagccauuauauucacauuuaaauccuauuauucgauaaauguguauguguaaauauuauauguaugugugcauauaucuauguaucagauacauauauaugacauuguacgccaagccauguuucuguuugaagacuguauguuuauguaugguuacaggaauauuuuuacuucauguacuuuuuuagagcugaaucauuuccuuucuaugaaaaagcaugguuaacacuuaagaacaaggcagaaagcauuuccuuuaaauauuuaaacuacuuguucuaaaaauaaucuauugaagaauuauuucuaccccacccaaucauuuaaacuaagaaacaagacuaacaauuuagagagauuauuaauuauuuaauuucuauuuggaaaagacuaucauaacuuugauucaauauucuacuugcauaggaaaugauuacuaugcaaacuugauuuugauuuaauuaauguaggauuuuuagauuugagcuacucgauucugauacgauucuuuguuuucauuuucaaagccuuaguauccucaaugcuuaucaaguuucauaaugaaacuuaguaaugauaaauguuucauuuuauaaaguucauuucaaaugucuaagguuuuaucaucaucucacuguuuaucuuuagaaauaucucgagugucauguugcuugaaaagaaguuaaauaaguauauaucagauuuacuuuaugcaaauauuucuuucagccaaaagucuuucuauccuggucaaacuuacaaucaugacaauuauuuucuuuguaucucaaaauuaaaaguuuacuauuauauuaccaauaaagauagaggcaacuaaauaaagauacuuaauuaguaccagcuaguuaguugaaagaaugugucauaauaaaugcccagauuuucucaaaauccagaaugucaaacccuguauuaggauauggaaguuaagaucucagagauaugauuucuuugugcuuauuuuuuucuaucaaaacuaguuuauaguuguaauuauuuucuuuucuuucagaaauaugauuaaugagguagaaaaaagaacgguaguuuagaaauaucucaggcagcuccgaccaauagaaccuucugugaugaggaaaacacucuaaaucuguccaauuggguuaccauuagcuacauguggcaaugggacaucugaaaugugauacagcacuugagaaacuaaauuugcaauuuuauguaauauuaauuaauuuaaauuuauacauggcauguguuaguggcuacauuaaacaguuuaugucuaaguuauuaaaauuauuaaaucuuuucauuuacaaauacuuuugauuugaagaaaaguggcuuuacaaauaaagaucagcagaugagugcuaauuaggaaugacuguuguccuaauauguacccuuuucuaccaucauaaaaaaucaacaaaguccuauuuuucacauggcacaggaugucaucuuuauacaauccaagaaaaacaaugguuuagauuguucuaaaaagauaagcaauaacuaauuauacauaugaauuaaauaaguaaauuauuaauuuuauauauauauauuuuuugagacagaguuucucucuuguugcucaggcugcggugcaauggcucaaucucggcucuccacaaccucugccuccuggguucaaacuauucuccuaccuccgccucccgaguagcugggauuacaggcaugcaccaccaugccuggcuaauguuguauuuugaguagagacgggguuuauccauguuggucaggcuggucuugaacuccagaccucaggugaucugccagccucggccucccaaagugcugggauuauaggugugagccaccgugcccggccaauguauauucuuuacaagcaaaaaaauaaggaaauacugaggugaaaagaaaaaagaugcuauugaaauuucauacuuaaauucaaauccaucagggaauagucuauggggagaaugaagcuucaagaguugaaagaguaugaaucagaaaugauuuagaaaaaggauauuccaggcguaauguguaucuuuuuacagaaagguagauguauguuuaguugacaaauuacauuuuccuaagaagacaguggauuuaucugaguaguaacaaaaggaggaaauaaaacaguugaggauuuuagaaauugauucuucauccuauucugauuucugagucuucaggugauucuuucaaauauauauuagaaaauuaaaaggacuuuuaaaccugguuguuuugaagucucucagagcuguagagauguauucagauaaauguuuuuccaugagugcuacucugauccaggcucuacccuaaaaggaagaagaaagaaucaaauauaaaaaaaauuaaaaaaauauuuugccacugugccaucaaaaauauuuuaauauguaaagaacagccauucaaaauauacauuugauaacgacuaagaaaaauguuuaaguagauaaaaauagguaaauuuugauuaucuagaguauauauuuuguuucucugaauauguaggguacagcaugucaaacuaacuuucuauccucugaagggacagaacguuaauacugaguuacuuggguuagagacuucuuuugaauuacaugauguaauuauauaagauauaacucucuacuucaauaccgcaaaucaacaaacuaauuaaaaugagcccucucauaaaucaugaaaaacagaguucucucucauuaaugaaaauaaucagucuaacaucacuuauuuaagaaaauuuucaauccuauccuuucagugggagguuuuauacaacuaguaauaaaauccaaauuucauuauauauaaugaauccaaaucaugagcuauugaauuuggguguccccagagaauucuaaaagcuauuaccaaauauuuaaacuagaaaaacaaacaacaacaacaaaaaacagaagccagcauauucuagcacagaaucacagaaacagacaauucuuacuaaaaguaauuaauuuucuuacggacuuucuauuuagaacuaaagaauauaagagaucauauuuguaguaagaacuucauaaaucaauuauuuucauuuucacucaacucuuucacaaaucucuaaaaaacuucaugaagacuaaauacauagaaaauugaaacacugcaauggcaguauaaaggugacacuaaucaauauauaugauugucaacuaccagaaagggaaaaaacauacucuagaaaugucugcaagucuagugaauucaccaaacuaugggauaggaaaggucacaaaggagucaauauaggcaguaguuaaaaccugucaggcuagaagcagcaguacuacugggaagaaaaugaaugauaaggguaugguuagcaugcgagucaauuuaccuaccaagcucaacaucccuuuuagcuugcccugugcucaguccauuguuccuucugaguaagccuaggggaaccugcaguuagcuguagcugauuggaacagaggaaggaagaggcaagcuacuggcuggccaguagucucaaaauucucucuugaaauuucaucuaaaagacacagaaacuaguagcggugucuugaaucaaaaggcuacaauuucaccaaugaagucaagaaaguugcucuccagagacaauucagcacaggagacuaugcuguuacuagauaagaaauguagggaaaaucuugcuuccugauuuauuaauuucaauccauacaaaacugggcugcauuuaguuuccuguauuugaauguguauggaauccuguuauauuauaaggauaaguugugcuaauuuuaaugguuucuuuucuuuaacaaaggaacuuuuaauagaacagaagacaaacagacuuauaaagauuguuugggccaagaaguagaacaacuuaaaaacuagauuaaggaauuuagauguuuucaguugauaagggugauccauaaaaugaagguuuaugaaaaaauaaguaaaaguaaucaagauuuaaaaauguaauuaauaugugcuaagcccuguuuuagagcuuuauauacauuaagaagauaaguaauccucccaauaauugugugaguuagguuacaauacuaucccuacuuuaugcacaaaugaaaaacagacacaauuagaagagaagaaauucauuuuaccaccaccaaacugaccagccuaauuauguuaauaccuauacacuccaccuucuuuccuguuucagggaaugagcugucagcauuuaagagaguuuaaaaaaagaaaaaaaagcacagagugggaaaauuaaaauuaaauuauaaauaucugacagacaacucuuauccauaaaauacaauuaacucuuaaaaacccauaagaagaaaacaauuuaaaaaugggcuugcaaugggaugauuuuuaacuauagauuacauuucuuuagcaaaaauaucacauauccagauauuuccauccuuuucguguuaguuuuggugaguaauuuuuuaaaagaaauuucccauuucuucuaaauuuucaaauuuauauaauagaugugaaguuauucauaauauccucuuuuaggauuuuuaaugucugugagauauacacacuuggccucuucuucauuccucauaucgguaauuuauauuaucuuuugaucuucuugaauagucuugcuagaagcuuaucaacugcauuaaucuuuuuaaaaacacuuuuaguuugguugauuuucuuauauauuuguuucaauuuuauugaauuuuuacuguuauuucuuuccuucuacuuugacuuuaauguauuucuuuuuucauagcuucuugagaugaaaguuuugguaaccaauuuccagccucuauucuuuuuuaaaauacacaaaagccuauuuaagccuauuccucuaagcacaaguuuuuauauguuauauuuucauuaucaguacuuuccaaauauuuuucaauuucaauugugauuuauuuuuucauccauggguuauuuagaaguucuccucaguuucacucauauaaacauuuucuagucauuuuuccauauuuuugauucuagcuuaauuccacugugguuagagaacauacuuuacacaauuucaauccucugcaauucacugagauaaacuauggcucagaaaauggucaauuuaauauaacuccacuggguguaugauaagaauguauauuuugcaguauuuauuuuauuuuauuuuauuuauuuauuuuauuuuauuuuaugacagggucuugcucuaucacccaggcuggagugcaguggugcgaucuaagcucacugcaaccucugccucacaagcucaagugacccucccaccucagccuccugaguagcuggggcuacaggugcgugccaccacaccuggcuaauuuuuguauuuuuuguggagacuggguuucgccauguugcccagaauggucuugaaauccugagcucaagugaucugcucaccuuggucucccaaagugcugggauuaaaggccaucacacccggccuuugaauuuuaacauauuccaauaaucuaguaauuuuauguauuucaguugucuaguaauauucauauuuauuuccauuuucuugaaccuauuauaauugcuuaaaaguccaaagucucuaucacccauagguuuguuucaauugucuuuuucauuuuucuugauuucagucauucaaucuuguuucuugaugugccugaugauuuuuuacuguauacuagacauucuguaugaaaauuuauagcaacucugaggcuaccuuucuccagaguagauuuuucuuuuggcagucagucagaguacuagaaaaucaccucacaauuuaggggacuacuuuuaggccuuuuuuuguauuaaucuucugaauuucccuuacuccaaagauauugucuuucaggggucucaaguaaaaaccuggaguguuuacaguuccccuucaccuugcuugcccuugaacucuaaccucuaucucuccagaacuagacugugaaaucaucaaucagcaguuuuaccucuucccugcugcuuucagcuuuguuuaugggacuuugcuuugagcuacagaugacuuagaguuggcaacaaccccauaggaaaacugcaugcacaacuccaggcacauuugucuguuguucaguggcaguuccaagcuccaacuucuguuugucugcccaaggaaauaaaaaucuccaccuccacaacuuucugcuuagucucuauaccuaggaugugaauagacaaacaacuuuaggcuaaagcaaagauggaugugcggcucagcucguguaauauccaucucuccaggacuguggccacucaaguucucaugccuugguugcucccuuauaucuuaaauuuguuacuucacauauuuuauucaacuuuuauaguuguucucagcaguaggucccucugauacaagauauucuguuaucacuggaaccugauuguuuucuuaccuuugggaucgacucuguuuuagauuccaauuacacccuucucaauaaauucucugcuucuacuccucccuucaauuuauuaucccuacagcaccaagcugaucuuauaaaauggaaaucagauuacaguauucuaucacuuaaaaaaaaaacucucaaguagcucccccacugcacugagaauaauaucugacuuuuaaucauggccauaucuuguauucuucagcuugcuuagccuggucaguauuugcacagcaaauuuauuggauggaaagaugcauggauauguggauggcugauguaacuagcauauucugaaacuggucuaauuaaacaaugaaggaauguacaggauaagcaaccagaaaccuaagaaagccaaaucuagcuaaaaacaagaacugcuauuaaaaacaaagaaaauggggggacaaucccucacaaaauauacaagaagacaggaagaacucaggaacaauacaaagcucauauuuuggggccaagaaaaugaaaaagcaagaaggagaagggauuucuugaacuugaaaucaguuggaauaucaugaaaacccaauguaaauaucugcaagguuaguaacagugguaacuaaagauucaauugggagugguuuuuuucagggaucauauaauauguuuauaagagcauaugacccaagagcagaugcggaagaugggugaguucagaaaagaaugagauaagucagugccugcugagauaaagucauuuuucuaagagugcugauucuagugugaaaccuaaguaauuuauguaauaaaagucucauguuccauaacaccugcauaugacagaaauaauagcugcaaaaguacugaagacacaaagauuacaaacaugauccucaacucaaauauuuuauucuauuguuaggcuauguuuaagucuuauggcuaaacuagucacagacagcagagaaagggaaugguuagcauuucauuguuuuuuuuuguuguuguuguuuuguuuguuuucuuagauggagucucgcucuguugcccaggcugcagugcaauggcaugaucucggcucacugcaaccucugccuccuggguucaagcgauucuccugccucagccucccaaguagcugggauuacaggcaugcgcuaccacuccuggcuaauuuuucauauuuuaaguagagacaggguuuugccauguuagccaggcuagucuggaacugcugaccucaggugauccaccugccucagccucccaaaguguugggauuacaggcaugagccaccacgccuggcccauugaucuuaaccuagacaaaaguaugagauuguccauggugacaagcuucuacaauaugaaucuaagugguaucaggacagauaauugugauauaauugugauacaaguguacuuguauacuguauacuguucaccaggcaaauuuagugcuucuggucugaaauaucuuuucacaugugucaaggcaaaaugacacuaugcuaguagucauucaagauugcagcuguaagccucaauaaaccuaccaucugaggcauuuguuuaauccuucaauccagagacgugagaugugacuuacugaguagauuaaguaaacugcucuuuucauugcaaugaauaaagagagguaaucuuucuccacagacucuucccagcauaacuaggcaacucaaauaauucucuuuccccacuaaauggaaucuguuugaggccugagcaaaacaaagauauaaaugcaggauuuggaacaugauuguucugugguguuuugauucucaauaccaguacuucacagaauaaauauuaacucucugcuagauaacauauugcugugcagggauuaguuccaagagccuuguuaagagaguuggucagcuaggguuuggguuucuuugguccacccagguccaaaugcuacauuucuaaacuuuguuaacuucuuaauuacuuuuuguauuuugggauaugcuaguuuuauaaauauauccuccccucuauugaaaggguuuagaauacacuguuauguuccucucuccuacuuuugauuugaaaaugagaauguuuauguagcaucuagaauacuuuuuauagauuugauucauucaaauuacagcuaaucuuuaaccuuagccuaaaccuuagccaaaagaaauguagauauaauucuuaagccauaaagaaaacauaaaaggaaaacugaggcugggugcuguggcucaugccuauaaucccagcacuuugcgaggcugaggcaggcggaucacuugaacucaggaguucgagaccagccuggccaauauggugaaacccuguaucuacuaaaaauacaaaaauuagccaggugugguggcacaugccuguagucccagcuacucaggagguugaggcaggagaauugcuugagccugggagguggagguugcagugagcugagaucguaccuuugcacuccagccugggcgacagaacuagacugucucaaaaaaaaaaaaaaaaaaaaaaaaaaccaaaaaaaaaaaaaaaaaaaaaaaaaaagaaaaaacugauaaagcucaccuaagaugcaaaggggaauucacacugcauauuuuaaaaaucuauaguucaaaaauuaaaaaguaaguaaaugaauuaaaaauucaguaguuugaggaaacagaggucaaaggacaauaguugggacaaaaaagacaucuguuaauauguaauaacaauaggauuuaaauaucugagggaaaaauuuaauuaaaaaaagaaaaucuauaauuaauuuacaaaugaagaaauuuacuggcuuaaauacgugagacagagaagaaaacugauccaaccugagagaguugaaagauauugaagcaggaaguuccuuguugcuacaaccccuugguugaagauuggcaggagggagcaguggcuuuaacaagugaacuuuauaguuauagucucaaaaaggugacaaaaaucauagcuauuaacuguauccaaaaguguacuuucauauuaaggagcuaaaaauguuuuaccuguguuucuaauuaugucacuacauuuaaacauuauagauuuugguuuuuaaaacauauacucaguucgugcuuacaaaauauuuaauuugaacauaucuucaucaguuuugcugaacaaaaauuuuccaaaagaaaaaaaaaauccuaaauaaaaaggaugcaagaacaaaaaacuuggaaauuauaauuuggaaagauaauuguuauacuuucgguuauuacauagacacauaauuuauaauucuauaaucgugaaauaaugaauuaugucuucaucuuaaaacuguaaauaucaauuuucaaucuuuauuuucuacuuaauguuucauucuguaauuucuaaaugucaaaauaauaaagcuacucugacaauucaauaaaaauaaauacaacuacuacauuaaagcugauaccugaguugaguuaguuauuugauaccugaguugagugaguuaguugaguuaguuagguauacucaaccuucuguugaguauaccuuuuccaaaaugcuugggacaagaguauuucagauuuugaguauuuucugauuuuggaauauuugcauuaaaugguccauuuagcauuuucuuugaacaucauggugaugcucaaaaaguuuuaguuuugagaucauuugagauuucacauuuucaguuuugggauguucgauccauuugacuuaauaguucagacauuuuauaauccuaaaaauuacugaggaccccaaggaaguuuuauguaggcuauaucuaccaaauuuacuguaucacaagucaaaacuggaaacuuaaauauuagguaauucaaaaauaaugaguuggucauggugacucaacgccuguaauccagcacuucgggaggcugcagcagaaagacugcucgaagccaggauuucuagacuagccugggcaacaaagagagauauuaucucuacaaaaaauuuaaaacauuugccaggcaugguggcaugccccuguagucccagcuacucaggaagcugagguuggaggaucacuugagccuagggguucuagccugcagugggcuaugauaguaccacuguacuccaaccugggcaacagagcaagacccugucccuaaaaaauaaaauaaaauaaaauaaaauaaaacaauaaacccauuaccuguuaacauaaauaacacauuuuuaugaaaaauaacuauuuuuccuaaaaaaaaauuagugagaaaaguaucucuguuuuuuuuuuuuuuuuuuuuuuuuuuuuuugagacagagucucgcucuuuugcccaggcuggagugcaguggcgcgaucucugcucacugcaagcuccgccuccuggguucacgccauucuccugccucagccucccaaguagcugggauuacaggugcccaccaccacgccuggcuaauuuuuuauauuuucaguagagacgggguuucaccauguuagccaggauggucucgaucuccugaccucgugauccgccugccucggccucccaaagugcugggauuacaggcgugagccaccgcgcccggccaguaucucuguuuuacauuuuuuucuaaucucuuuagugucuuuacaagauaauuagauaucugcuucugcauuccaucuguaacaauguguuguuuugguugaaguauaugaagaaaaucuagcuucacacagauauaugguuggaaagggaaucuuuuaauagucuuuucagauaaguguagauauuuucuuuuguucuagaucaaaacucacuaaaugguaaguuucuguaaucauauuaaugacuuuuucauacuauaguacauuaaaucuacugaccuaccuugcacuuugaauugaucuuuuuacccauacaugauuuuguaauuccacgaacugaucauuuggaaaauacaaguuaugcaguuccaucaaauguugacacauuucauuaaauaauuuaaaaauacauuuguugauaucaacaucaauguuuuaaaaaagcuuuucuauauugggaagcuaugaagcuuaagauggugaacacaaguuucuaaaauucuaguuuuuacuuaaaagcuuuaauuucaccauuggcaacaaauacugucagcuguuuccuugaaguaauaggcucacuucuuucuucuuuuuuugagaaaauaucugucaaaugccuaaguccaaaaaauuauguuuauaaguuuuucuuuucaguaaaaucauauuacauuaaaaaguaucuaguucagcucacaauucaaagaauuguacaaguguuuuucuugaagcaaccaucauauuucaguaugcugcagaaaugcuuuaugcauacuucccauuuuauuacucaggauauuaaaaagacagauccucaaaguugagauuuaauaagaauuaauguuucccgcaccaucauggucauucuuaaguugaaacugccuuuaaaagaaaauacugagugcaugguggggaagaacucaagacugcuugcacaguuugaugucacugcauuaauucgugcuaagguuccaacaguuuuauccaccauugugucugcauuggcagugcaaauaucaacacagcgaaaaggcaaauaacagguugauauuauauaaaaauauuuuugacauuuuguacccauuaaagaaagggucuuggacaucuucaggguucugcugaacauuauuugagagccacuaguuuagauaauucaagaaauguagaaacaucacagaacaggacguauuuuauuaugcuucuuaagaaaaggaaauucauaguaaguagcuucacaccuuccugcuauuccaaauacaugcaaugaaaaaaaaaauagaaacgagucucugaccaaugucuuaccuuagcucuagaagaacugacauuuuccauauuuucaaugcugcagauacaauucugugaaacuuuccggcaagccacucugauauagucccagaagcuacgaggacuuucauaaccaaaccagguuacuugaccuucaggagacaaauugcgauauaaaauuuuaaaaaguaaaauaaaacuagacuugaaaaugcaagaacaauaaaauucugaaaaauaaagguaauauagugaacuauaauggcaagggcaccaccaaucuaggugucaaaaagccucaaaucuaguccuauucuaucuuuaacuagugguguuaguuuggaaaauuuacuuaauuuacuuaaugagucuggaucauagucuuaacaauaaaaucaaacuaaaugaaagggacuagacacuagaaauaucuugccauuuaacauccuauuugucuaauacagucgcuuaaauagcacacgggaaccuuccugcgcuucuaguuaagcauuaauaaaugucaccaauugaauucuaaaccuuucucuauuuaaaaaaacagaaaaaaaaaccccaccaccauaauucuuuucuccucuucauaaggauacuucaaaaaagguauacaauguguuguuuacuuuauaaauaaauaaaaucaauuagcauccuauauucacuaauaaugcauaaccaccuacccaaccauucucaucuauaaagcuccccuuuaacugucauuuguuugcucucuuccaguuaagaacucaugaaaaacuuguaaucuuucagauuuggcuaacuauguauccguucaugaccaaauguucuauugugcauagguuauauuaguauuaauauuucuaugguugggcaugguagcucaugcuuguaaucucagcacuuuggaaggccaagguggguggaucaccugaggccaggaguucgaggccagccuggccaacauggugaaaccucaucucuacuaaaaauacaaaaacuagcugggcauggugguguaugcccauaaucccagcuacuugagagaggcugaggcaggaggaucacuugaacacaagaggugaagguugcagugagcugagguugagccacugcaccccagccugagugacagagcaggacucuguaaaaaaaaagaauucuauacaggacucugaauauuagucucacaggaaacauuuucuacacucaguauuuuuaaguggaauaugagagacaucuuaauacuuucuuuaguugucuaguaugacuagucuucccuaggaaaguuguuuaaucuucuuguagaaagauuugcuuucauauuuugaaauaagugcuuuuuucaucaugauuuaauuauuuacuuuaaauccucccuuccucaguaauuacuucucuacagcaacaucaagaaguguucuugucagcaagcaccauuuuaggaccaaugucugagauaauaucugagugguuccaaaccauggcagaacauuaguguaacuugacugcuuuuaaaaaauacucaugucuagccuccccacaaacugaauaaucaaaaucuuuaggggaagauguaagcauuugaauuuuuaaaaaucgcccccuaguauuucuagugauguacuuauuauuaaucaaccaacagaaauccuacaagucaugauagguaacuucuauucauuauucaggguguuuuaaaggccucuuccagaaacccauguaugaucccaacagcuagucccucuguuggcacaggacccugugcuuacuucuccucaaaaguauuucuuuacuugauuauuucacauauuaggcgguaagaucacuaaggcaggaauuuugucuuauuuuagaucaaucucuaacacuugacacagugcuuacuuggcucacaguaggcacucaauaaauauuuguugaaaaauuaaauuuauaaaucagcacaacacagauaaucuuaaaugcaaugaacacaaaaacuuaaauuuaaaaaaauccaauuaucuuuuuauagcaauaguuuugauaacagucugcuaguguuugcaugauagauuacaaacaucaaauauuuugcacaaauauauuuuucuuuauauaaauaaaaacaaaugcaucuauaaaucuuuauucuaauaacuauauaauucaaugucucuuuaaaaauaaaauuuugcagccggugcgguggcucacgccuguaaucccagcacuuugggaggccgaggugggaggaucauguggucaggagaccauccuggcuaacacggugaaacccccucucuacuaaaagugcaaagaaauuagccgggcaugguggcaggcaccuguagucccagcuacucgggaggcugaggcaggagaauggcgugaacccgggagguggagcuugcagugagccgagaucgugccacugcacuccagccugggugacagagugagacuucgucucaaaaaaagcaauaaaaaauuaaaaauaaaauaaaauuuugcuacuuacaaauagaaaucuacagacuucucccucuuaaucucucuccaucacuuucuucugcucccucucuucuuuuaacuaaaaauuuccugauauaaugccucaauauaguuugucucuagggcacuuuucaugucaucaauuuguuagccguuuggaggggaagcagggugacuggugguuaagaacaugggcuuugaguccgguggaccugaacuagaucacuuucuagcuaugggaucuugaaaaaaugacuuagguucacuuuaugagucugggccucuucuguaaauugaaaauaacgauaguaccuacuggauaguacuguuguaaggauuagaugugaucauguaugugcagcaaguagcaaagagucuagugcauacuaaauucaaaauaaguguuaauuauuacuacuguuauuacuguaaucauacaagcaguuacagggaccaagcucuccuugcaucacaaaaugaaguaggaaugagaugcaaaguuaaauucuucacauuacuugcuuuggaaucuagagaaaucuuccaaacuuacucccuaauccaacuuuacucccaucaucaaccauucuaaaguuacuuccucaaauguuucuaacuucaacucauuuuccuugacuucuauuaucugggaucauucuauaauuucaaaaugagagcuacagcugccagacuucccucaagaaaugaaguacuacacacuggaaagaaucuuaaggaaagaguaucaccaagauucuguggugaguuuaagucucucuaaaaagacaauaugggaaacagaagucagagaaauaggcaagggaaaauacaacauuguauuagccaauggcaaccaccuauagugguaauccaaauagguaaccacagagaaagauaaagcauagguuguccaugaacaagaagauuuuccguuuuaaggaaauguacaaggguccaggacuuuggcauaggacaugguuugcuuuucuguaauguuauuuuaaaucuucucuuuaguuucagguggcugaagaaaauaacuuguaggauguuucaaaguagagcuguugaaaaccaaagaguauuuaaaaagcccuguuuuggaggagagaaaacagagacagaaaaacuagaaaacuagaguuagguuaagcagagaagggugggcacuaaauccuuggaacuccugcuauagguagggcacacuauccacaaggacuuuuacccaaaagauaaugaaaagauuucccagauuacaaacugagaaacuaagcaauugacaggacggcauaucaucaugacuuucagggccauaaaucaaccaccaagaucuucauaacacauuuaucugcucuacaaauuagaugugaggaugacuuggcuugauucuggcuuccuuccuuuuccaugugcaucacuuccaaagugaagcucuuaauucaagacacugaauuuuucacauucagaaagauauucuucaagagaagguagauucucuugcuagaaccuccaaacaagcuuucauguaaauugccuguauauccuaggauuucaucuaaauaauuaauuucugcaucuacagaaagguuuaauuuaguucaauauaauagauguguucaaugaguuaucugcgauauuauuugaacaucacuuuuauguaaauacagauuaacugcuaguaaaagucuauaaccuguauuuaacaggaaaauuuaaaaacaaaguuacaagcuacucaugccuuuaaaaauaaauauugaaguaauaaauaaccacuccucaaauacuuugacuuccuuuaaaaauaaccacaaaagacaaucauauagcaagaaacugacuacucuauaucuugaagaaauguuauuccaaagaugagauaugcugucauuaacagaauucccuuuuuaaaguucucaaugaauauagguauacaauaugcuuucaauuauaaguauucuuggaaguuaacauuuucccaauguuaaacaagcuuuuaaaaacauauucccaucccaucaauccaacucucuucaucuuuaggcacagaaacaaauggugaaaaguuugcuagacuaaaagacaaucuguuacugaccagcuaugugauuaucuuuccaacuaaauugccucaucuuuaggaccuaaaaauugccugugaucucuaggguccaauguuacucuaaaauuacucuucuauacucuuuaagugagauaucuauuuacacuuugcaauaugucuguguuuuguuuguaucuuauuucauggccagaauaagaccuucuaagaacagaaauuaauuuuucuaaagugguucucuacuaagcaguagcugacacaagaucuuuucauaauacaagaaaaauauaaaugaaucuguuaagugacuuaauuccccaucuuuaguaauagugcuuagcuauguaaaaagugaaugauaaacugauuucacaaaugaaaguucuguuaguuaaaauauaucaccuacuugacaauauuaaagacuauuaccuuugagcuauuauucaucuagacaaucaacaaaagacaagauaauccuaccacauuuuaauaaaccacucugaugucacugcaaaagcuuucagauacuuaaagaaaauugguuccuuuaaaaaacuuguggaguucucacuuuaaacuuuguagcagcaaucccaaguuucuuacugcuaauuuauaaaagccaguuuaauauuauccacuauuuuaucaaacagagaaaauuuccauuucuguaaaaguucagaaacuuuuccuuuaaaaagguacuauuauuaguugagguuuauauuuauuagaccauccagcuuugaagguaaaauuaugacacugauccauuuucuaacuaaaaucccaaauuaauguucuaaaaaauagaacaaguauaaacacuuaaaaauaauuaguuacacuuuaaauugaaucugaggaagucagaaucuacauuagauacucaauuguacuuacauugcuaguucuacaugcuacuuacaggacacuucaaguauaucauuuaggcacuaagaaucaguuacucaucuauaaaauguaacuauuauccuuugguauugacaauguaaugucuaguucacuaguaaggaauuuaucacaaacauauacaaauaucuaaaguaugugucuaugccauaacaauuagucaacucuuaauuuuccaaaacaaaaagauuaagaugaacagguucagcaaaaaucugaauauugaaucaauuuaauaggcuuuuuuaucccaguaauuuuacucucucugaaauggagaacaaacguuuuguuuuuucccuuccaccagcauuauuaacauaaggcuuaaaguacugguggaaugaaaucguacaugacggcugaaguccacacagagagcuacacauaaaugcguacuccugaagaaaucaaguauaaugugugucaguagugauuaagacuauagguacagaacauaaaacagauaaaauugcuugaaaggauuaauugugggaauuagaauuaaggaaaugacauuuguuuuuuacuuuuucucuuucguucuacuauuuaaaaauaaugacuauauugcuuuucuaagcaaaaaauacagaaagcuagaucauuaaguacaaagguccagcaguguuuugcauauagcagaaacucaauuaaagaaaagguuugaauaaguaaauaaaggcaugcauucuaccugggagaaaggaaacuaagaaguacauucccacuaaugguucaagaaugaaaaagcaguuauuguuuauggugccacaucuauguuuuacugagacuggaauauucauacagcuucccugagcugcuacuucacacguaauauuuauuauuauacagcacuuaaaaaguaaauagguuauuauauuguguggauuuacaagauuuuaauuuuaaaauuagcauaagcauacuugugcucucuggauuaaaaaaaaaaaacaaaaacacacaaaaaagaaggcuuuacaaaacccaugcaauguacuaaaaaagaucacuuaacugauacagcccucccccgaaagucaauuccaugcucccgugcagcucaguggcgggagacaucaccagcauagaguaccuugaagagguauuuggagaugagccagccaucugcaacuuugggaaaucucuuuaaaaaaaaaauaacaacaacaacacacagauauuuaagaaaccugccaucauguuuacaguuccaaacugaauagcccaacuaagauggcuacauauaauuuugaagcaguaaacacuacuuuuaccuacuaaauaaaugaacucuguuaagauaaauaugagcuacacuugguaaguaaaugaagcuaguuccuuguagcuuauuguauuggagaggcuaaggugucuguaagucaaaaauaugugagcagaaauuguuuccuguuuacuuuuaccuccaucauucuuucucagauguaauaaacugaugaguagaauagaccucaaagaagagcaacagcuugacugaacuugcuggcgaugcaccucagaacuuauaagauugguuaggaaaaaaaaucacucacuuuggaacuauauggcucagaaaauuuccaaguuuaaaaauaaauacacauuuuuaaauguuaacuuuucuaaaaguuauaaacaaauauauuuugaaauguagccauucauuuuuugccuaagaauuguuaaaacuuuuauguuuucuucccuguagagagcagcacuuagauauuauauaaaauguuggucaguuuaaccaauguugacuaaaugccuacucuaucaaaaacacuguuuuauuuguuacagcuucuaacucuuauuuaacaaucaccaacugaaaaaguacuagaaauuucugcuauauuuuucagaaauugcuaguauaacaauaugggaaaacuccaaagccaaauuucugaaauaacauucccaaaaaauaacauuuccuucucucauagucaaacacugaaaucuccaauaguacauggucccacaccuuuccaaacacuuagauccuuuauaaaaccaauaaaagacaaacacauagagcuaguaaugugacaugaaaaaugaaaggaaggagauacauacagcugugccacaucuacacaucugccauucacucuauccucuuacuuccauaacauuuuaaacaaauauuaaauuuggaaaaacauauccaaaaggaucuauaacuugguacgacaguuaaagcucauauuagaacauaauguucuugcuauaacuacaacaaacaaaaaugaaauuucucaacauugaauguaaaucagaauagaaugcuuuucauugcaaauaacauuaauuccuaauauuuaaaccacauuuacuaucucuguccuaaaacaaaguucucuauauuauuugugauuuauagaucuaaaaacuuaucaaaguaaaaacaauuuccaugaaaaucugacuuaaagaaauuuuacuacaaaaauguaccaaauaagcauaucaugaccagauuuauggcacuucuuaaccaaccccuuauauaaggugggaaacaauuacugaaaauaucacaaaacucaauuuauaggguuuuuguguuugauuguuuaagagacagguucucacuuugucacccuggcuggagcucagugaugcauucauagcucgcugcaaccucaaauucuuggacucaagcgauccuccugccuucgccuugugaguagcuaagacuacaggugcgugccaccaggcucaacuaauguuuuuauguguuuuuuuuguagagaccagaucuugcuauguugcucaggcuggucucaaacuccugggcucaauggauuauccugccguggucucccaaagcauugggauuacaguugugagccaccaugccuggccuagauaauguugguuauuuuuuuaaaaagcuguuaguaugcuagccucugugcccugauuuucauuuuggcugugaaagaccaugggaaaauuuucuuaaauuuuucacuuauuuguaggauguaauugcuuuaauuauaauuuaauacgauuaaaccauucuagacaaguuaaaagcaaccagaaauaucuggaccaaacaacaauccacuauauuccaaguuaucuaauguagucaaauuucaacaacucucauuuuacagaugagaaaagguaggcccagagacaaggcugccaagacccagcaaucgguuuucucugucacuucaagcugaccuacuccuuaggagauaggcaggaccugacugauggaggauaauuagucaguuguauuuccugguugguuagaguucucacugacaaccccagaaagaagggggaaaaacaugagguagugaaacauguaaugggaaggaauauaaauauuuuuuauauaaaacguaaauccuuaggaaguagaagugcugcucuuuaaauaaacaagcguaugacaaagcucacauuauuucaaaguggcccagggcuuguuuguagaagggguucuuauuugagauggaaacaaaaccuuuuguuauaaaauauauaauguuaaaagaaagugaaacaguauuuaacacuauguagcuuagaaaaauacuugagacaauaccaaagaaaccagguucagaaagcauuuugcucaagaacaaaaugcauucaaauacaacaguauaauuauaccauauaguuauuucaggaguaaguuucugaaauuucaggcaaaggcagaaucaacucagagauggauaugcaauagaagaaugcuucuauacugaauacugaagacagacagcauuuccugacccaagaaguauguacuuuucaauaucaaauaauugauucauaauuuuauuaauauugaaauuagcccucacacagaaaagacuauuggccacuguuuuaaacaaauaaauuuuccuugauaagacugaauauguuucuaauucaugaauaugauauuuauucuucuauauuuuucaugucagccauguuccaacuuuguuuucuauucauuuccauuucuuugaucauugaaucacuaucgugauugauauaaucgaugaauuuuaacacuuaugcaaaaaguaaaccuuuagcuuuugcuauauuuauucuauuuucucucucucucucugcauauauauuuuuuucuaauaaaguugcagguagauaccuuuauauaaauguaccaagauggaauauggaaaagacuccuagauaaaauggucuguaaauggauuaccauuuguaaaacaaauaaaacuaauuauaagugaucagauaauaauucagauuuuucacaagucuugucuauaaauuggcaguaucauauagaacauauucuauuacuaauacuguuaaggcgaguugcuuauaaucuuucacuuuguauuuacauaggaggaaaauuuuucagcgaagcaacagauaaaaaugcuacaguacuguaauucagcuaacaaugagacuaucuuuuauacagcauuuuucaucuuuuaacagguucugaaguuaaaauguaguacuauauauaacuuuucuuaagcuuuaaaaauacugcuuuaaaaugccauuuacagguaggugguagguauuaacaucuuagaaacaaaguauuuguucauugauuaaauaauuuuuaaaauacugaguaccuaaauugugcuaaucuuuugaaguuuaucaagugcaaaucuuuugaaguuuaaaagucauaacuuuaaagaaaagaaaauguaaaaacaguuuaauaaaauaaaaauauagaucacaugaacaauggcaaucaacuaaacagugacaacuauuaaugaaaauacucuucaucaaauuaaaguauuugaauuuauggauaauaagaguaauaaaaauauuuuaaauuauaucaaauauaucuguacuacagggucaucucagguucuuauaccaagaaaucuaagccccaggcuuaguggcuuacaccuguauucccggcccuuuaggagguggaagcagaaggaucauuugagcucagcgguucgagaucagacugggcaacacagugagacucugucucuauaaaaaauuuaaaaauuuuuaaaaaaaaaucuaugacagcuauuuaaacauucaaagauuuaaaguaaaaauauagugcaaacacacauaaacauuuggcauucaaaauucuaacauacuucagucaacucuuaauuaggcuacauauuagaacaaauaauacaucagaaugggaauuuaucauuagacgucuagcaaagcagcuugcagcgauauuguucaccuuaaggaaaagagguaacaauaccauaaaaugauuuugaaaaggacaacucauugaaauuagaacaucagaaagauguaggaacugggauuauuauuaugauacccuccuaaaaugaacaaaguccacuaaauuguguaaucuuuccccucuucuauaaaaugagaaauauuuacuuucuuuagaugauuagcacaauaaaguaauauuagcaauauuagcuaauuaauaauuagcuaauuaguaauuuagcaauauuagcuaaaguaauauuagcacaauaaaguaaauauuagcgcaauaaagcaaaauuguugaauuauguagcaaaaauaauaaagaaagcaauuuuccaagauuaaaaauaaaguaugacuugcucauuacaaguacugcaaauugcucuaugcuaauuugcaaaaaucacaaggucaaacuggaaaugucucauuaauuuucugacagaaacucaaagggcuauaaacagauaaaugaacauaaacaugaauuaccaucagagaucaucaauuucuguuagacaugaaauuggauuaauuguagacuaaaacauuucuuuaacucucuuauuauaaagaagacauucaaaaaaaucucagauaauuuuaucaauaauagaauuuauuuaacucuuuucauaguaucaucuucuuugugauaaucccccuuccccagaagccaaaucuaaauuuugaaucauuuuauuugaagagauuuugaaagugauguucauguaaaauaaaccugaaaaauuccccaguguacuaaaguuuagaaccauuaauaaaucucucauucuguaaauaaguaaauauuuaaauuggugaaugaaaaugauuccuugaaaauucuaguuugguuauaaaauauaaagaucauuuugucuauauuucauuauaaauaaauacaaauacauaagauuuuguucacccagaaauaccuauaacaaacacaguaauuaagaaugcuacaauaauaugacucaaacagaagcaaguaaccaaguauaugagaauuguguuauaaaauuuuagacauucaaaacaauauaaaacauuacagaacuaagaaaaauauuucauauguuuuaaaacagaaaucauaaagucucaaaugaaaaauaaguacaaaauaacaaacuaccaacaguaaucauguaugaagacuaaucaacggagaaaaaaggucacuacugaucaaaauggguuuauauaaaaauuaguuccacauaauaaauaguuuuuuuccuauuuuaggguaauugaaaacuccacagaagaaauaggcaaaagucaugaacagaaaaugaaaaaaaacaaacaugaaaauauauucaauuucauuucuaaauacguauaaauuaacauaagauuauguguauauauauguauauauuacauuauauaaaauguguagcucucuguuuuuagaaacuauguagugauuauuuucucccaaaucuuaaauguauuauaaaacauuaauauaagauucauuuuauuccauaugcaauuuaaaacauugaaucaaauuuacuaagguauacauaaccccggaugcuucgagaauuacaugaauacgaugauuuucugagauacaauaucugcuucaccuuuccugaauuuccaaguacauaacuuaaaaggguguuucucagaguggccucucccauugucuaaaagccaaacucuggugaccuuaagagccaauuucuuaucucugguaucauguuuuggccugaguauaugggauuuuauuggaugaauuguguucauauguuacuacagaaacaauuuaagucucauuuuccaacaaaaguuggaaaaucuucaaaaaugaacaaagaaaacucaaaagccaaaugaacagguuuaugauuauccauuguuucuaacaguguuuacacuguacuucaaaagauggccucauggggagguaacuguuuaucaucuaagucaggaagagcuuugagguucaagccagaguuccugagcaaugcuuagguaucauaacaguucaauuggauuagagaaauucuaaaaugucaagucacaggaguucuaacucguuuuaagaguccaaauccaaguccuaucagaaaaaaauaaagaaauuauuacucuuccaucaauuuuucaacaaauaaugacugaguuucugccauaucguaggcacugcucuagagauuuggauacaccaaugaacaaaacagaugaagaucuuaguccugguaaagcuuacguuuuaguggaggugaagaaagauaauaaacaauaaucauaauaaguacauaaaauaauaugcuagaaguuaagacuuaauguaacucaggggaaagaggucaggagugcuugagguugaaaggaggggaggugauuuauuauuuaaaauauaguggaaggguuaaaccucauggaguaguuuucaaauggaugaggguguuaaccauucagauacuagaagaagugugcuccuuacacaguaaacagccagugcaauggugcccugugguagaaugugccugauauagucaagaaaaaucaaaagacugauaaggguagagaacaguaaguugugggggaaaaacuagcuguacacaaauauaacugaaaaaauauuaagaaucaauauaaaaucuaaacugaaugugagucagcaagccaaauguuaauaaguauaauuagcagauuaaauuauacgcaauuuaacagugucuuacauuuaaucauuuuuucuuuaauaagugcuacauuucuaauugacagucuauacuugucugguauacucagcuuuuucuuuucuuucuuuuuuuuuuuuuucuuuuggagauagagucucccucuguuguccaggcuggaguggaguggcacaaucauggcucacugcagccuuggucuccuugggcucaggugacccucccaccuuagccucccaaguagcugggacuacagaugcacaccuacaugcucaguuaauucuuuuuuuuuuuuuuuucuagaggcgggguuucaccauguugcccaggugggucucaaacuccugggccucaagugaucugccugccuuggcucccaaagugcugggauuacaggcaugagccacugcaccuggcuaacuuuuucauuuuaaucaguuauuuuccauauaaacuuuacaaaaaucacuaauacaucccauccucaugucaccaagcugaaguuuacaacguugucucugaugacuuuacugcuaaauuucuauuuuucuuaaucuauguggccuaccagucaguccauaaauaaucaaagucacagaugacauuuuaaagaacuguaauuuucauuugagguacuucuaugccucuuucuuguguaaagccuucccucacccauccaagaaaaacagauauacuccuuuguguuacaccaugcucguuaauauacuucuauuaugacuugaugacauuaguacacacaauuauuuguuaauguguccuuauucuaccuuucaagacugaguuucaugugaaagcauaccuuauuaaucucauauccugggcccccagcacagggccuaaauuuguuguugaauaagagaaugaaugagguaaagagaauagaaaaauuguaagaaaaaaaauuguggguggagggaagccaaaaaaagcagaaaguauacaucaaguguaaauuuaaggcaucuguuucagaaaaagaacagggaacucagguuaugauucauuuccaaagcagagaaaaaguagaaguaauacuuggccaagaaaaauauggaggggugaugguaaaggaguauuccuugggacuucuuuuuacugggcucugugacaaauuguccagcuuucuaaaauaagugaggaucaaggaguuagaaucuuacauauuauaaucgaaagugggauccuccccauuuuaaaauguuuuaaugggaagcaauagaauuugggggaguuauacauuuauuccuuguaguaaauuugcuguugcuaugaguuuugaaaaauagagggagucauguaaccaugauuaugagacacauaacaguuucaucaugcaaagaaacuccuucaucaugaugcuugucaacccccacccugcaaccuuuaaucccuaguaccacuuaucuguucucugauacuacaguuuggucuuuccuagaaugucauauaaauggaaucauacguaaucuuuaggguuuugcuucuuucauuuagccauaauguaucugacauuuauacauguuguuguguguggaaauuuuuuuuccuuuuuauuacugaguuuguccaguguaugaacauacaacaguuuauccaggcaucacaugaaagauacuuggguuguuuccaguuuuugacaaaagagcuugauaaagguguguagugcuaccuaauaugguuugaauuugcauuuuccuaauuacuaaugauguugaacaucuuuucauuuguuuacuugccauauguguaucuucuuugaugaaauaucuguucagcucuuugcauauuuuaaaauuggauugguuuucauauuauuaagguuuuuauagcaauucuuuguauauuaugcauacaaucccuuugucaaacaugugauuugcaaauauuuuuuccuggucuaugccuugucuuaucauuaacagugucuuucagggaguaaaagcuuuuaauuuugaugaaguccacuuuaucaauuuuuuuuguuuaauggauuguacuuuuguuguuauaucuaaaaucuguuugccuaauuaaacaaagauauucuacauuuuuaagaguuuuauacuuuuacauuuuguguuuacaccuauaacccaccuugagcuaaaugugagguaaggaacaagguucacuuuuuuuuugcacacagguauucaauuaauccuagccuauuauucuuaaagguuaucacuuuuccaugaaauugucuuugcauuagcaaaaugaaucaagcauauuuauguguaucuuuuuccaaacucucuauucuauucuauucuuuuuuuuuuuuuuuuuuuuuuuuuuugagacggagucucacucugucaccaggcuggagugcaguggcacgaucucgacucacugcaaucucugccuccuggguucaagcaauccuccugccucagccuccugcguagcuggggcuacaggcacgugcuaccaugcccaacuaauuuuuuguauuuuuaguagagaugggauuucaccauguuggccaggauggucucgaucucuugaccucaugauccgccugccucggccucccaaagugcugggucugcucuauuuaucuauacguauaagcuuuuaccaauaacacacugauuacugcaucuuaacaguaagucuuaaaaucagauaauuugaguuuccaacuuaguucuuccuucaugaaauuguuuugccuauuccaguuacuuugccuagacauauaaauuuuagaguaaguuuuauaucuacaaaaaaagccuucuaaaacuuugagauugcauugaaucuauaaaacaauaugaaaagaacugacaucuuaacaacgaguuuuccaaucuguaaugaagaauuacccauccagaauaucaacaguaucaauguugagaaacccuguuguaaacuucuguagaugcccuuuaaggaaguuuucuucuaauaccuagcuguaaagauuuuuuuuaacaugaauuaaaguugaauuuugucaaaugcuuuucuaugcaccuauuaguaggauccuaucauuuuuauucuuuagucugcuaauaaaaugaaauacauccauuuucaaguacugaagcauucuugcauuccaguuugaucugucaauauuuauugaagauucugaugucuguguccaugagguguacugguauguacagucauuucuuguuuuaauguauuucacuuuauugugcuuugcagauauuguauuuuuuacacguugaagguuugugucaaccuugcauccagcaagucuuucggugcaauuuuuccaauagcaugugcuuacuuugugucucccugucauguuuugguaauucucacaguauuucaaacuuuuucauuauuauuguaucuguuauggugaacugugaugagugaucuuugauguuacuauuguaauaauuuuggggcgccaugaaccacaccuguauaaaauggcaagcuuaauugauaaauguguguguucugaaugcuccagcuaccggccauuucccaucucucucuuucuccucaggucucccuauucccuugagacacaacaauacugaaauuaggccaauuaauaauccuauaauggccucuaagugaagaguggcauauaucucacuuuaaaucaaaagcuguacacgauuaaucuuauugaggaaggcaugucaaaaacugagauagccaaaaccuaggccucuugugccaguuaggcaaguggugaauacaaagaaaaaguucaaaggaaauuaaaaguacuauuccagugaacacaugaaggaagugaaagagccuuauugcugauaugaagaaaguuugaguggucugaauagaagaccaaaccagccacaacauucucuuaagccaaagccuaauccacaguaagguccucucuuuaaugcuaugaaggaugagagaggcaaagacgccgcagaagaaaaguuugaagcuagcagagguugguucaugaaguuucagaaaaaagccaucucuguacauaaaaaaauaauaauaauaaaacaaaaaggugaagcagcaagugcugauggagaaguugugcuaacuuauccagaagacugaacuaagauaacugaugaagguggcuacacuaaacaacagauuuucaauguagaccuaacagcuuuauauuggaagaagaugccaucuaaaccuuucauaguaaaagaagagaaguuaaugccuggcuuuaacgcuucaaaggacaggcugacucucuuauuaggggcuaacgcagcugguggcuuuaaguugaagccaaugcuuauuuaccauuccaaaaaauccuaggguauuuaagaauuaugcuaaaucuacucugccugagcucuauaaauggagcaacaaagccuggaugacagcuccucuguuuacaguuuggcuuacuaaauauucaaagcccauuguuuugauccacuacucagaaaaaagauuccuuucaaaguauuacugcucauugacaaugcaccuagucacccaagaacuaugacagagauguaccaggagauuaauguuguuuucauggcuucuaacacaacauccaaucuguagcccagggaucaggaaguaauuuagacccaagucuuacuauugaaaaaguauauuucuuaaggcucuagccuccauagacaaugagucuucugauggaucugggcaaaguaaauugaaaaucuucuggaaaagauucgucaagaacauucgagauuuaugagaagagguuaaaauaucaacauuaacagaauaucaacauuaacaggaauuuggaaaaaguugauuccaacucucauggaugacuuagagggguucaagacuuugguggaaggagucauugcagauaacauggaaaucgcaagagaacuagaaguagaacuugaagaugugacugaauuauugcaaucuuaugaucaaacuugaacagaugaggaguuccuucuuauggaugagcaaagaaagugguuucuugaaauggaauguacuccuggugaagacacugugaacauuauugaaaugacaacaacagaagauuuaagauauuaaaugaacuuaguugauaaagcaguggcaggguuugagaguauugacuccaauuuugaaagaaguucuacuguggguagaacgcuaccaaauaacauugcaugcuagagagaaaccuuucaugaaaggaagaguccauggaugcagcaaaauucacugcugucucuuuguuguuguuguugagauggggucuugcuauauugcccagacuggucuggaacucaagugauccuccugccuuggcucccaagugcugggauuauagcuguaagccacugugcccagcccauuguugucuuaagacauugucauauccaccccauccuucagcagccagcacaucaaucagucagcagccaucaauauugaggcaagacccuccaccagcaaaaagguaaugacuugcugaaggcucagaugauuguuagcauuuuuagcaguaaaguaguuuaauuaggguauguacauuuuuuagacauaaugcuauuacacacuuaauagauuacaguguaguguaaauacaacuuuuaauacgcacuggggaaaccaaaaauuuuuugugacuugcuuuauagcaauauuuacuuuauugaauuagucuugaacugaacaagcaauauaccucaguaugaguagaguuuccuuuucuuguaauauuuugucuaauuuuguaucaggcuaauaguuuccuuauaaaaugaguugagaaauguuaucuccuauuuucugagauggauugaauaggauuacuauuauuaccuuaauggcugguugcaaucaacagcaaaaauaucuaggccuggaguuuucauuguuggaagguuuuaaauacugauucaacuucuuuaauagauauaggacuauuuguguuaucuacuucuuuaugaguuuuguuaggauuugucuuucaagaaauuggcccauuuccuccacaauuaacuuuuuauccuuugaauguaaggucuguagucauaugcccucuuucauuccugauauuggaaauuuguauccuuucucauuuucuugaucagccuaaccagaaguuuaugaauuuuauuaaugauuucaagcaaucauccuuucauaucaccaauuauuguuuuuguuuuuaauuucauugauuucugcuuuuaucuauuauuuccuccauuuugcuuguuuuggguuuaauuuucccuucuuuauuuaguuucuuuuucuuuuuucuuuucuuuucuuuuuuuugagauggaguuucacuccuugcccaagcuggagugcaauggcgcgaucuuggcucacugcacccuccgccucccagguucaagugauucuccugccuucagccuccuaaguagcugggauuacaggcacacaccaccaugccuggcuaauuuuuuguauuuuugguagaaacgggguuucaccauguuagucaggcuggccuuaaacuccugaccuaaggugauccacucgccuuggccucccuaagugcugggauuacaggcgugagccaccgggcccggccccuuuuuuaguuucuuaaggugaaagcuuagguuacugauuucagacaauucuuucuaaguaaguuuuuaauguuuuaaauuuccuucuaagugcugcuuuaauugcaugcuacacauuuugauacaacgcguuuuaguuuuucauucaguucaaaagacuaauuuuccucgagaaucccucuuugauccaagaguuauuagcaaagacuuggaaccaacccaaaugucuaucaaugauagacuggauuaagaaaauguggcacauacacaccauggaauacuacgcagccacaaaaagggaugaggucauguccuuugcagggacauggaugaagcuggaaaccaucacucucagcaaacuauuacaagaucagaaaaccaaacacugcauguucucacucauaaguggaaguugaacaacgagaacacauggacacaggguggggaacgucauauacuggggccugucuagggguggguggcuaggguagggauaacauuaggagaaauaccuaauguaggugacagguugaugggugcagcaaaccaccauggcacauguaaaguauaauuuguuuaaaaaaguguauuuuuacauuuucaaacauuuggugauuuuucagauaucuucuguucuugacaucuaguuucauuccauuacagagaacauacuuuauaugauuucaauucuuuuaaauuugcuaagguuucuuuuauggcucagaauaagaucuuuuuuaauguuccacuugcccucgaaaagaauauauauucugccacugaggaguauuuuauaaauguuaauuauaaauguugggguggccaggcacagugguucacacuuguaaucucagcacuuugaaaggcugaagugagaggaccacuugagcccaguaguucgagaccagccagggcaacauagugagaccuagccucuauaaaaaaucaaaaaauuagcuggguguaguggugugugccuguagucccagcuacucaggaaccugaggugggagaaucauuugagcuuggggauguggaggcuguggugagccaugauugugccauugcacuccaaccugggugacagggugagauccugucuuaaaaaaaaguugggggccgggcacgguggcucacacuuguaaucccagcacuuugggaggccaagguggguggaucacgaggucaggagauggagaccauccuggcuaacacugugaaacuccgucucuacuaaaaauacaaaaaaauuacccgggcgugguggcgggcaccuguagucccagcuucuugggaggcugaggcaggagaauggugugaacccaggaggaggagcuugcagugagccaagaucgcgccacugcacuccagccugggggaaagagcgggacucugucucaaaaaaaaaaaaaaaaaaaaaaaguugggguguuuuauaaaugucaguuggcugauaauauugccaagaucauuuguacccuuacuaauuuucuguuuacuugaucuacuauuaugagaggaguguugacauugcuaaguauaauguagauuuuucuauuuucuccucucaguucuguuaccuuuugcuuuuuagacucuguuaucagcugcauacauacuuugguuuuguucugucuucuuggcaaauuaaucugcuuuuuaauauguaaauguccaacuuuaucccugucaguuuucuuuguucugaaaucuacuuugauauauaauuaaaucuacuccaacuuuuuuucaauuacuuucugcauggaauaacuuuuucuauccuuuuaaccuaucuuuaucacuauaauuaaaauggguuucuguauauauugaguccuuuuuuuacccagucaaaaaaucucuuuuaauuggagugcuuaggccauuuauauuuaacauaucuauuaauaagguuugauuuaggucuaccauuuuauuguuuguuuucuguuuaucccuuuuuucaccaccuucuuuuuggauaacuuuaauguuuuaauguuccauuuuaauuuauuuauuggcuuuuuuggcuaaaaacucuuaguaucuuuauagucacuacuuuaugaaauagaacaccuaauauuuaauagucuacaguuaacauuuuagcauuucaacuaaauauauauaaccacauaguucccuuuacucuguagccuuugcuuuaaaagucacuuguacuauacaugcaaaccuggaaaccuuccccagcaaugccauaaauuuugcuuucaagaguagagucagggccaggcaugguggcucacaccuguaaucccagaacuuugagaggcugaaaugggaggauugcuugaguagucauauugaaagaccuuaauagaggagaaaaacucugcuguauuuauuuagauauucacaguuucuguugcucuuucuucauucaugaaguuccaaguuuucuucugauaccaucucccuuuagccugaagaacuuuuguuagcauuucuuuuagaccagauuugcuaguaauaauucuuaguuuuccuuuaucugggaauuucuuuauuuuguccucaucucugaaguacauuuucacugaauacagaauucuggguuagcagugcuuuucuuuuagaacucuaaagaugcuauuucacugucaucuguccuccaugguuccuguugaaaacccugcauucacuugaacuguuguucccuauauguaauaaauuauauuucucuggcagguuucaagauuuuuugcuguaaucuucuauguuuagaaguuugauuaucauguguuuagaagcaguuaacuuuaaguuuaucccuuuugagguuuuguuggguuuuuuguuuuguucuguuuuggauuuuuguguguguauguauggugagaacacuugagaucuacuaucauagcaauuuucaaguacacaauauaggucuccagcacuuaaucaucuuauaacugaaggcuuguacccuuugaccaauaucuccccuuuucuccuaucccccagccucugguaaucaacauuuuacucucuguuacuauaaguuugacuauuuuuaggcuccauaucuaauacaugagaucacgugguauuugucuuucugugucuugcauauuucauguaguuuauugaccuccagguucaucuguuacugcaaaucgcaggauuuccuuuuuuuuuuuuuuuaaaucugaaaugguauuccauugugguguguguguguguguguguguguguguguguguguuauauacacuguaguuuauuaauccauccuucuguugacagcuacuuagguugucuuaauaucuuggcuacuguuaaaaauccugcaauaaacauagaagugcaaauaucucuuccaaauacugauuuuaucuucuuucaauaaauaacccagaaguagaacugcuggaucauauggcaguucuacuuguaauuuuuugaggaaccuccauacuguuuuccauaauggcuguccuaaucuacauucccaccaauagaguaggaagguucccuuuucuccacauccuugccaacacuuguuaucuuuugauuguuuuuuauacuggccaucuagacagauguaaggcauuauuaaauuuugugguuuagauuugcauuucucugaugaguagugauaucgagugucuuuucauauaucaguuggccaucuguauguuuucugauccucugcccauuuuuauuauuuaguggaagggaauaugagugauuuuaagauaaggcaaggaguugugauccagguaauggaacaugguaaaggcauuuaucuuuuuuuuuuuuuuuuuuuuuuuuuugagacagggucuugcucuguugcccaggcuggagugcaauggcaugaucuuggcucacugcaaccucugccuccuagguucaagcaauucucgggccucagccuccugaguagcugggacuacaggcauacaccacuauaccuggcuaauuauuguguuuucaguagagaugggguuucaccauguuggccaggcugguugucuugaacuccugaccucaagcaauccaccugccuuggccucccaaagugauggaauuauaggugugagccacugcgccuggccucuuugcccauuuuuuaauguuguuguuguuguuguuguuuucuacugaguuucuuaaauauucuggauauuaacaccuuauuggauacaugguuuacacauguuaucucucauucuguaaguugccuuuucauuuuguggauuguuuccuuugcuuugcagaaacuucauuuguuuguuuguuuguuuguuuagacagggucuuguucuaucacccagccuggaauauagugaugaggugauagcucacugaagccucaaacuccuggguucaaccaacccuccugccucagccuuaugaguagcugggacuacaagugcaugccaccacgucuggcuaauuuuuuaacuuuuuguagagaugggaaucucacuauguugcccagguagaucucaaaguccuggcacuccugaccucaagcaauccuccagugucaguaucacaaagcacugggauuacagguaugagccacuacacuuggcuugaaacuucucaguuuaaugucguuccacuuauuuaucuuuucuuuguugccuguacuuuggguguuaaguccaaaaauaucuuugccaagaacaaugucaauuagcuuuuccccuauauuuucuuuuaguaauuuuacaguuucaggucuuauguuaaauuauuuaauuuguuuugaguugauuuuuguguaugauauaagagaaagguccgauuucucucucucuuucuuuguuuucuuucuuuccuucuuucuuuuuccuuuuuuuuuuuuuuuuuuugcaugugaauauucaguuuucugaacacuauuuacugaagagauuauccuuucccuauuguguacucuuggugucuugucaaaaauuaguugaccauaauaugcauacauuaauuucuggguucucuacuuuguuccauuggucuauguaucuguuuuuguuuuaguaccaagcuguuucaauuacuauagcauuguaacauaguuugaagucaggaagcauaaugccuucagcuuuguuucuuuugcucaggguugcuuuggcuacucaagacuggagguuugauauaaauuuuaggaaacuuuuccauuuucuaugaaaaaugucauuaaaauuuugaaaaagauuauauugauaagagacuuggacaucaggaagacuggcagacucugaacagaucuuuggagggaaggcauuuagaguggacagagggaggaagcagacacuggguggaagagggaggaagccgggaacccagcauggggaggcuaagcacagggacuuguuccuagcccccagcaucuucuggggaaaaggcaaguugaacaagugaggagcggcccgcucucaccacagacugccaggauccuagcagcaggagaucauuuccccaacagacacuuaagcuggcagggagagaugccugaaaaggcuguagguacagggcuccagccugugcaaaaccaagagggcuuggcacaggaagagcugcacuggagcacauccaaggaugccccucccccaaggcuuaccaugcuccugugggagccuuuagccuuagggugaccgucagaccuggacagagaaggugcucuugccuguaggacaaagccagucugaucuaagcacccuccugucagcuagccucuccuugggcuccagccuaccaugcccacuugcaaugcggccucagaugcccaaccagggugcuuccugggggcccuaucaugccuccuuugcuggcagacaauucuugaccaucucagaguuccaacagaccagccccugccaauacaugcuagcccacccacagcuuacccccaaggcagacuugccucaccuacuuuacuggcauauacuauuugcccaugcccugacuccccacugcuuugcuggcacaugucacccuccucucccaucccaugcugguacauguaugugugugcacccugacacccuagaacugccagcaugaguguacccugccauuauucccccacugaugugugggcacagagauacacugccaccgacaugaaggcacacaaugauaccagcaaccacaccccugccagcacccugcuccugccaugauagcagcaagagagcaugcauggaugccaguacccccaccccugccacaacugcauaaguaccugcauguacaucacugccucgcuuccacugguacccugccccagccaaugaggguguaccucgcuauacuucugcagaugcuggcacacaugaaggagcaugaaucccacugccaccaccucgaugaagugguuuggccgguaccacccauaggaguauugugaccaguggacugaaaacaccuuggcccuuccagugcagcagcuuccuaaccuugaggggccagagaacaaagccaggggccagguaccaguuccccagaguuauagcacacagccgaggagugcugagcuaagccuuggcccacuaaaaucuuccagaaaugaagccaauugacugaaccuaccuuauaucacaaucaaacacccaagggcaucaaagaauauaaaagcaaaaaaacccauccaaggacagcaacaucaaagguugaaggaacaucagcccacacaugagaaagaaccagcacaagaccucuggcaacucaaacagccagagugucuuauuaccuccaaacaacuaccuaguuucccagcaaugguucuuaaccaugcugaaauggcugaaaugagugacauagaauucagaacauggauacgaaugaagaucaucaagauucaacagaaugucaaagcucaauccaaggaaucuaaggaauaugacaaacggauacagaagccgaaauaucgaagggccauuuuaagaaagaagcaaacugaucugauagacaugcacacuucgagaauuucauaauauaaucacaaguauuaauagcagauucgaccaaacugaggaaagaaucucaaugcuugaagacugguucuugaaauuagcucagucagaaaaagaaaaaagaauaaaaaggaauaaacaaaaccucugagaaauaugggauuauguaaagagacaaaauaugugauucauugccaucccugaaagagagggagacaaagcaaggaaauugggaaacauauuugaggauaacaaccaugaaaauguccccaaccucucuagagaagucaacauucaaauucaagauaugcagagaauccugcaaaauacuauacaagaugaccauucccuaagacauauauagucauuagauuugccaaagucaaaaugaaagaaaaaauguuaaaggcagcaaaacaaaaggggaaggucaccuacaaagggaacccgaucaggcaaacagcaaaccuuucagcagaaagccuacaaaccagaagaguuugggguccuaaaugcagcauucuuauagaaaaggaauuccaggggaguagucaggauggccgaccagaagcagccagugugcauggcucucauagagaaagacaaguuaauauagcaccuucaauugaaacauccagguacucacauugggauuaaucaaggaaacaacuugacccauggagaaugaagaaaagcaagacaggacaacagcccacccaggaguaacgcagagccaggggaaccuccccugcccagggaagcagugagucaaugugugaccucaggaaaccacacuucucccaugaaucuuugcaaaccuugggucaggagaucuccuugugaacccauuccaccagggccuucggucucacagacagagcuacauggagucuuggcagagaugcugcucagacaugcauggaaacccuggaggcuuagauacugggcuuuccagcaaaagaaguugcagcucuggcaaaguggaaggcuggaccccuguacauaccccuuggaaagaggcugaaucuagagggcuaagcagccaaaaccuacaggccccacuuccacggcaccccacaagauaagacccacuggcuuggaauucuacccagccaccgguagcagcacugcaccucccuagggaggagcguccaggggaggggugggccaccaucuaugcuguuugggcaccuuagccauuccagccucugggcuuuggagaguccaagcugaccagagguggaaaggaucccccagcauagcacaacugcucuaccaaaauguggcuagacugcuacuuuaagcagguaccugauccuguuccuccuauggguggaaccucccaaguggggccucuagccaucccugccuguguucuccagacaacacagauuugaauucucccugggaugaugcucccagagggagaggcaggucgccaucucugcugucugggugacucagucauucccaucuuugggauuuggagagucugagcagaccaggggcagaaaagacucccagaaagcacagcugcucuaccaaaaugcggccaaacugcuuaaguggguccccagucccacuucuccucacugggcaggaccucccaaccagggccuccagcacuccugccuguguuuuccagccaacagagagcugaauucucccaggacagugcucccagggggaguggcaggcaccaucuuugcuguuugccugacuuagcuuuuccagccuucagguuucagagugucugaggcaaccgggggcugaaguggaccuccagcacagcacggaacagcugcucuaccaacacaugguaagacugcguuuuuaaguggguccucaaucuugcuccuucuuacugggugggaccucccaggucucuacccaccucuuacaggugccuuugggccagcaacaggccuguaccucccagggacaaagcucccagagagagggacaggcucucaucuuugcuguuuugcggccuucacuggugauaccuccagguacuagaaaauccgaggcaaccagguacuggagcaaacauaccacagcagcccuauggaaaauuggccagaguguuaaguaggugcccauucucagaucuccucaccagacaggucuuccaggcuugugucuccagccacccucuaccagagcuaccgagcaaguagcaacuuggcaacucccuggacagggccucuaggggaaacuaaaagccucucugagacugccgcugcaguggaucugcccuugccggaccaauaagagaguaaaaacccuaagugucguguccacaccuccaaccaguuguaaucagcccaaggagaggaggccaguacgucucccacaggucccacacaccccacagugcuugugacuagacagggaacccuuggccuggggccacaguacagacccuccauccuggucugauugcccugaggggcugcugaccuauaucucucuggguuggagcccccaggaaacaagcaaaugacccucagucacaacuacuaauaagaucccuuucucugcugccuccaacuugagaaagaaacauaaacacugagaucgccccaaagcugcagugggcagcccagaaguaccaaaucacaaucuacagccagcauucaagggggagagaaacucacacuuucagaacauugacagagaacacagcugcaauugugaggaaacauaggggagccacacaaccaaacaagucuaccaacugaccaaaaagccuaagccaccugcuggaucacaccccaaggcuuuaacaucaaaaauaccucacuaauguacccaccucugaaaccagagucaagaagucagcuucaaauaaagacacugcacaaagccuuggccuggugaaaacauccaaaagagaagucuguugacuauacuuaaucuacaaugcagauaaaggaacacccacacacagagaugagaaagaaccaaugcaagagcuccaguaacucaaauguucagaguauuguaugccauccaaaugaccacacccauuccccaacaagaguuuuuaaucaggcuguacuggcugaaauaacagaaauacaauccagacuauggauagguacaaagaucacugagacucaggaagauggcaaaacccaauccaaggaaaaugagaaucacaauaaagugauacaggagcugaaggaugaaauagcugguauaaaaacagaacccaaugggucugacagagcugaauaacacaauacaauaauuucacaaugcaauuacaaguauugacagcagaagaaaccaagcuaacaaaagaaucucagcaccugaagacugguucucugaaauaagaaagucagaugaaaauaaugaaagaggaauaaaaaggaauaaacaaaaccugugagaaguauuggaucauguaaagaggucaaaucuacaaaucacuggcauuccugaaagggagggggagaaagaaaacaacuuggaaaacauauuucaggaaauuguccaugaaaacuuccccaacgagguacagggccuaacaguuaaauucagaaaauacagagaacuccugcaagauucuauacaagaagaucacccccaaaacacaugucaucagcuauuccaagguuaaaaugaaagaaagacuuuuaaaggcagcuagagagaaagggcacaugaccuacaaaaggaacuccauuaggcuaacaguggaccucucagcugaaacccuacaagccagaagagauugggggcccauauucaacauucuuaaagaaaaaaaucuucaaccaagaauuucauauacagccaaagugagcuucccaagugaaggagaaauaagauccuuuucagauaaacaacucuugagggaauccauuaccaccaggcuugccuuacaagagauuuugaaaggagcacuauauagaaaggaaagaccaauaccagcuaauacaaaaacaugcuuaaacacacagaccagugucacuguaaaacaaucacagaaaaagccaacauaauaaucaguuaauaacacaaagacaggaucaaauccacacaaaucaauauuaaccuugaaaguaaaugggcuaaaugccccacuuaaaaggcacagugagaagcuggauaaaaaagcaagacccaaugguaugcuguguucaagagacccaucucacauguaaugacacucauaggcucaaaauaaagagauaaagaaaaaucuacuaagcaaauggaaaacagaaaaaagaagggauugcaaucugaauucagacaaaagagauuucaaauaaacaaacaucaaaaaagacaaagagggcauuacuuaaugguaaaggauucaauucaacaaaaaaaccuaaauacccuaaauauauauguacccaacacacaagcacccagauucauaaagcaaguucuuagagaccuacaaagaggcacaaacucccauggaaaaaauagugggagacuucaacacuccacagacaguauuaaacagaucauugaggcagacaauuaacaaagauauucaggaucuacacucaacauuaaaccaaaaggcucggauacaccucuauagaacucuccaccaaaaaacaccagaauauacauucuucuccucaccacauggcacauacucuaaaacugaccaaauaauuggaauaaaacaauccucaacaaauguaaaagaacugaaaucauaccaaacacacucuuggaucacagagcaauaaaaauagaagucaagacuaugaaaaucacucagaaccaugcaaucacacagaaauuaaacaucaugcucuugaguggcuuugggguaaauaaugaaauuaagacagaaaucaagaaguucuuugaaaauaaugagaacaaaaauacaacauaccagaaucucugagacacagcuaagacaguguuaagagagaacuucauugcacuaaaugcccacaucaaaaaguuagagagaucucaaauuaacaaccuaccuucacaacugaaagaauuaggcaagaacaaaucaaccccaauacuagcggaagacaagaaaaaaaaucagagcugaacugaaggaaacugagacacaaaaaaaacaaucaaaagaucaauuaauccaagggcuguuguuuugaaaaaacuaauaaaauaggccacuaguuagacuaauaaagaagaaggaagaaaagcuccaaauaaacacaaugagaaaugacaaagggaauguuacuacugaccccacagaaacaaaaacaaccaagagaaacuacuaugaacaccucuacauacacaaacuagaaaaccuagaagagaugaguaaauuccuggacguauacacucucucaagacagagccaggaagaaacugauucccugagcagaccaauaaugagcucugaaaucaaaucaguaauaaauagccuaccaaaaaaaaaaaagccaagggccugauggauucauaacugaauucuaccagacauacaaaugagagcugguaccauuucuacugaaauaauuccaaaaaaaugaggaagagggacuccuccccaccucauucucuaaggccaacaucaucuuaauacccaaaccuggaagagacacaacaaaaaaagaaaauuucaggcugauauccuugaugaacaucaauacaaaaauccucaacaaaauacuggaaaaccaaaucuggcagcacaucaaaaagcuaauccaucaagauugaguaggcuucaaccccaggaugcaaguuuggcucaacauauucaaaucaauaaacaugauucaucacauaaacagaacuaaagacaaaaacuauaugauuaucucaauagacacagaaaaggccuuugauaaaauucaacaccgcuucauguuaaaaacucucagugaacuagguauugaaggaacauacuucaaaauaauaagagccaucuaugacaaacccacagccaacuuuaugcugaaugggcaaaagccagacgcauuuccccuugaaaacugagaaggaugcccucucucaccacuacuauuaaaaauaguaauggaaguccuagccagagcuaucaggcaagagaaagaaauaaagggcauccaaauaggaaaagagaaaguuaaacuaucccuguuugcagaugacaugauucuauaucuagaaaaaaaaaaacauagucuuggcccaaaaguuccuccaucugaaaaacaacuccagcaaaguugcaggauacaaaaucaauguacaaaaaucacuagcauuccuauacaccaacaacagccaaacuuacagccaaaucagaauggcaaucccacucacaacugccagaaaaagaauaaacuucauagcaauacagcuacccagggaggugaaaaaucucuacaaugagaauuacaaaacccugcucaaagaaaucagagaagacacaaauggauaaacaucccauguucaugaauaggaagaaucaauaucacuaaaauggcuauacugcccaaagcaauuuauagauucaaugcuauuccuaucaaacuaccagugacauucuucacagaacuagauaaaaaccauuuuaaaauucauauugaaccaaaauagaacccaaauaaccagaagcaauccuaagcaaaaauagcaaagguagaggcaucacauuaccugacuucaaacuauaccacaaggcuacagugaccaaaacagcaugguacugguacaaaaacaggcacauagaccaauggaacagaauagagagcccagaaauaaggcuacacaccuaugaccauaugauauuugacaaagcugacaaaaacaagcaauggggaaaauacuccuaaucaauaaauggugcugggaaaacuggauagccauauguggaagauugaaacuggaccccuuccuuacacuauacacaaaaauaaacucaagauggauuaaagaccuaaauguaaaaccucaaacuauuaaagccauggaaguuuacauaggaaauaccauccuggacauaggaaugggcagagauuucaugaaaaagaaaccaaaagcaauugcaacaaaauuaaaaauugacaaauggaucuaauuaaacuuaagagcuucugugcagcaaaggaaacuauccacagaguaaagagacaaccuacagaaugggaaaaaaauauuuacaaacuaugcaucuggcauggucuaauauccagcaucuauaaggaacuuaagcaaauuuacaaggaaaaaacaaaccacuccauaaaaaugugggcaaaagacaugaacagacacuuuucaaaggaagcauacacacggcccacaagcauaugaaaagaaagcucaguaucacugaucauuagaaaaaugcaaaucaaaaccacaaugagauaccaucucacaccagucagaauggcuauuacuaaaaagucaaaaauaacaggugcuggagauguugcagagaaaaggggaugcuuauacacugcuguuagaaauguaaauuaggucagucaucagucauuguggaagacaguauggcaauuccucaaagagcuaaaagaacuaccauucgacccagcaaucccauuaccggguauauacccagaggaauauaagucauucuaccauaaagacacauguacacguauguucacuguagcacuaaagaaaaugugauacauauaugccauggaguacuauacagcuauaaaaaagaaugagaucauuucuauugcagcaacauggaucaagcuggagaucaucauuccuaagugaaauaaugcgggaacagaaaaccaaauaucacacguuaucacuuguaagugggagcuaaacacugacuacacauggaaagaaggaugagaacaacaaacucugaggucuacuugagagugaagggugagaggaaggagaggaucaaaaacuaccuuucacguacuaugcucauuaccuggguaauaaaauuaauuguacaccaaaccccaugaaaugcaauuuaccuagaugacaaaccugcacauguacccuugaacauaaaaguuuaaaaaaggaaauacugcauugaaucuauaggucacuuuggguaguauggacauuuaacaauaaaaauucuuccaacccaugagcaugagauauauuucuauuuauuugugucuucuacaauuuauuuaaucaauguuuaguaacuuucaguguacagagguuucacuuccuugccugaauuuccuccuaaguauauuauucuuuucugauggaaauggaacuguuuucuuaauuucuauuuuuggauaguucauuuuuaguauauaaaaauguaacuuauuuuuguauguugauuuuguaucauacgacuucacugaauuuauuaauucuaaccauuuuuugguauuuagguucuuauacauguaagauaauuuaaucugcaaacagggaucauugaacuucuuauguucuaacuuggauaccuuuuauuuauuuuucuugcauaauugcucuagcuaggagauccagaaugauguugaguagaagugguaggaauggauucccuugucauguucuugaucuuagagagcuuucagcuuuuuaccacugaauaugaugcuuacugugugcuuguuauauaugaccuuuauuauguugagguacauuacuucuguacuuuaauuguugagaauuuuuauuaagaaaggauguuaaauuuugugaaaugcuuugcuaagcuucuugaaucuauaaauuuaucuuccccaaaucuaggaacuuauagcuauuauuuugucaaauguauuuucuauauuaaucucuuccuccucuccuucuaagacuccaaugacacaaacuuauauauuuugcuauaaauuuuuaaauuucuuccuguucuguucuucagauuggaucauuucuauugauuuacuuugaaauucauauacgcaccucuaucaucuccauucugcuuuagaggcucaucugguuaauguuuuauuucagacaucauacuuuuaaauuuccaugguucuuccugaagauuuuauuucucuacucagaauuuccauuuuucuauucauuucaagaguuacaccuuacaucauggagcaggguuauaauggcugcuuugaugucuuugccugauuauuccaacaucugggucaucucacaauaagcaucuguauuccuuugagaauugaucacauuuuccugcuuccuuguaaguaaaguaauuuugguuuuacccuagauuuuauauuuuauuuuuuuagagaugguaucuugcuguguugcccaggcuugagugcagcugcuaucuccagguacaauaauaguguacuacagccuugaacuccuggccucaagugacccuccugccucagcuuccuggguagcuuggacuacagaagugugccaccaugccuggcuacccuguauauuuuuaauuuaauauuauuuuaaaagugaaugacagagucuuuccucaaagugcacagagacaagaagauauaaacauguaagccaauagcuacaacacauugauaaaugcuguaugaaaugaauugcaugccuccaaaauucacauguuuaaguccuauccccaauauaucuguauuucaagauagccacuauaaggaguuaauuaaggugaaaugagguauaaggguggggccuucauccaguaggaucauacaaagagucaccagagagcucucauucucugucuccaccaagugaggacacagugagaagacgaccaaccaccuacaagccagaaggagaaugcuugccagaaagcaaaucagccaauaucuugaucuuggacuucucauccuccagaacugagaaauaaauuucuguuacuuaagccucucaguauguaguauuuuguuauaguacucuaagaacacucagagaauuagguuauuauuggacuuacucuaccuugucuaacauccuaaguucaguaagauuuuucaacaguagcuuuuaaaagcaauaauguggaaaaguauacaguauuuuaaaagauuaaagacaaaaucuaugcuguaacagaaagauggaguagaaaaauaauggaaguuuucuugagaaauuuacugaaaauaaaaagguauacaaagaacacagaauucaauaauacauaguagcgguagaagaaaagccaacuguagggaaagcuuaauaaguauugacuagauagauggaaauagagagaaaacaggggaagaaugcagcugaacuggacaacgagaugguuaguuaauagcgucaauggguaauaaacacaaggaauagaucucaucaugcuuaaguagaaaagaaccuuguauuuacaauaaaauaagagggauuaacagacaagagaaagaaauaaagggcauccaacuaaaaaggaaaaagucaaauuauccuuguuuucagaugauaugaucuuauauuuuggauaaccuaaagaauucaccaaaaagccauuagaacugauaaacaaauucaguaaaguugcaggauacaaaaucaacauacaaaaagucagcagcuuuccuauaugccaacagugaacaaucugaaaaagaaaucaaguacuauuauuuauaauugcuauaaguaaaauaccuagaaauaaacuuuaccaaagaagggaaagaucucuacaaugaaaacuauaaaacacugaugccagaaauuuaagaggacacaaaaaaacugaaagauauuccauguuagugaauuggaagacuauuguuaaaaugcccauacuacucaaagcaguauacauauucaaugcaaucccuaucaaaauaccaaugacauuuuucacagaaauagaaaaaccaauccuaaaauucauauggaaccacaaagacccagaauagacaaagcuauccugagcaaaagaaacaaaacuggaggaaucacauucccugacuucaaaguauacuacagggcuauuguaaucaaaacaccaugguacuggcauaaaaagagauacauagaccaauggaacagaauagagaaugcagacauaaauccauaaaacuacaguuaacucauuuuugacaaagauucugaaaauguauauuggggaaaggacagucucuucaauaaauggugcugggaaaacugguuauccauaugcagaagaaugaaacuagaccccucucucucacuguauacaaaaaaucaaaucaaaauggauuaaauacugaaaucuaaaaccugaaagugugaaauuauuaaaagaaaacauuguggaaagucuccaggacauuggacugggcaaggauuucuugacugacaccccauaagaacagggaaccaaagcaaaaacggacaagugagaucacaucaaguuaaaaagcuucugcacugcaaaguaaacaaucaacaaagugaagagauaacccacaguaugggagaaaauauuugcagacuacucaucugacaagggauuaauaagcagaauauauaaggagcucaaacaacucuacaggaaaaaacuaauaauuaaacuuaaaaugggcaaaagaucagaauagauguuucucaaaagaagaccuauaaauggcaaacagguauaugaaauggugcucaacaucauugaucaucagauaaaugcaaaucaaaaguacaaugauauauuauuucacuccaguuaaaauggcuuuuauccaaaagacaagcaauaaugaauacuggugaggguguggagaaaagggaacucuuauacacuguuggugggaauguaaauuaguacagccacuauggagaaaaguauagggguuucucauaaaacuuaaaauuaaacuaccauaugauccagcuaucccagugcuagauauauaccuaaaagaaaggaaaccaguauacugaagagauagcugcacuccaauguuuauugcagcacuauucacaauagccaagacuuggaagaaacagacaaaugaauaaagaaaaugugguaaauauacacaagggaguacuauucagccauaaaaaaaugagauccuaucauuugcaaaaacacggauggaacuggaggacauuauguuaaaugacaaaagacagacacagaaagacaaacuucgcucauuuucacuuauuugugggaacuaaaaauuaaaaacaguuaaacuuauagagauagagaguaaaauaaugguuaccagaggcuggggaggguagugaagguggggggcaguuaguggggaugguuaauggguacaaaaauguaguuagauagaacuaauaagaucuaguauuugaucacacaacagggugacuacaguuaauaauaauuuauugcauauuuaaaaauaacuaaaagaguauaauugaauuguuuguaaugcaaaaaaaugaaugcuugaagugauggauaccuuauuuaugcugaugugauuauuacacauugugugccuguaaaaaaaucucauguaccccauaauauauacaccuacuauguacccauaaaauuaaaaauuuuaaaaauguaaucuaucagaauaaaaucauuuaaaauaccuaauaucaauaaauaaagccaaaaaauguaaauaacauuugaaaaaagauaaucaacaauuaagaauacaucuucuucucaagaugggacauuuauuaaaguaacuauaaacuaggcccuuaaguaagucuuacaaauuucaacaaaaucuaccauacaaaccaaauucugacuauaacucaauuaacauagaaguaaauaugaaaagguaaaaucuccuauuuucagaaacauaaaaagacuuccaaauuacucauaagacaaagaaaugaucagaacaaguagaaauuacuuaaaaaugaguauuaaugaaaauauuacauuacucaaacauaaauuuagccaaagcaguaguuggagaaaaauuugaaaauuaaucugcuaagaguccaacauaaacauaauagagccaaagaagauauaacagaggaaacaauaaugcauuaauauacauaaaugaucagcaaagccauaaauuaguuauuugaaagacuaauaaaacagacaaaucucuggcaauacugguuaagaaaaaaagaaaaaggaacuaacgaucauaaaauaaaaacaaagaacuaaaaacguuuuagacuuuauaucucuuuagagagcuuuaauuuuuaaaaaccauucagcugaauuaaucuacuuuaagugucacauuaaaggaaauacuacaacuaacuagagauuuaaaaauugagaguauaugggauagaagacauugacaacuuuaaggagaauacaaaauagaauaacaucaaagaaaucaacaaccugaauagaguugaaagcauaaagugaauuaguaguugaagugcauguacacacacaaauacacucacucacacucaccauuugacccagagaguuuuuacugguaacugcuaccuaauagaccaugauuccaaacuuacgcaaaauucucccaaagaaugaaaaaaagacaaaacaccugcaaugcauuuuugaggcuaggauaaccuugacaacaaaacccaaaaaagcacaaaacagacuaauuuuacucauaaacacagaaccuaaaccucuaaaauguuaucaaaccgaaauccuaaaucuggcaaaguagauuaaaacaauauaugaggcucaaguuggauuuauccuaagaauauuuaggugauuuaacaugagaaaaacaauugauguaauucuucacauuaaaaaauaaaggcaacuucugggauagaacaaaauuaaguagauguauuuuccuccugcuaaauacaacuaaaaacucuggcuauuuuaugaaaacaaacauuaaaagauucugaagguggagauaaaaaggaagacuggcuagaaacuucagaacccagagaaugacacagcaguaaguucccuggguuucuuuuuaccucuuauaccccggacugugugcuagacaaauuagcaaacuguaucuacacuauaaauacaggaacaacaaacuugcuuuauccuucuccucuugaguguucuaaauuaucuuuggugguggagaaaaaaaauuauaacacugucuaaugugguccuauauguauguagaggaaauauuuaaaacaacuaugcuacacacacaggguagaauaaagggacauaaagaaagguaagauuuuuaaacuucacacuggaaaaugauaccaguagacugguauaauauaauacugcaaccacugaaaaaucuauauaaagagauacacuaaaaaacaauauaaauaaaaauggaauucuaaaaaguauucaaacagcccccuagaagacagaaaaaagaaaacagagaaaccaagaacagggggaacaaacagaaaacuaaaaguaaaauggaaagccuaauguauuuacccauauucuuguuuacuguauccuuucuuccuguuauuccaaaguuuuguuguuguuguuuguuuugagacagggucucauucuauugcccaggcuagauugcaguggcaugauggcacgaucacagcucacugcagccucaacuuccugggcuuaagugauccucccaccucagccgcccaaauaggugggacccacagacgcauaucaccaugucugauuaauuuuuuguauauuuuguagagacaggguuuugccauguugcccaggcuggucuugaacuacugagcucaagugauccgcuugcuuuggccucccagccuaaaguucuuucuuuuaucauuuccuuucugcuuaacgaauguucuuuaaccauuauuugaggguaagucugccggcaacacauuuccuuaguugucuuuccugugagaaggucuuaauguuuccuucauugcugaagaauaauucugcuguguugacaguuaucuuucagcacuugaaauauguuuuaccacuuccuccuggccuccaugguuucugaucagaaaucuacugucauucaauugcuuacuuguaggcaaguugucauuuuucucuauuugcaacauuuuuucuuugucuuuauuuauugguuuaauuaucgugccuuuggcaugaauuuauuugaauuuuuccuauuugugguuugcucuguuucuugaaucuguuugcuuaugucucuugcuaacuuugggaaauuuucagcuguugaguacuuuuucagucccaccuucuuucuucucuccuucaagaauucugacaggugucaucuuuuguuauugucccacaggucccugaggcucuguucauuuuuuaacaagucuaauuucucucuguuguucagauuaggaaauuucuauuguuuugucuuucaguucacugguucuuuccacuguaacucccauuuuccuguuggguccauccacugaacuuuuucaguuucauauuuuuucagcaccaaauuuccauuuuggucuucuuuguaucuuccauuucuuugcuguggauuucuacuuuuucauuuguuucucacauguauugcucaaagcauuuuaaucauggaugcuuuaaaaucuuugucagugauucuaacaccucugucaucucaguguugacaucuauugacuaucuuuuauuaugcaaucugagaucuuccugguucuugguaugacaaaugguuucaauggaaagcuggacauauuuauauuauguuaugaaacucuggaucuuauuuaaaccuucuguuuuaacuagcuuuuugugacacugcucccacaggggaaggugggaggggggcauugcuucauuacugccaaguggaggaugaaguucaaguuucccaauuggcuuccacugacacccaauaagggcauccucauuacuacugugugggacuuggaguccaggcuuccuacaugguuuccacuggcaugguacuugggguggccuccuuaccacugggugacagugaaagacauaacucucuaacaggccucuucugaccccaccccaguauggccaggaaccagcacauuacuuuuggaugaagauggcagccuaggcuccacagugugguguuccgucaacauugugggaagggggguguuggggaagagagagagaguuuuugaccagccaagagggaagaaaucuuaucucucuggccuucucugauacaacccuaauggugguacugggacacuguuauagccucaggagggcggaauucuaagcuucccauucagccuuuuuuaagaguaggugguacuacgguuuuuuugugugauguuuaaaguagagcagauacggcugaaaaguuuucuguuuugcuaggcuguucuuucucugguccuuuggcuagagagaauaguaucuuguggagagguuuucauuguuguuguuuuuuucccuuugccuguugaaauuugcagguuccuggcuuauccaacacccagucugggauauaugagguaaaaaguaaauccaggcaacccacuacugugucauuccuaagguucuaguguccuuaaccagucuuucuucuacucgcuaccuuucagagucuucuuauguuuguuuuauguauaaugcccaggguuuauuauuguacuuagugagagaaauaggggaaaguaugucauguucaucuucccagagguacaagucuuccuaaauugcauuucccucccaccauuugauaugauagaagcuaugaaugagggcagggauuuuuguuuaauucccuacuguaugcccagcacuuacaacagugcuaggcauauaguagauacucaauaaauacaauugaauaaauaaaugaaaaaaugcauuuauagugauccauuacauuauguuuuugaaugaguaacuugaaauuuaaguagcuuagugauggauaaauaaguuuagaagaaaaauaguggugaacuauaauacaacuaacaaguuaaaaaacaaaucaauugauuuuccucuauaaaugaaauuaaauaauuagguuuuuuuuaaacuaucaauuaagucuaccaacuuagacuaaaucuaacucuguuuuggaaaaugaguauccucuaacgucuuucucuucuuuauucuauuuuccuccucccccuuuaucuucccuugcuuucucuuucuucuccuaucauuuuuucucaaguguccaaaacaaaccuugauauuuucucuuuuccuaaacauguucuucuuuuucagucacccuggguaaugaccacauccagacuggaaucucugcaucguuccaguccucagcuuucuccuacccacaaccaaccaauuccuaagauuucuuaauacuacuaaugcauaccguauugucuagcuucacugguuagucucuucuuucuucuuuuuucuuugaauaaacuuauaacuguauuaauuuuuucuuuuuaaaaauuauuuaaaaauuuuuaaauugacaaauacaaauuguauauaugauauacauguuuugaaauuuguauauaucauggaauggcuaaauuguacuaauuaacaaauuaauauacauauuaccucacuuucuuaguccauuuuuguauugcuauaacaauacccaaaacugggucauuuauagauaacugaaauuuauuucucauaguucuagaggcugggaaguccaagaucaaagcaccaucagauuuggggucuagugaggguccugucucugcuuccaaggugguaccuugaacacuacauccucuagagugaaggaauguugugucuccaaauggcagaaagcaaaauggcaaaaaaggacaaacucccucugucaagcccuuuuauagagguauuaauccacucaugagggcucugcccuuaugagcuaagaacaccucccaaaaagccccacuucccagcacuguuggacaggggguuaaguuuccagcauaugaauuugaggggacacauuuaaaccacagcccucacauacuuaucauuuuuuggugagaacacugaaaauauacucuuuuaggaauuuucaaauauccaauacacuuuaacuauagucaacauuuuguacaauagaucucuugaacuuauuuccuuuuaacugaauuuuuauauccuuuaaccaacaucucucugaucccucuccuuccagcacacgguaaccaccauucuacucucuacuucuacgaauucaacuuuuuuagaugccauguauaaggaagucaugcaguauuugucuuuaagugucugguuuauuucacucaacauaaugucuccugggucauccauguugucacaaaugacaggauuuucuuccucuuaaaggcugaauagcauuccauuguuuauauacgcaacuuuuuuuuuaucgacucaucaguagauggacaauuagguugaguccuuaucuuagcuagugugaauaauccugcaaugaacaugggaguagagauaacucuucgagacacugauuucauuuccuuggcuauguaccuacaagugggauugcugguuuacauggagguucuauuuuuauuuuuauuuaaucacauagaagacuaauggcaguucuauuuuuaauuuuuugaggaaccuccauaauguuuucuguaauggcuguucuaaauuuacauuccuacuacaaggguucccuuuucuccacaucuucuccagcacuuguuauccuucggcuguuugauaauaugcauucuaacgaggggauaucucacuaugguuuuaauuuucaucuauuugcuguauagugauuuugagcaccuuuuuauauaccuguuggccauuugaaugucuuauuugagaaugucuauucagguucuuugccuaaaucaggcuauuuauuuucuuacuauugaguuccucauauauuuuggaaauuagccccuuauccgaugugugguuuuuaaauauuucuucccuuuuuguaaauugucucuuuacucugaugauguaauuuaguuugauguaauuccacuuguuuauuuuccuuuaguugccugugcuuguggugucaaauccaaaaaugucaucacccagaccaaugucauggagccuuuucccuauguuuucuucuaguaauuuuacaguuguaguagauagaucuuacauuuaaugcauuuugaguugauuuucuucuguagugugaagggucuaauuucauucuucuacauguggcuaaccaguugucucaacacccuuuauuaaagagacuguccuuucccuaguguguguuuuggcacuucuguugaaaauuaauagaccagaaaugcauggauuuauuuguggguucucuauucuauucuauuaguuuauuugucuguuuuuaugcugguaacauccuguuuuaacuaauauagcuuugcaguauauuuugaagucaaguauuuugaugccuccagcuuuguucuuuuugcucaagauugcuuuggucagggucuuuugugguuccauauuaauuuucaggauugucuuuuuuauuucugugaaaaaugacccugaaauuuugguggagauuucagugaaccuguagauuauguuggguagauuguuaauauaaacauuuuaacaauauuaauuuuucaaucuaugaacacauauaucuuuccacuuauuuguguuuuuaugucugaaguggaaaaagaagaaaaaaaauacugcauuuaucccuaucaaacuucagcucaggcaaacuaacuuagagaaauaaaauauaagcuauaguucaauuuuuuaaaagccuugggauuuuacucagccucaauuucaaugugaaccaaaagucuauguaaucuuaaauucugacuaauacagaguuuagccuaucugaagcacuuuacucagcucugagaaccagauuuuuaagagcaauacuaacaaaucagugguaagccagaagacuaaguaagacuguggugguuccagaagauuaaagaaacuagcaauaccuuaccugggagaaagaaaagagggaacuugggaaaaggauuauaaaauagcuauauuuuaauauuuauugguauuaggcucgcauuugaaaaaaaaguagcagaaaaaagaccaaagcacaauaugauagguugguuucauauacauaagaauuuucaaauaaucuaaccuguccaauaacuugauggacugcuuuauuuaguucucagagaucagaaguguuaaggcaaagacuauaugucccccuguuagaaauacuguugaguagauugcuucagcaggaaagaggcuagaaaacaguagugcuucucaaucugugauccuuugugcuagcugaagugguacuauguauggaguuuugaauagguugcaauuguugcugagcaggcaaaaugccuaacuucuccaaccuggcuucaacaaaauguucuacauauuuauccagcuuuugcaguggcuuuuauuagagugguaggguuaggguggagagaaguauuaugcuuuaaauaaauaaauaaaaguucaaaaauuacugaaggaccugaacaaagaucucuuucaauucuaauauuguuauuaauuccuauuucucagcuauauccuaggaaaguaagaucaacaucuuauugagagauuacugcaaauaauauuaauauaucugauuuuaaaagccuccuuuucuucaauaacggggcuuuuagaguaaaguaacugucucagcucuucacuuugccuguaucagcacagccuauacugugucugggggagauuuuaucucucucuggaaaaguuuaauguugaaaacaaauguccuuuuacuucaaaaauaaccaguaguuguagaaaaguagaucuuagaaacacgcaaaguuauaaaauuuuaauuuguacuucuguaaaggaaaacacuggaaaaauuaguugcuauguaacuaaaucauaagugaagaguguacuaucaaaauaaucaugacuucuccaaaaguaaaagcaauuugcuauauauuaaaauaccaaaaaauaggaaauaauauaugaaagucccagaugcuuggaucuuuaaaauaccucaucucaaaaguuacagauuauuucauacuuccuacuauauauauauauauauauauauaucagugaccacaagagucaacugacagaaauuuuuaaauuaacuuaccuagcuuaaaaaauuaacacaauucguacuguaucagcuuucuuacuauaucuuagucacacaaguagaauucuuauccauaaaucaacuggggauucuauuugcauuauaguauuauucagaaauaacauuaauggauuugauuguuuagaaauaauucugaaggggugugaucuauauuuugcugaagcacaacucagaagauggcagauuagugcgcaggaggcauccacuuacauaguagugagucuacccaaccacuuggcaugggagucucaacauagccuuacuguucauuugcuauugauaguuuucuauugauaguuuuugugagagaaucauaugcuaaaugauauaccagaucaagggaauuagguuuuaagguaaaauucucaugaacaucaagguacaucagagucuauucuauuccauaugcuuuuuaguuaggcauuguuuauaaauuuaugcauaaaauuuaaaaauacgaucaucacacaauauaguaucuaauaauaucucaaaauacuaccauauccuuugcuuuuauaaaaauuuuauuuucuuauaaaagguaacauuaauggcagaaaauuuaggaaacacagaacagcaaaaaggacaaaaaaaacccuuuuaaaaugcaaaacaaccaaauuuaacagaaaaaagcauuagcaauuuuacaaaccccguuuuaaauugcagagggauaaaugaauucauauuuuuucucccauguaguuucaauucaauccuuugcucugggcccacaguacugcucaacucauuuaaacacuuauauuaaaaccuggaugcuuucagcaucaaaaaguacagaauagaauuaaucuucacaguacgccugagaugcucauaaguuauguuaccaaagcaaguuacuacuacugaugugaaacuguaucauuaagauuguaaagauaauaaaaaacuuaagugaaaauaucugaugaucaaguuugcuuuaggaagaccagauaaugggauuaaugugauaaaguuaguacuuauuguuacuaagauuuauacuauauaauacuucuugaauuuuagcaacuauauuuuauagaucuuuuuaauuuaaagaaucuaaaauucagagaguauagcuuccaaguuccccuuuaaauuguugagaauuauauuucuaauguaaguauacuuuuugauuuaagaaaaucaaagacaagcaugucucuuacauaccucuuuuuuaaccuacuaccugcuaaaacauuuacaaagauaccuaaguuuaagaaaguagaugcuaaacaaauaaacauaaugccuggaaugcuucucuguaaauugauuaaaacaccaucuaguaaccuuugggaugcgcuuccuuucaauuuaagcuuuuauuuuaauuacuuauggaaagucacuuuucuccuuguauguggcaauuaacacaacauuuucaaugcaucccagaaauagguguaaaucugagaacagaggcucuuucguagucacacaggccaaaagauuugacauuucacauuauagaauguuggcuaucuaagucacacagacuguaugauuucuaaaauuucaagcuuauuauaaagacagcuggugggaaaauaaauaguacauuagugcuuuuaccuuuuagccgguggcuuaaaaucuguuccaaaauagcugcaaaauuguuaaauucaggagaagaaucaucaauugucucaaagcaagaccgaucaaucagggucuucacagaaaaccuaugaaaaaaagauuauuguugcuuuuaggcagaguugauucauucccuaaguaugaaaaaaaugggaggaaggcaauuuggggaagaguuguaaaaauauuuuacaagaguauaacaucugaaaaaccccauuuauucaaauuuacucuguaaauggaaauuuuuacagaaaggagucuuuuuauugauauauuuccuauuuccucuggucagaauguuuguguacucccaaaauucauauguugauaccuaaucuccaaagcaauaguauuaagggugggugccuuugggaggugauuggauaaugagggcagagcuuucauguacagaauuaguacucuuauaaaagaggccugagggagcuuguuugccucuucugccauguaaagacacacagaaggugucaucuaugaggaaugggcucucaccagacacccaaucugauggugccccgaucucagccuucccagccugcagaacugugagcaauaaauuucuguuguuuauaaauuaccugguuuaagacaauuuguuaaagcagccugaaaggacuaagaaaguaucuacugaaaaaacuaagacucagaaauagcuaauuguccccauuaaaaucaaaaugugaccuaacuaaauuaacuccaaaauacucaaaaacaguaauacuacuuguaagaaauuugagcugcagacucaaaugcuuuugagaguuucugagcacaaaauagaauaaaauaggacgugagcauuaaugagaagaauacgucuguauuagucuguuuucacacugcuaauaaagacuuacccgugacugaguaauuuauaaaggaaagagauuuaauugacucacuguucuacauggcugggaaggccucacaauuauggcagaagaugaaggaagaguaaaggguugucuuacauggcagcacgcaagagagcauguguaggggaacucuccuuuauaaaacuaucaaaucuugugagacuuauucacuacuacaagaacagcaugggaaaggcccgcugccaugauucaauuaccuaccacugagucccucccacaacacauaggaauuaugggagcuacaauucaagaugagauuuggauggggucacagacaaaccauuucaacauccaaaauuuuuaugagcuuauaaauagcaaaaccugcaaaucuguaaaguguacuauauuuuuccuuaucagaauguccuuugucucuauuuuugacugucaaaaaucaauguauuuuccaagucucaacucaaaugucaucuucucaauggagaauuauccaccugcauauuccuagcacaaacaaacauuuuauuugcauuuauuucccuuaagagaaaauuacaauuuaucuuacugcuaccauuuguguuuucaaucuucaucuuauuaggacacaauuccuucaggcagaaccacgcuuucugaacuauguaucucccucagcaccuaggacaaugcuuugaacguuguacccaguagguaccuguugauuuauuuguaagcucuauuuugaaagaaugguaaauaaauguuuaaacguccuaucauggcaagacccaacauauaguuuauggguuuuaacauguguagauucauauaaccacuaucaaaaucaggauacaaaacaguccugucaccucaaacaacucccucaugcucuuuauaguaauauccuauaaaggaugguauaugagugccuaagacaguggggaaucaagaagauaaggggagcuguuaaagaauuagaaauaaaaacuauaaaggagauaaaagaguacaagcuuuuuuuaagguuuuacucuugauaguuaugcuauucaauccggacagaaaauacaggagacaggcauaaagggaaauauagaaagauuuguuuauauagguuauaucuaguauucaccauauuagaaauugaacuaaaagauuuuaaauauaggcaguccucacuuagcacagcaguacaggaccauaacaguaacucugcaaguugaaaccaugcaaaauaaucuuuauaauuaaguaaaaauuauaauuuuccugugaccuuuauaaauuuuugucaaaacauuaaaaacuuucuuacaaccaguuauaucgggaaauaaaaaauacuaaaacauuuauuuaguacacuuuaaaacauuagaaacacugagaauucaaguguuuuacuucucuguaagaaacuuaugaagaguaaucugaacagugcuugccucauucuucucauuuauacaacuuaagauauaguguaagccucuuuuuuuuuuugucuuuuggcaaacugccauauuucuugaacuagcuuccaauauguuuuccuuuacacuuucaaugcugugaaauaccucugagaagcccuuuaaugugaaguguucugucagugucacuuccucugggacauuuucauccuuucuguugcaaccacuuuccucauuuuuauaugaacauuugccuccacuaaguuccuuuggcugcauaucuagauucucuuaaacaggagaaaugugcacauucccaugaucaaugauuucuucuguaacucccuuuauauucaugcaaaucucacuuugagcauuaucauuuuccauuucuuucuuucuuuuuuuuuuuuuuuuugagacagagucucgcucugucacccaggcuggagugcaauggugugaucuuggcucacuguaagcuaugccaccccgguucacgccauucuccugccucagccuccugaguagcugggacuacaggcgcccaccaccaagcccggcuaauuuuuuguauuuuuuaguagaggcgggguuucaccauguuagccaggauggucucgauuucuugaccucaugauccaccugccuuggccucccaaaguguugggauuacaggcaugagccaccgugccuggccuaucauuuuccauuucuuuucuguacuuucaucucugcaaguuggccaauuuacucuuuuugauuauccauuuucagaugcauagggacaaauccuagacagacuuugaaagaagugauauuauuggugucugaucaugauguguauuuguuaguuauguaaugguuuguggacuaaagagcuaguggcaaaauguguauuuuaugcaacuacucacaacugaauuacaaugguaauucaaauugaaaccacguuauuguaggacugauguuacuuaacuaaauuaugaaauacuggaaccaugcaaaguaagaacugccugcauuuauuuacuaauuauaaacaaaauaaauucauuacauguugcauaaaaauauauuuuuaugaaacuuauauuuuccaaaagaaaaauguagcaauguuuacauguuugcaaauaucuuuaauguguuuaauagaagacaauuagauuauauuacugcuuuugcauucaagcuauuauaauagcacacauuauguagcuucuggaaaacuccagcauacacuucuuagaaaaugggaauuuuuaauaaaaaagacaaagaaaaugacaauaacaacaacaaaagagaauggaaauuuuaaaaggcaaauaaugucuuagaauacuuaagaaaauaauuuugacuuuguggaccucugaaagcaucuggguccagaaguacacuuucagaaaugccacccuauggcauucuuguuguguaaugaaauaacucuccuaugaaacgagaaugauacaaauuacauaccauuacauauauaugggauaauggaaaauauaaucacucaaauaauuuucagucuucuuugguucagaugaacccugauugaggaaugcugagauagauuaauguucaacuacauaguauuaucuacaacagcaacuggagcucaauggaauaaauuaucaugcaauaacgggaaauaacauauaggaaguaacacugauaaaguuaguuucuuguaccuaacggauagucaaguuagacaaaugccagauguaaugcauaguaaauggauagaaacaaaaagauaaagagaaaacagauuuaaaagggacuugaaaacuuuuauuuccuacguccaucucagugacaauacacaagaauaaugcugccaaucccuggcaaacuuuuaauaagaaauaauaaguacaguguguaggaaaaggaaaugagaaauguuucuaaaaugaauaaauaaaaagcacacaaucuccaccuccaccuccaccuuugaccugaauagaaggaaauuucugaauguauuucucuaaucuucauucaguagaauggaauaagaaagcuaacucugcauccacacugcucaaggaaggaauaaucuacugcuuguaaaaauuaugccauuuaagauaguaaugcaucuccauaaaauacaccaaaacuuauauuugaaaacaaaauuaacaaagugcuuaauucaucaaaaauaaaaaucuagguuagaacucaauuuccaccuuuaacagucugauaagauuuuagucacuauguucuccaggaauaacacuagauuacuuaacaaacuauuuacuuuguaaaauguagugggaagaaaaagccauggcuauuagugcauauauuuucauaucaucaagagaccuauauggaucaaucaguagucaacaaaaugcacaaauauuuuucuacauuacucauagguuacguuccuacagaagauacuaucugugucauaaaaacauaaaaugucaaauaucagagcacuaaauuacuuuaaacucaacagcuaacuaaaaacuaaaacaaaagcgaaguccaaauaucccaaagcauauccuuagacacaauuucuaugauuuucaagcauaaagacauuuaagggugagaaagcauuacaaaaauuucuauuauaucaaagucaguaaugaagaaaaauaauguucuccagcuuugcuucaucauucauauccugcucuccucccuccaacacaacccaaaauuucagaaggcaaaucaaucccuuagagucuaugcuucacuuucagcuaaccgauucuucccacucaauacucacuucucuaaaaucauauagcuagucaugaguauaugccagaguaaugagaaucuguccuucauaacacaguaacuaagaugugcuauaaaaaucaaaccuguagaaagaauuuuaauauaucuaagaaauaucacacagaugcugagcuauuuccugauaaugaugacauuaauauuagucaucuguuuccuaaaaaggaaugauuuuuaaauaaugaaaugacaauuugaugaaugucuaaaaauaucaaaucaagucuaaguaacagcuuuuacauaaaaauuaaaaaucaaaaguuuauauaaaagagacuuauaauuaagauuuugaaaugcaguuuuugaaaugucucuauuuaaaaagauucucuuucccaccuucaaaguccaaggaaauuuuuguuagcuuagaaaugagaaacaaugggccaggcgugguggcucaacccuguaauaccugcacuuugggaggcugaggcagguggacaaccugaggucaggaguucaagaccugccuggccaacaugaugaaaccccaucucuacuaaaaauacaaaaaauuagcugguugugguggcacaugccuguaaucccagcuacucaagaggcugagguaggagaaucgcuugaacccaggaggucgagguugcagugauccgagaucgugccacugcacuccggccugagcaacaagagcaaaacucugucucaaaaaaaaaaaaaaaaaagaaagaaagcaugauugugacuaaaaccuuaaaacuuaagaaagcauggacuaccuuuuucccuuugucaucauagcaagagaaaugagaugguuaccaaaacuguuuaaaacauauuaauuacauccauauuacauuaauuccuuccauaguucauagauuuguaacauaauuauaauuaaaaauaacuuaaaaauuuuaaaugugaggacaaaucaaaaauaauuuucuuuaaugucuauaguuuuuauuagaaauuauuuuuauagugaaaauucaucuuuaauauuuaauguucugcauuaauauauauauauccauauauacacagagagaauaaguaguaaaaaaaauuauauuccuaucccuuuacaacaagcauauauuauuuggccauuuauccaauaugcuucaggaaaaaaaauguucaaauaaaauagaucuucuuaucuauaccauguuauaucccuuuauauggaaugauaucugaagauaacuaauguacaugaaaacaucuagaaucaucacauuucaaaacuuaaaagggcucacaaagguuaaagucauuaauaagagugauguuuuuaauagaacguaaguauccaaaauaugagacagagaacucuccacuauuucaaaccaaauuuacaauauuccuuauuauaugucauugcuguuaguagucucuaacacaggggugagguaauuauccucugccauuaaaauaacagucagcaucaaugaucaacaaggagauggcuuccaagagacaugacacaauccacaccaaacauaauauaagcagugacuauaggugauaauaagcacaauacccagagauaucuguucacuggaaggccuauuuucucucuuauauuuuacaucagaaacacagagaauuuuucagaaucaacaauuugcaggucugggcacgguggcucacgccuguaaucccaacacuuugggaggccaaggcggguggaucaccugaggucaggaguuugagaccagccuggccaacauggugaaacuccaucucuacuaaaaauauaaaaauuauccagguaugguggcacacacuuguagucccagcuacucaggaggcugaggcaggcgaaucacuugaaccugggaggaacagguugcagugagccgagauggugccagugcacuccagccugggugaaagagcggaaacaaacaaaaaaaguaauuucccuucuuucuucaaauauuaugcaacuugcgaauucuuggccgggcgugguggcucacgccuguaauccuagcacuuugggaggcugaggcaggcagauugccugagcucaggaguucgagacuagccugggcaauauggugaaacccugucucuacuaaaauacaaaaaaaaaaaaucagcugagcauggcggcaugcaccugcagucccagcuacucaggaggcugaggcaggaaaauugcuugaaccugggaggcagaaguugcaguaagcccagaucaugccacugcacuccagccuggcaacagagccagacucccugccccgcacccacacacccaaaaaagaauucucaaacaucauguguauuuuccucuuucuuuucuaauauaauuuuaaucuauuuaaaauauuuuauaaugagaaaaaauaccuuucacauauccuuuaagcaggggucuacagacuguuguccacaggccuaauacaacuaguuaaauguuuuuguaaauaaacuuuuauuggaaccaaaaaaagucccaaccaucuucccugaaauuuguacccugaaacaugaaacucucuucgugauauuuuauuaucucaaaaaauuuuacgcaauguaaaaaucaacuuaaaaauaaaggaagaaagcagggccaggugugguggcucacaccuguaaucccaacacuuugcaaagcugaagccacaggauggcuugaggucaggaguuugagcaacaaagcaagagcccaucucuauaaggaaauguaaaaauuagucaggcaugguggaaagaggcuguuauuuuaagcaacucagaaggcugaggcaagaggacaacuugagcccaggaauucaagguuacagugggcuauggucaugcgucuacacuccagccuguguaacagagcaagacccugucucuaaaaaggaaaauuuuaaaaauuaaauaaagagacagauguguauuuaaaauauuuucucaaucuguacugucaaaauuuauuuuaaaagagaauuguuaaucuagacacuuaagaauggaaauacuauauuauuaacaucuuguauugcuauauaagcagacugaugacagcagauugccaaacauaaaaaauaacguuagaagcacacucuuaaaauaaaaaagacaguuugcugagaaugaugguuuccagcuucaugcacauguacccuagaacuucaaguauaauaaaauauauauguuaaauaaauaaauaaauaaggcaaaacuuuccaaaaagauucaucuaaaauuaguaagccaucaaaccaagaaaacuuccuaucuuaaaauacauugguuuaaucucauaugaaagaacucccaauuaaaauuauuuuaauaaagaacacuuuauauacuuggaucacauaucccuugggaauccaauuauucuuuauccaagaacaaaugaaaauauucaaauagaauacuuuaacauagugagcuuccuaguaagcuagacauuaaaagcagcaauagaacaacgugaagaacagaaaaaaaccauaacauauagucuucaugguuuaucaacacuagaaugcuacgaaaaugaaaggucccaguuucugucuaugcaaacacacacaucagcugacuuguaucacagacaaucaagacagcacaguuuuaaaaauauauauauauguuuugaaaccagauauauuuggguuugaauucuggcaauguuagccuuaacuauaaaauaaaucuaauuuaaauaaaaauuauuauaauuaaaauuuccauuauuagugaugaaggcugaaucuaauauuuuuccugcaaaaagcauaucguccacguauaaauuaaauauauuuucuuaucauguuaagauacagauguuuugugauugauuuaugaaaauuuuaaauuguuauuaauauuaauuuugagauuagaccugaaauauaacagaagauuugguucuguaaauacuaagauuuaaaaaucacaaaaucuaauguuaaauaugaaucuuuggaggauauuguuuuccuaaccucuucuaaagacaaucaccaucacuggagauaacagacaauaaaucauuuuacuuagcuaaaacaacaaaaugugggcaucauauccacuuucuuucuuucauaaaauauuuucaaaacaauauguauuuuggaggauuuguuuuugaauaugcaaucuagugucagaguaaaagaggaaggcagggaagaagagcucuuucauuuagugcacauucacagcugucggccagcuuuugguaaacaguaguuacugugauuguuuacugucgcccccaaaucagugcauuuuguuguuuuggcuugcuggaggaagggugcuagaaaauauaccaaauccaaguugaaaacccugaaaggccaggagcaaacuguagguuguucaagacuaaccaugguuaaaaccuagucuggauucagcacagucccugauuggaugaaagcaaucagcugcuacucaaucuuauggaggaagaugaacacuaguaaagcaaaguggucauuaaccuacacuauuggccauggguacuaguaaacuguuggcgauaucuuucuaaaauuaaguggugcauuccaucuguuuacuccacuguggucuauuucuacuguauacuauguucuuaugaauacuuugacacaaaaugguugacaaaaggguaaacaugauaguacuaaaagaacaacaaaaguauuaaagaaauaacuuaauaaacauuguguggcauucaauaacauucuagaugugacaaaagauagaacauacaugacaaagaaaggaguaagagagaaaaagcagaccauaaaaguagauauaaagauaauucaaaauucuaaauuaauaagaacuuuaagauaaaugugaguaauacauucaagagaugagaagaaaugaaguacauagguaaaaagacagguuuuuaaaaucagaggguuagagucuauuuuaaaaaaucaaauaaaaauucuggaacuaccugaaauuaaaaacucauucaauggauuaaacaguagaauagacaaagcauaagacauaauuaaugaacuagaaaaggagucaauagaaaacauacaagcugaagcauaaagagaaagaagaauagaaaccaugggaaagaauaugaaucaagugaggccugguaaaguuuaacauaauguaauuggaguguaaaaagauaauggagacacacgugguggcucaugccugucauuccaacacuuuuggaggcccaggcaggaggaaugccugaggccagcaguuugagaccacccugggcaacauagccagauccuauaucuacaaauuaaaaaaaaaauuagcugggugugguggugcaugucugcaguccuagcuacucaggaggcugaggaucacuggaacccaggaguucaggguugcagugagcuaugaucgcacuacugcacuccagccugggcaacacagcaagacccaaccucuaaaaaauaaaaauaaaaaguaaaaagaagauaauaaccaaaauuuuuccaaaacugaggaagguaaaauggaaaggguaaauauguggauaaauauaaauguguauuuccuaaauaccuacuguaaaaaaauaugguaauaaaauaauguaagauuuaauauauauauauauauacacauauauauauaaguauguuuuaggaugugggggaauaaaugguucuaacacuauuggagaaguaguaaaaguuacaauuugcauuaagcuguaauaaaccaaagguaacugccaaaagaauagaaauauauauaaacauauauaaagaaauggaauauaugacucacaaguucacaaaguaaaaaacuggaaucauggaauaaauggaacuauaaaaauauuaauauuuaagaaggcaagaaaagagaaaaaagcaaacauacaaugaacaguaagauagcuauaaauccaaauauaauaguaauaacguuaauuaaaaugggcuaaauaauuaaaagacuaagauuaucagacuacauaaaaugcaaaauucaauccuaucuuaccuacaaggacacucuaaauauaagagcccagaaagagcaaaaguaaaaguaaaagauggaaaaagagacaucauauuaacauuagcuaaaagaaagcuauuauaacuguauuaguagcagauaaaacagacuuuaaggcacuagcauuauuagagauaaugagggacauuucaugaugacaaugaaucaaacuacuaggaagagaccacaauucuaaaucuccauaaaacuaguaacaaaacaaaauauuuauaguaaaaaucacaaaacuaaaaggagaaacagacaaaucuacagucauagagguagacuuuaacacaucucucucaauacuaaagaguauacaaaaaacaaguaagaauacagaggacaugaacaaggcaauuaaaacacuagacuuaacugacauauauaaaucaugcaaucaacaaugacagaauacacauuauuuccaaaugcauauuaaauauauguugaaauuaaccauauacugcaucauaaagcaucaacaaauuucaaaagcucaaaaucuuucagaauauguucucugcacaacagaauucauucgaaaucaacaaauaaaagguuacuaaaaaaccuucaacuguuugaaaguuagacaauagauuuuuuuuuuuuuuuuuuuuuuugagacggagucucacucugucgcccaggcuggagugcaguggugugccgucucuucucacugcaagcuccgccuccgggguuuacaccauucuccugccucagccuccggaguagcugggacuacaggcgccugccaucacgccuggcuaauuuuuuguauuuuuaguagagacgggguuucaccguguuagccaggauagucucgaucuccugaccucgugauccacccgccuuggccucccaaagugcugggauuacaggugugagccaccaugcccagccgacaauagauuucuaaauaaacugaggagucgacagagaaaauuaacaaagucauaacacgagucgacagagaaacucaacaaagucaaacgcugguucuuugaaaaaguugguaaaauuaauaaaugccuagcaaaauaaauggggaaaauggagauuauaauaucaggaaagaaaaaugggaaaucacuacagaucuuucaaacaauaaaaagacauuaagaggauauuaagaaaagucucagcaaaaaaaaaaaaauugacaauauaaaugaaauagguauguuccuugaaaaaccuacugaaacucauaccagaagacacaggaaaucugaauuguucaguauuuauuaaaugaauugauuccguuacuaaaugauuucccacaaagacaauuugcgguucacauugcuucccuggugaauucuuccaaauguuuaagaaagaaauaucagucuuacacaaacuuuucuacagaacaggggaggaaacacacacacacacacacacacacacacacacacaaacacauacuuccuaacuuguuuuauaaagccaaauaaucuuaaugacaaaaccagacaagaacauuauaagaaaggacaaucacauaccaaucucuaccaugaauaaauaugcaaaaaucccaaaauauuaacacccuaaaugcaaaaauaugucaaaaagacaauacaucacaacugauuguuuuuuuauuccagagugguuuaacaugcaaaagucaacauaauucacuaugaaaacaacaaaagagagaaaaaucacguuuacuugaaagacaaaaaaaauuuaauaauacaauaauaagcauccauuuaugauacaaauucucagcaauuuagaaauagaagggaaguaagaaaaaccuacugcaaacauccuauuuaauaauaaaauuuugaacguuuucugcaacacugcauuagugguccuagccagugcaauaagacaaaaaagaaaagccauaaagauugaaaaaggaagaaauaaaauaagcaaaugacaugacugugcacucagaaaaaaaaauuuuaacugcaaaaaaucuguuagaauuaauaaagaaaucugguaagacuguuagauauaagaccaguauuuuaaaaggucaaauuuauaucgauauaccaacaaccacaagaaaaugaaaaguuuucaaugauuucaguuaccauaauauaaaaauauaucaaauaugcaagaauaaauauaauaagagauuuaaaauaucuauauaugcaaaacuacauuauugagaaaaauucuagaauauuuaaacauauaaagaaauagguuauguucauggguugcacguaagucuuaauaucauaaagauggcaguuuucccaaaacugauuuauaguaccagugcaagcuuaauaaaaaucccagaaaaauauuuuaacagaaauugacaaguugauucuaaaauuuaguuuguaaaaggccaagaauagccaagauaaucuugaaaaauaaagcuagauaacuuauauuaccacacaucaagacauaauauaaaguuauagguauuaauuuaguacgauauuagcucaggagagacaaauagacuauuggaaaaaagaaagucuagaaacagaccacaaauuauccagucaccuaagauaaaugugaugcaugaguguaguggagaaaguaugguugauauaguuuggcuguguccccacccaaaucucaucuugaauuguaguucccauaauccccacauaucaugggagggagcagaugggagguaauugaaucauggggauguuuucccccaugcuagucucaugauagugaguaagagcucacgagagcugaugguuuuauaaggggcuucccccuuugcuugguucucauguucucauuuuucucucuccugcuacuuugugaagaaggacauguuuacuuccccuuccaccaugcuuguaaguuuccugaggccuccccagcccugcagaccaaugaaucaauuaaaccucuuuccuucauaaauuacccagucucagguauguccucauagcagcaugagaacagacuaauacaauggucuuuccaauaaaugguacuaggucaguugauuuuccuuaagggaaauauuuaaucuugacuccuguacuucacaucauaaauaaacuacagauggauuguugauauaaauguaaaaauaaaacaauaaagcuuuagaagaaaaaagaauauuuucauuacuuuggaguaggcuggcuucuuaaagacauuacaguaagcauuaaccaugaaggaaauuuaugggccauuuuacaaucagaaauuucuauucaucaaaacauacuacagagugaaaaauaaagccaccaaauggaagacauuugcauuacauguauccaacaaaagauucccauacagaauguacaaagaacugcacaucuaaaaaauaaacaaaaagcagagauuccaguugcuaagugacuugaauugccauuuuaugaaagaaaaucuccaaauggccuacagacuuacggaaaggugcuugacuucauuagacaucaagaaaaugcaaacuaaaaccaccaugugacaccccaacaaacauacaagauuggcuaaaaugaaagaaaaugucaagcauuaguuaggauacagaacaacuggaacuccuacacacaaugcucacuaguaugaguguugguacaacuccuuuugaaaacuuucacaucuacugaagccgaauaucugcaugccauaugacucaucaauuccacuccaagcuaauaucagacagaaaaauguacauaucaucacaaaaauaaauaugaaugaauauuuaguuaguaguagucaaaaaguagaaacaacucagaugacagucagugacagaauggaaauauugugguauauucauccaauggaauaagauacagcaaugaaaaugaacaaacuacagcaacaugcaacaaaauggaugaaccucacaaacauaauguugaacaaaauaagcuaaacacaaaaaggucuauacuguauuauuccauucauuuaaaauauuuaaaaaggcaaaacaaaccaugguguuaaaaaccaggguauuaacuacaagaaagcaaggaggaggucuugauauuugaacaguucuuucucuugacuugggugcuaguuacaacauugugcccuaccacaaaaaugaauugagcugcauaguuaugcuacguauacuuuucuauauggaaaguauaagucaauaaaaauuuauauuaaaagaauaguggcauaguagagcuagaaauaaggcuaaaagcauuaucacaauguccuacauaucucguagugguugacuacagacuugacacuaagauuucuaacagcugcaugagaaaaagauaaaguugucaguuauacauuaguguccaguagauacaaauaaaucaauugcuugaaaauacaaauuguuggcacuaaacacagagauuucucacagaagucuucacaaaaaagaagccccuuuugacauaauaauguccuugacaauaacuucaagacccucugugacugcuucuuaugaugaccuucagugcagacugauggaaucuuuccaauauacaacuggguaaaagcaguuggggauagaagaguguggagcaaugcagucuacauacccaauucucucugaugcuuuggacugacccagggauauauuuuauaaaccuguaagagggaauagaagaguggguaagcuucaaacauucccccuugaauaucaucucucaacugaaauuuugacaauuaucaagcagcaacagcaaaguuaaaauaaauacccccuaguaaaggacugggggauagcuagucucuguugucaauuaauaugaaugcaguuugguugggggaagagaaaaugaccuuuugugaaugcugaaaugucuacucuaggacuagucguugaaaagaggaucauccuaccuccauugugcgcaucuacuaauuagagcaugaagaauccuuagaaauauuuaauaauacugaaccugcuuccaagguauauaacuaauguugaauccaaacucaaacucaaaguucuacuacauauaaaaugacugaaagaguuuuagccaaaaauauuauaaucacuauagccaagguaugaacagucuuaugaggcauacucaagcauauucaaccaaauaguaacaaaaaaaguaaaucacuggauuuaaaguucuuuuuuuuuucuuuuuuuuuugagacaagagucucacucuuucucccaggcuggggugaaguagugaaucucggcucacugcaaccuccgccccaggguucaagugauucuccugucucagccucccgcuggaauuacaggugcccccccccccaccccccaccaccacgccugacuguuuguauuuuuaguagagacgggguuucaccauguuggccaggcuggucucgaacucuugaccucaggugauccaucugccucagccucccaaaguccuaggauuacaggcaugagccaccacacccagccaacaaauuuaaaguucuuuaaaggauuaugcugcaaucuguauaugguuggucugcccccaucaaaugacauguugaaauuugaucuccaaugugaugguguugggagguggggccuagcaggaaguauuuggcuaaucauggggguggauacuucaugaauggcuugguacuuaucacccacuagugagccaguucucacucuagcaaggcuggauuggucucaaggaagaauggaucaguuccuagaagaguagguugauaaaaaaccagaaugcccuuuggguuuggucucucuucacaccugccugcuuccccuuugacucucuccaccauguuuugaugaagcacaaaagcccucaccagaagcucagcagaugccggggccacgguuuuuguacaaccuacagaacuguuagcuaaauaaaccucuuuucuuuauaaacuaccccaccucagguauuccuuuauagcaacacaaaacaggauaagacagauuauacugucauuaauauucaauaacauuucacauaucugcauuucucccaccaaguucaagcauagacuagacaguuuuucugauuaguuagcaccagaauguuaagaaguucagaguucuaaagcucacuaaacuuaacucaggccucugggugcuuuuuaaaaaaaaaaaaauuaaacaccugauaaguuuaguuauauacuuucccaggucacaaccaauuauaaucugcaagucagaaugggaaguacaaagaaaagaacugcuagaaauaaaaagaguuguaagaaauaacaaauaacuugguaggaagaaacagaaggaugcaaaagcucaaagaacuccaaacacauaaucuucuggggccacuuaggcaaaagcucuacaugcugcaagagucuccaagggcaaccacugcacagugggcauauucauagaggcagauucagaguaaagucaucaauaaggauuacauuauucuauguauagucuuugucaagaagguagggaaacguguaaucauuuuuuaaagcaauccauccaaaauauuguaaauauuauguguuguggauuaaacuugugcgcuuaaauaaauuucaguuauacaaauccugcgcuccaaaauaaaugcugaguaaagcacuacaguugaugaaggauuuuaagcuuaacucaaauauuaguuauguauaaaaauauaagcuucucauuccuugacuauaauggaaaaacugaggugcuaauguaauuugaaauaauauucaaguucugaaauaauaucaugaccuauagaaaacuaagacuauucauauguuauuaaaaacacuugaauugugaaaucaucacuugucuccaccgugcuuaucacacuacuccuuauauuccucuuauuagucccuccuagcuacaaaacaggaaaauuaugacuuugcaugggaaguuucucuuaaaaguauugacuuaaaaguuugacaaguguuauucugaaauguuuauaugugcauauuuuaauaauuugcucauaagacauuguuaagccauagaaagagaauuuagauuuuaauacucugccaccaaaaccaaaaucaaaggacuauauaagguuuucuguaaacaaugaagcuuauaaaggacagaaaaaaugacuaauaucugauuaucuauggauaaaaaugcaaguuaaaaaaaucugaagggcguuaacaacuuaauuuucugaaguucuaaacgauagagaauauacagggaaaauacuaguugguucucagagccaaagucaaguguaugaauauuuugaaguugaguguguaagauuuagaguccucaaaugaccuacuaucucuucaccaaaaucugugaaaaauaugaaaaaacaguacuuaucugaugaaauaaggacuaugcaaauguuuuuagucuacaacauguaaauguucacuaaaaaaaacuaaugaauuacauacacauauacaaucacacaugagccaaaauucaauucagcucuuuaucugauuaucuuaccuaucuaaacaacccacuuucaaagcucaaaacuauauauugcacuugaauaaagcuuuaaacauaaagaauuguguacucacauaagaagacuuuaaaccuaaacugagaauacaccuaaauuguuuaagggguaaggaaaaacauuacugugaaaguauaaguggauacacuagaaugauauaugcuggugacuuuuuuuuuuuuugguuuuguaaaugguucaauuuuuuccagaacaucagcagagaauuacaaaaucaaaggcacaguccaaaauauuuuuguuuauagagaaaaaugcacauacguaauuuagcuauuauaaacauuuaucuuaucauuauuacccugcucauauuuggaaaaauucaaaacuaaauauaaacauuuuuugcuuggaggcuauuauuaauuuuaagccuauaauugaagguuaacaaugaucuaguccaauauuauuuuacagacaacaaaaaugaacaaauggaaagguugcauggcuuguaaaagugcacacuaguuaaugauaaagucaaccuagaacccaguuauauuuccaccagaucaacuucuuuccaacuuaaauaucaaaucaucucugauuugagauauaaaaauaaagaggccgggcgcaagguggcucacgccuguaaucccagcacuuugggaggccgaggcgggcggaucacgaggucagcagaucgagaccauccuggcuaauacggugaaaccccgucucuacuaaacaaaacacaaaaaauuagccgggcgugguggcgggcgccuguagucccagcuacucaggaggcugaggcaggagaauggcgugaacccgggaggcggagcuugcagugagccgagaucgcgccacugcucuccagccugggagacagagcgagacuccgucucaaaaauaaauaaauaaaaaauuaaaaaaagaauucauaagagacaugagugaaauacccaggguuuggugacucuggaaaguaaacuagcaauaaaugcauaaauacugcuuuauucauuuuucuuaauuugucauggggauacuuaaaauguacaaauggccuauagugacuuucuuccaaaaaguaaaagucauucagacaaagccuaucauauagaccccauuacuacacauggauaauuuacaugcaccaucaacuauuuggaucugaaaaacagccuuaauauuauccauauaaauaacaauacaaaugaaauccagagcagaaaccacaacuuauuuuagcuauuacacuaaaucuauguguaaacuguaacuaaaguuagcacauauucauuucacaguagaaaauaauaauuauguaaauuacaaucaugaaaauacaacuaauacagagagcuguccccagaaaucagugugacguuccuaaaauuucuuaaagauaauuuaaaauuuaguuuaaauaagguugaaauacaaauccuuuucuuuucaacugucucugauaagggcacacaugaucauuacaugaccuaaagccagccaagacaaaaauggagaagcaaaaggaacaguacccaucacugaaauuauucauucaauaaauauuuuuugaguguuagaugcuauacugagaauuugaaagaaaaaaaaaaaaagacuaagcaaaaagcagauagaaucacugcccuugugaaguuuaacaaaagcugauagagcuuuuauuaaauauguuaccccccaagaagcacuguauauguugaaacuacccuuauuuuuaaagcaauuuuugaugucuguauauuaugguuaagaaaaucagccuugcuuaugguuccauuuaccuacuuuaaagauauuuaccuauauuuuaaaacaccuaacagccuauuugucucaaaaaguuacauccuagacagcacaaacggcaaauuaaacggauaccauauuacuuuaccauuuacaacucaaagugcuguaauaauuacauuauacaaauacagucaaugaagaaggucuucuugcuagauaaacauuuguaauaauucaaguauuuuuuaaaaagucacugugaguuauugcauuuaaguccuggaauaauuaucuguauuccacuuaagaugcuagacacauuuuuacacaagaaaaauaacggaaaaauacagagaaauugcaaaggaagaaaaaguuucaucaucaucugauucuuaagaggaauaucacuaggugaugauuaggagucugauggaggaaaguaauuuuaaaacaacuuaauggcucagagaaguuccuaagaaauugaugcuuaggguuucaauuuuucuuaauacucagauauaagacuuaaagaaaauauaucagcauguuaaaaaccaguuaucucugaauacuaggcuuacuauaaauaguucuuuuuuuuuuuuuuugacgaagucucccccuguggucccggcuggagugcaaugacguuaucucagcucauugcaaccgccucccagguucaaucgauucuccugccucacccucccgaguagcugggauuacaggagcccgccaccacgcccggcuaauuuuuuguauuuuuaguagagacgagguuucacuauguuggccaggcuggucucgaacuccgaccucgugauccgcccgccucagccucccaaagugcuaggauuacagguguaagccaccgcgcccggcccaauaguaauuauucuuuuauuguuucuauauuuuucugaaggaaauacuacauuuacaguuauaaagcauuaaggaaaggcaggccuuaaaauaaaucauugacauaaagacuagguauccuccacagucccacucuuaauaacaacugcagaaccagcacuagcacuguagcugaaaaguggauaguacacacacgcucacauacacaauggcuggcauguaguaggcacucaacuaacgugugaaaugaaauggcugaagauaauguaaacaagccaaaacaacgaaaugcacucugauuugggggcaacacaguaaacaaucacaguaacuaccacuuuauccaaagcucgcugacagcugaaugggcauuaaaugaaagagcucuucuuccuugcccuccucuuucacucugacgcuagauugcacauucaaaacaaauccuccuccagccccgccccaagcucuacccuccaguaccuucagcacuggaacugacacaaaguccagggcugcgacgguguccagacccgggccccuguccaaggagcugcgcgcucacagauuuggcuggcgcaacauaggcgggggcacugggcggcagcccaucaugcccgggacccccaaggacccgcgcggaagcccagagcucucagccccggcgggaggcugguuccccucgcccugcgcugccguaccugcacacggugaucagguuccuccucuccaccgcagcauugcgggcgcucaggcuuuucuugccgccuccgccgccaccgccgcggaucccgcucaggccccccaggcuccgggaggccauggcgggcuuacccccgugccccuuuugucucgugccaccccgcacgccccccacaccugcuuaaggggguucucgcucgguccgcaaccgugggggcgcgggaaggauguaggaaaggagccuggagggaggaaggguguggaagacagcagggacucgcacccggggacugacggcucgcccuuggcacccgagcuccacacacacacacacacacacacacacacacacacacacacgcacgcacgcaccaccuccgcccucggcgcgccgccgacugccgggcugcgccugcgggucggcgucaggcgcucuccuccuucccgagggaccucagcagacggcgcgcgcgcgagcccgucggccccucacgcccaaccacccacacuccgcagccacucgugccccagcccgggaggcagcggcaaggcccccggccucgcgugcgcagccccacccucucugcgccuaucaaaucaacgcuacccccgccggauccaaucgcggcaccagaggggcggggccggccgcgcggaccuuuuaaagcagcgggcucaagccccgccccgacgcgugggcugcugucaaggacgcugggcucgcuuucgcagcccgcuagcugccgccaguagccacacaggcuagccgcggggauugugggaugcggggccccacagcgccaggggccuauugccccccccuugccuguagccaagcuuuaacggcugauaccuauuugcguggcugccguagcuucagugccugccuagaaagcagcgcgccggcucccacacccgaccuugggccuaaguacuaagaagggaggaggguuccuuuuguccugacgcccucccaggggcuaauaaacagcaacacaauggcccgaggggggaauugcucguagaaucuccuucuuggcgcgucuagugccgacauuucuugccccuccacaccaugucgcucccaccucagccuccagcgcagcccgcacccgggacugacggcccgccuaaggaggagcguggugccaguguagagucuuuucgcguccugggccgugacuccggaaucgggaguccgggucugggaauaguaagcccaggaacgacgcggccucgguccagcugggcugcucccucagaguccuggaacgcccuccucgacgcgcguguucggaagcgcccccuuccuagagcuucucacuacccaccguuuuaccugcaggagggucccagcuugggucagguccucugacacucaccuacgccugcuguucaccucccuuugcaccaauaugcccagauuuuagagugcaauccuaaaugacuuacucucccuaugggaccuagcacagugcuguacauagaacagguucucaauaaauguuucucgaauuuaauuugaagucacauuugacauaauuuuuacugaaauuucacggcuucaguggcuccaaaauccauguaucuuucaccucuacuuuugaaguuucugucaaagaaugucagagaauauauaguuuuguguggcuaucucuauuuuucuuauauauuaucccuguuaaugcagggcauacuguuacucuugaauguuuuaacaacgcacguuuguguaauaaaguuguaaauuccuaauuucugagguuuuuaaaguuuaaaaaucucuauuuaaaauagucaaaaaaucauccuuuucagcuaccaugucuaauuuuauucuacuauucuguuuaguagaauaaaaauauaugggcugggcgcgguggcugacgccuguaaucccagcacuuugggaggcugaggcgggcggaucacgaggucaggaguucgagaccagccugaccaacauagugaaaccccaucucuacuaaaaauacaaaaauuagccgggugugguggcacgcgccuguaguggcagcuacucgguaggcugaggcaggagaaucguuugaacccgggaggcggagguugcagugagcggagacugcgccagugcacuccagccugggcgacagagugagacuccaucucucucucucucucucucucugacauauauaugacauauauaugacauauauaugacacauauauaugacacauauauaugacacauauauaugacacauauauaugacacauauauaugacacauauauaugacacauauauaugacacauauauaugacacauauauaugacacauauauaugacacauauauaugacacauauauaugacacauauauaugacacauauauaugacacauauauaugacacauauaugacacauauauaugacacauauauaugacacauauaugacacauauauaugacacauauauaugacacauauaugacacauauauaugacacauauaugacacauacauaugacacauauauaugacacauacauaugacacauauauaugacacauacauaugacacauauauaugacacauauauaugacacauauacgacacauauauaugacacauauacgacacauauauaugacacauauaugacacauauauaugacacauauaugacacauauauaugacauauauaugacacauauauaugacauauauaugacacauauauaugacauauauaugacacauauauaugacaauauauaugacacauauauaugacaauauauaugacacauauauaugacaauauauaugacacauauauaugacaauauauauauauauauauauaugucucagccugggcgacagaaugagacuccaucucucucucucucucucucucuauauauauauauauguacauauacauauauauguacauauauauauauauauuccucucucucuagccauacguauauagugucagucuuaacuaaugugcuaugauaaauauucauucauacauuaaaauuuuaagaaaacaauuuagucagacuuuacacuuuaucuuucaaguuaauaaaagcaggcgaaauuucuauauauggauguuugugacuagucagugcacuucuuccagaacauuacgugucugcucuccugugacacggaggcuuauaaagagucuucuuuuccuaggagcuacaacuuaacuugucucuucuugcuaguucaacaguuuggauucagaaguagccaucaggaaacagaugcacugguuaugcaggcagucucagcaaaauauuugcgcuggcaaugacaaauacuacucaaauugauguuguuauuauuuaaccacagauaaaacugcagaaagaaaagaguggaaaaccaucaguuaucaauaaaauuucuaaaaaccgaugcuugggugugucgugagugagggagagaacacacaugccucugaagcauuuaucaagaagauaaaagugaguggucaugacagaacgagaaaagugagauguuaauauccucaaaauuggcuuccuagccuccaguacauguucauguuauuuucacugugaacuaugacugaaaacuuaguaaaacuccaucuuaaaugaugagguaaucguguuauuuuucuuuuuucuuuuuuuuuuuugagacgcagucucgcucagucgcacaggcuggagugcaguggcaggaucuccgcuuacugcaaguuccgccacccggguucaugccguucuccugccucagccucccgagucgcugggacuacaggcgccugccaccacgcccggcuaauuuuuuuguauuuuuaguagagacgggguuucaccguguuagccaggauggucucgaucuccugaccucgugauccgcccuucucggccucccagagugcugggauuacaggcgugagccgccgcgcccagccauaacguuauuuuucaaauguuacucuuagaaggauuuaguugacauguuaguacuugcuuaccaagacuuugccauaaacaagcuguguuuuucuuuuuuguuuuguuuuguuuugcauguauggagugucauuacacugccacaugggggccuuauuugauaaggcuuuucucauuuauccuaaguaguauguccugggucucuuucucccucuagauuacuaaucuggauauugucaaucaauuuauucaguacacagcauaauacuauuauagaacuccaugaguccacguuacuuuuuggacuucuuuuggcaccuauuucaauuauuuuuauuuauuuaagcauugcacaaagguauucaaagauuuuacaaagagucacaguaaaaauuaugaaaacaguagauaccuaaauuaacuuauaggaauucuguagaaccgaaugggcagaacauacccauucaccguuuucccaacuuccuucuucucaucgaaacagacaaaauuacaagugcaacauauaaaauguccucaaauauaaaauacuauaaaauguauauauaaagugcuauaaaccagagagaucaccaaaccauaguuuauucuagucucagagaaguggacuuuuuaaauaugccauaaacccagcaucuguacagaagaaacuagaaacauugaagauguaaguuuuuuuaauuuuuauuuacuuugacgucagauggguaauaugcugacaucauaacaaggauugggugaggcacgucucacaugugugugaaagcucaaucaucacgcuuaugaaccacaaauggauagauauaaauuuuuucaaauccacaaaucaaguaucaucauaagcaaagucaaaaguaaaugagaccgagaaaacauuuuuaaaacucaaaucauagacaaagagcuaauuuccucuauaaaauacuccugcagaucaauaagcacuguuucaguggcacaaugaaugugaaagccaaauuccagugaguaaaaagucagugggaagugaguaucacacaaucuuaaaaaguuaugaaaggggagaaaaaaagaguggugguaugggggaauauugaacagagggacauugguguuuuauugcuaucaugucauuauuuuucacagaagugacuugagcauauuuugaagcugaugcaaugaaucuacugggagggaaagguuaguaaugcaagagagaaaaaaaaacuaucagaagcgagcaugaagaaaauguaugaaaauugcuuuaaaaaaaaaaaguccaugugagaguaagucaagagaagcagaacacucaggggagguauggguuuccguugagaagaggaagcagaaagaccauuccaaagaauuggagaaugcaagguaguauuggucauagagcaaaaguuccagagagcaucauggaagggagugcagacagggucaugggccaggaagcgcgaagcgugcucauuaauaggguauggauagugagguggguauuacaggcuaugacagacacauaaugaagaguaccuugaugggucucacaaacuguucucuguaaaaagucauuggguaaaggcugauugaaacaaaguggauuugguccuacaguuucuuugaggagggcaaauacugacccucaguucgaacagaggauauuuuucuuuuuaaaauuuuuuaucauguagaagggcauuaacaaaccagaaauuauagacuccagacauuguaugcauugcaucaauuaaucaucagaaccguucucuaaaguaaguauuauuauauucucccauuuacaaacaaggaaacagagacuuggagacauuaaguaacauauagaaagucacauaguaaauggcagagccaggauugaaaucuaaaucauuagcuagaaaaucuauuauuuuuuuaaauuuauuauuuuaaagacagggucuuacucuguggcccaagauggaguacaguggguaaucauggcuuaccucggccuugaacuccugggcucaagggauacucaaagggcuuagccuccuaaguagcugggacuacaggcaugcaccaccacagcugccuaguguuuuuuauuuuuaaaaauguuuuacugagacaaggucucacuauguugcccagauugcucaugaacucccggucucaugcgauccucccuucuuggccccucaaguguggggauuacaggcaugcaccaccaugacuggcccauaauuuauuguuuuuucuaacauguuucacugccuuuuugagaaaguaacuccagauaaggcuuaaacacaaaacucccauacuguacacauaguucuuaagaaucaagaaggauuuuacacacugaccaacuguaucacucaugcaauauagucucuagauaauucuggagcucaggcuuucauuuuuuauucagaaaguguauucugaaucaaaagauaugcauaauuuuaaccacaaauuaaauuuuuuccuagagauguuuuaccaauuuacauccuacuaacaguacauaaguuuucuugcacucuugcucacucuagggacuauuguucuuuuuauuuuucugcauaacaagcaaagagcaauaucuuuuugauauuuuaacuuguuuuucauuaguaaugaaaaugcacauuuauuuugugcacuuauuguucauuuauguuuugcccguucaugcccuuuacccauauuuuccaaaaaauauuagucuucauuauaguggcucaugaucauauuuguuuauuguauguauggcaaauacuuuucccaguucguuguuugccuuaccuauggugugaguuauuuauaaagagauguuuaaaaaauuuuauauaaaugaaauucaucaauauuuuccuuuauugguuuuuccuuugaucauuuuagaauagccuuugccaccuccaagauuauauacuuuaugguuacuuuuuuauaucaaaaauaguuaaccuauuugcacuaugugaagguaugaaauuagaauauaacuucauuguuccaaugauuaaccacugucccaauucuauuuauuaaaugauccaucuuugccuuacugccaauauuaaauuuaucaugaaauaauuaaauaacaagguugcauuuuaauaaagaauugugcccaugauaauaaauccauagaaacagcuaacauuaauguuucacaacaacuuuuuuuggauaggucuccagacauacaaaagagaaauauauacuuaauuuuaccuaaaucaguuuauucuacacacagucaauauauuuucucaccaaucuguuacuauguguuuguauuuguuuaugauuuguuucccauagaaauuuugaauuuuuaugcaaucaaauuuucguuuuuuuaauaauuucugguuuucacacaauguuuagaaaagcuucuguaugguaagauaauaaaaguguuuaccaauuuuucuguaguguuuuugcauucacauauuugauauuuauagaguuaucuuuguguaagagucaauuggugaaagagccuaauuuuuccaaacagucaauacuuaucuaaugcuaguauuaaauaaugcauacuuucccacugauauaaaaugcuaccuuugucagguacuaaauguauacaauuuuagucuacugcuggauuuucuauuuucauccauugauuuaucauuuaugagcuagugguaccaaaaucuaauaaguggcaaagccugguaauuauuuuuaacaucucguaagguuaguguucccuaauuauucucuuucagaauguucuuagguaauucuggaaugucuguucuuccauagaaacguaagaaucauuuugacacaucucucucaccaagaaaagccuauagggauucuaauuagaauugcaugauauuuauagauuagguaaaauuaacaucuucccaauauuugcaaugaucuaagaugacaguaugucuauuucuucacauuuuuuuuuuauuucacuugguggcguuucauaguuuuaucauggaguuucggacugguauuaugaguaagguuuuuuguaugaguaggguucuuuuuuuccacuacacuuccuaaauaguugcaauauuuacacaggaaagcuauacauuuuugcacaaucaccuuuuaacauguauuuauuguuuuuaauaaauuuucagauucuguugguuugauuuuuaugcagucaaauuuuuguauuuuuacuuuuauaauuuuugguuuucacaugaaucuuagaaaagauuuucugugcuuagauuauaaaaguguuuacccauuuuuuguuaugauucuguugguuuucuaggcacuagcucagaaaaauaaagauuaauggugaaguuaguggaacaacacguaaaucucuuuaacauuaagaauuugcuuucaaaacuaaaauacuggaauaccaauuccacgaaguaauuuucuguaaauuaucucaugcaacggauucaaaugcaaacucuuuagaaaaaaaaacccuauugaagauauuuuggcaaagacuaaacaucaauuagaaacgaguuacucgccuguaaucccagcacuuugugaggccgagguggguggaucaugaggucaggaguucgagacgagccugaccaccauggugaaacacugucucuacuaaaaauacaaaaauuagcugggugugguggcacgcgccuguagucccagcuacucaggagggugagcagaagaauuacuugaacccgcaagguggagguugcagugagucaagaucgugccauugcaguccagccugggcaacagagcgagacucugucuaaaaaaaagaaagaaagaaaaaaaaagaaaagaaaaaaaugaguuacucacaaacgucuaaacaggauuuucagcuaugaugucaagaaaaaucuuguuuugauuuuuccuauggauagacuaaaugagacuuuuucucauaaaauaauuuuuaagaaaauguucccucaauaauccacaagcaaucucucaguaauccacaaguaaucuuuaagaggauuaaaagacauuuuaguaccaauuuacuauauccacggcugaauucugcuuaugcaagcuuaaaauauaacaaaaugacaaugauauuaaugaucgccccuugaacuuucaggaucaaaauaugucaaaaugacaauggcauuaaugauuccucuugaaaucucaaggucaguuuauucauauauauauauauauacacacacacacacacacauguguuuguguguguguauauauaaaaauaaguuuacagucaguacgauuucugcuuaguguucaaaaauuggacagcagcaaucuucaacucauaaauuuggccaaguauauuuaccugugucaaccaauaaaccuuaguaagaaaaagaagaauguugugguuaucauucagauauuugucaaguuuacuuuuuuuuuuuuuuuuugagauggaguuuugcucuaucacccaggcuggaguacaguggcacagucuuggcucacugcaaccucugccuccuggguucaagugauucuccugccucagccuccugaguaucugggaauacaagcaugugccaccauacccagcuaauuuuuguauuuuuuguagagacgggguuucggcauguuggccaggcuggucucaaacucaugaccucaagugaucugcccacuuggccucccaaagugcugagauuaugggugugagccacugugcccagccaagcuuacauuucauucauugugguuuauauaauugaccuugauagugagguuaauaucuucucaaauauuuacugacaaauuuggaagccaauguuuagcaguuauauuaguuuucuauuguuguauaacaaauuacacaaacagaugguuuaaaaacacccauuuauuagcugaaaguucuguaggucagaagucuggcacagcacagguggguuuucugcucagggguuccuaaggcugaaaucaagguuucaguuaagcuauguccucaacuggagacucugggaaagaaucuacuuccaagcucauucaaguuguugguagaaucccauuguaguuguaagaguggggucccugauuuccggcuggcuuuugacugaguguugcugugaagcccauugcauauggcuuccuccaucuaucaaauuucaugauucaaauuucugacuucuucuaccccuaacuaaagaauucucucugcuuuuaaagggcucaugugauuagauuucgccuaccuagauaaucucccuaucucaaggucaacugauuaguaaccuuaauuacaucugcaagaucccuuugcuuugcaaaguaauguaaucacaggaguaauaccagggagccaagaucauaaggaccauuuuagaaaucugugaaccacaguggugaaagaaggaacacauucucuacagagauguauauuaagugucuguuaaccuggcauuguccuccccaaccaaaacuauuucuauugauaggcuuauaggaauuuggauacagcuaaauucaaagcgacuauuaaccuccugguagucuccaagacuaucagccuacugguaguccccaaacauuuguuguauuuauuuauucaauaaauauuuuuuaguugcccauuaagugacagacacuaugcuauacuguggguguacaauggugagcaaaaauuccugcucucauagagcuuaagauuuagaugggagagagagguaucaaaaccuaaagaaaucaacauauacauauuuauaccguaugauaaauguuccaaaggagagaagaacauauaaaagaaguuggggcaggacuccaggaggcacuauuccuacagaagauaaugucaacagggcccccggaauuagacaacacucuugcccugcaagggugccagggaaggaaguaaugacugaauucugguaugaaggaagaauaggagugaacuagguaaagcagcucgagguaggagaaacuauccaggcagaggaagaguauguacaaauggccuguggcuggaggaaauacacugugccugaaguuaauguggcuggagcucagagaguaaggaggaucaggagaguauggcuagacagaaggccagagaggaagauaggauuuguuuuauucacaggcucacugaucacauuaaacauuuucaucuuuauccuaagaauguugagaagcccuuggaacaguuugaaaccaaaggcuuacaagaucagaucugaguuuugaaaugcucauucuggcugccauguggagaaugguggagaacauuaaguacaaacugcugccccaaaaugauuucacagcacuccgaaugcaagauuucuuuagcuucccuaaagacuuaggacuacagucuuugugauuggaagcucuaguucuuguuuuaaaacuuuaguaaguuccugauaauagguggcaguaaugugcaaucucauguacugagccuaguuguacucuacagaagaagacaaacaauagucacucugcuccuuuuucaacaaugugcuguguuuugccucagauggaaggacacauguugucauuguuaaauguuuucuaaacuuuaacacagugagguucucagaaaacaucuccuuuauaauauauggggauccuugacauacacauuaccaaaguuuugguuuucugggacuuuguuaucuucuaucaaaaagaaaaguacauuggagaacagauaagaauuuuuuggacaacugacaauguuuaaagggaauaucugaguauaagauugccugguuaugcaugaguucucucuucccuuaagugaaauuuagcaaacagauccaugucuucaaccacuuaaagguauccaagucaacagaucuagauaaucucauuuuacuaauuuugugauucccagauugcaggcucaggaagaacucuaauuucaugggcuacauagaauauauaacccaaaucaacuuguaucccacucccaugagcucaucucuccuccccuugucacacaaacccauucccuacuaggccucaccaauaauuugugcaaguuugcuugcuaucucuuagaugaagagacagaccaauucuagcugcccuuaucauaagggaagagaccaauugguuucuuaucacaagagaagagaccaguuggucucuagaccaauucuagcugcccuuaucacaagggaagagcauauacaaauggcucuuaguuuugcucuucaugaauuauaugaccuugggaaaacuguauaauuucuauguacuuugguuuucugaucucuaagguugggauaauaaugauaguacauaugguaauuucacaggagcugggacaagauaaaugaguaacuaaugaaacucugauauuuaccugguggggagauaccaugaucauaaacgaaacucuuagggcaugauguguagcaagugcugcagaauuguuagcuguuuucauuaguuguccuuccuuaagauauuccagugaauaucaagucugauggcuuggcaagagcuccaugauuuugaccuuaacauuguuucugcuuaaaacaaaacaaaaccaagaaauugugucagcuccagauugcacaaaacauccaucacuucuuaucacauauuuccccuucuucauagucuuauaacaaacgcuuuauagucuuucagguuugacgaaaaagguuucuuggauuaucuucaugcuuuucuuauauauauucacucugcacaagauguccaaugccucacaaugcagaaaucacaacaaacuaacaauagcccagaauacugauauuuaagauaucuuauuauuccgaguaauagacaauaccauuuuggauauaaauaacacucagguacauaauuuuagaagguagaugcuuauuauuuuauaccacuacuauaaaauauaacuuuauguuaaaaucuaccuuaaaguaucuuauacuaggcaauagcuauaaagguauaaauuguaccuucuauuuacuaugaacuuaaguauuagcaaagccacgcaugagcuuguuaugcucuccucaaugcuugcuuucucagucuucugaauaucucaccauccccaucaggaaaaaauauuugguagauuuuuacucucuguaguuuguguucaaaaaucauuuuuuuccaauaggaaaucagauuaaaugcaccuuucaaacuuaaacccuagagauucugauauggcuucuuacccuucuuuuccuuucuccuuugaucacuucuuauuaauaggcuauuuuaacaacuguaucacaaagucuacaaauuauauuaucauggcauguaaggccuuuugcaaucuuguuggugcuacccucaaaauauauccagagucuaagcacuuuucauuauucccacuauuacacuccccugggcucaccuggaucauugaaacagcuucccagcuuccagcuguuucugcccuuggcucccuacagucugauuucaauuuaguagccagagugaugagauuauguuacuucucugcuccaaacucuucaaugguuuucucucucacucagagugacgaaguccucaagauagccuacacauccugcaggaucuaaccauaugucacuucucugacaucaucuccuacugcucuuuuccuuugguuacaccacuccagccacacuggccucuuguuaacucucaguggacuaaacacacagcacaaccuuauuuauccauuaauugaaccaauauugaggaagcccuuacucuguguagaggcuuuuggggauuauagaaguggacaagauagacagagcuccuuccuuugugaauguauaguguagcaggagagauaagaaacaaugcaauaagaauaaaaggcaaggcugggcgcaggggcucacaccuguaauuccaucacuuugggaggccgaggcgggcgggucaggagaucaagaccauccuggcuaacacggugaaaccccgucucuacuaaaaauacaaaaaauuuagcaggacaugguggcgggcaccucuaguccagcuacucgggaggcugaggcaggagaauggcaugaaccugggaggcagagcuugcagugagcugagauggugccaccgcacuccagccugggcagcagagcaugacuccguuccccggccccccccaccaaaaaaaaacaccuacacacacaaaaacaaacaaacaaacaaaaagaauaaaaggcaaaaccauuaguaauuauuauaaguaccuaaacaugcuauuaaacuggauauuagcaggagagacaggaaacaauguaacaagaauaaaagccaaagccaauaguaauucuaaauaucuaaacaggcugucuauuaacacaucucaguuugcuuuauuuuagaucgcaacacucuuguuacacaagauucaucuugaaaaauaucuuuauuuaaucugaugcuuugugaugcaaggucaugaacugaaaugccauaaacuagaagaugcuguaaucuaucacacauaaauauuagucaagcuuguuucuuucccuuucuuucucuuucuuucauucuuucucucuuucuuucucuuucucucuuucuucuuucuuucuuucccuuuuucuuucuuuucugagauagagucuugcucuguugcucaggcuguagugcaguggcaugauugcucacuguaaccucaaauuucugggcuuaaguaaucuuccugccucagcaucccuaguagcuaagaauacaggugcaugccaccacaucuggcuaauuuguuaauuuuucuuuagagacagggucucacuauguugcccaggcuugucuugaacuccuggccucaagcaaucuuccugcuuuggccucucaaagcacugggauuacaggcaugagauucuucacucaucauauuauaauuauuuugguuuauaguagagaacuaacuucauaaaguaaaaaaaaaaauacaauauuuagaauuguuuguccaaaaauagaggauauuaaauauuaucauaaaacuaaaggauaauuuaacacaaaccaaguuugucuagauuaauaaauaagaauaaacuuuccaaaacugguaauuucuuuuuauagauccauuuuugacuaaaggaacauagguuuuauggcuaagggaaguauuuuaaaaauaaucucaacuuuuauuuuagauacagaagguauaugugcagguuuguuacauggguauauuguauaaugcugagguuaagguuaugaaagaucccauggcccagguagugagcauaguucccaauagaucaacucuugcuccccucccucucucccucuuuaguagacuccaguaucuauuguugacaucuuuaugucugaguacccaauauuuggcucccauuuguaaaugaaagcaugugguacuuaguuuucuguuucuguguuaauucacuuaggauaauggccuuguugcagcaaaagacaugauuuuguucuuuuuuuauggcucuguaguauuccauggcguauaugugucacauuuucuuuauucaguccaccauugaugggcaucuugguuaauccuaugucuuuguuauugugaauagcacugcaaugaacauauaagcacauaugucuuuuugguagaacaauuuauucuccuuuggguauauaccugguaaugggauugcugggccaauugguaguucucuuuuaaauuuugagaaaucgaaaguccuugccagagcaaucaggcaaaaaaaaaaaaaaaaaaaaaaaagaaauaaaggacauucaaauuggaaaagaggaagccaaauuaucucaucaaugauauggucuuaugccuagaaaacccuaaagccuccuccaaaauacuucuacaucugauaaauaaguuuaguaaagucucagguuacaaaaucaauguacauaaaucaguagcacugcuaugcaccaaugaccaagcugagaaucaaaucaagaacccaaucccccuuacaauagauuaaaaaaaaaaaaaaaacccaccaaaaccuaggaauauucuuaaccaaggaggugaaagaucucuaaaggaacaacuaugaaacacugcagaaagaaaucauagauggcacaaacaaauggaaauacaucccaugcucacagauuagaaaaaucaauacugugaaaaugaccacacugcccaaaguaaucuaaaaguucagugcaauuccuaucaaaauaccaacaucacuuuucacagaauuagaaaaaacgauccuaaaauuuauaugaaaccaaaaaggaacacaaauagccaaagcaauccuaaguaaaaagaacaaaucuggaagcaucacauuacacaacuucaaauuauacuauacgauuauaguaaccaaaacagcaugguacugguauaaaaguagauauauagaccaauagaacagaauagagaccccagaaauaaagccaaauacuuacagccaacugaucuuugacaaagcacacaaaaucaugauuggggaaaggacacccuauucaauaaacggugcugagaaaauuggauagucacauguacaagaaugaaacuggaucccuaucucucaucacauauaaaaauuaacucaacauggauuaaauacuuaugucuaggaccugaaaccauaaaaauucuagaaggaaaccuaggaaaaacucuucuggacauuggccugggcaaagaauuuaugacuaagacccuaaaagcaaauucaacuaaaaugaaaauaaauaaauuguaccuaauuaaacuaaaaagcuucugcacagcaaaagaaacaaucaucagaauaaacagacaaccuacagaaugggagaaaauauuuguaaauuaugcauucaacaaaggacuaauauccagaaucuauaaggagcucagacaaaucaguccugccacucacuuugcaacucauugaaucuuaguucccucuucuuuaaaaugaagauaaucauaauacuaccugugccaagauucagugggaaaaccugacuuuagagcucaauaaaaauuaguuguuuuauuuucucuccucaaguguauuagaagcuccuuuaaggucaauaauuaaauuuaucucuauaucuagcaugcucagugcaauugcucuauaaauauuuguuaaauuuaguuguuauaaaauucuuagaacuggagugcagaagccaucugcagcaugcuaugaaaaucuaaaauaaaauaauguaauaaaaaacaauuccuuugagaaacuucauacccugauuauuuuauuugcaacagaugcauaaaacuaaaacucaaaucugcauaaaucaaguaguucagacuugcuguaagcauuuaaaaauauauuuuuaaaauacaugcuauuuucuagcaaagacauguaaucaaccuaggugcuuauuaacaguggauuggauaaagaaaaugugguacaucuacaccacagaauucuacacagcccuaaaaaaaaaaaaaucauguccuuugcagcaauguggaugcagcuggaggccauuauccuaagcaaauuaaugcagaaaaagaaaaucaaauaucacauguucuuauuuguaaguuggagcuaaacccugggucuucauagacauaaagaugaaaacaguagagacuuggaaccuaaaaaggagggaagaagggaggagagcaagggcugaaaaacauccuaaugggcacucugggugauaggaucaauagaagcccaaaccucagcauuaugcaauauaaagccuagaaaagcuccaaggagcugacagaagacugguguggauggaucaugaaggaauaaggggagaaguggccugaggcuauagagguaagcagaagacagauuauugaggaccuuuggaauagaaccugagaacagugggaagcccuugcaggccuuacccauggauaugauaugguccuauguagauuuuacaaauacuuuggcuguuacgaagggaguuaauuagaagaagaccagaguaaauguggagaaacuaguuaaaguagcccaaguaagagaaaauggaugguggauauagugguuuggacaguuauugucauuguugagaagacgcuggauucaaauuggauauagagaguaagggaaaaggggaugcuagcaauaaccucuccccuuccuccagguuucugacgcaaaguaaauagugguguuauguacuuagauaugcaugcugaaugagaagccaaugugggggcaggauuaagaguucugucugggcaguucucaaauaugagaugcauagagccacccaaguggcaauuucugcaacauaauuuuuauaauuauuugucuuaaacaguaacaaagaugauggagaauaaggaaaacuugacuauaguagaguaagaagguuugccuuugccacaugaugcaaugguaacaaggauaaacccagccugcaugacuacuuugguuguaaugcauagcauucgaguaaaacaaaaagaacaggccagaugcaguggcugacuccuguaaucucagcauuuugggagccugaagcaggaugaacacuugaaagaggauugccagaaugucaagaccagccugggcuacacaggcagacucuaucucugaaaaaaaaaaaaaaaaaaaaaaaaaaggccaggugugguaguauguagucccagcuacucuggaggccaagaugggaggaucacuuaagcucaacaguuggaggcugcagagagcaaugacugcaccauugcaauacagcccgggugaccaagcaagacccuggcugagaaaaaaaaaaaaaaaaaaaaagaaagaaaaagcuaguucguacauaagaacacugcaguaugacuuguugccaauuagaagaaacacaacuacaaggucagggcauauuauucaaacaguagagacaauacagucaaauauuuggcagaauuacaaaauaucucauuggaaaagacacgcaagggaaaucaacaaaaagauaugaaucagaauucaucugugucucaagaaaaggucaugcgauaaauuaaguucugcuaguguuucuacacuaccguuagccucauuaccuuauuuuuuaaguguuaauauaguuuuagguauuuuacauacauuuuuauuauuaauuacaaccaaagugcaacuuguaauagcaauuccuucacauuuuuuuuuucaaaucuugcaccuuaaaauccaccucgggccucaguuggccagcuuugguaucugauacuuggacuacagauaccacuaaggcaaguagauaaaauguacucuaggaccuacagcccuucugcuagauccugaagaaugaucauuaaaacaagcuggucuagcuggucaagagcaaaaauaaaaucaagaugacagaaaauugaugcaaaagugaaguaaaauagcuagagaauaugauugcgccuguccccuuagcauggauucccaugcuagccaaucuaaaauccucacuguuagaauccuccugucaauaugauagaaugaacagcaagcucagugucagaaaaccuguguuguuaacuuggcccucuuucuagcugaauguguguuuuuggucaaguucuuuggcauuucagagacucagaguagugaaggaaguggauaagaugaccucuacauucucuugcaagcucaaacaucuaugaauccagagagaaaaacuagagcaugaaauuaagguuauuuuaaagaaauaaccuuaaaauuauuaguauucgaggaucuccaauauauucauggcaccacucaaaacuuuccuucugcucuaucccgucuuggcucaaaguuaucuccuuaaugaggucugcccugacuauccuacuuaaaauuguaaacuuugcccaccugguacuuccacucucuuuccccugcucuguuuuucaccguaauacuuuacucuuuuuaacauacaaaaucacuuauuuacuguguuguuaucuaucugccuacucuuaccaucaaauauaaguucuaccuaggcagggauuuuuguauguuuugcucauggauauauacgaagcacuuagaguaauaugugacauauacaggguacuugauuaauacuguugagugaaugaaugaguuuccaauacaaauuuaaaauaaaauauuuccuaacuuaaaauuguaaagucagaucuaaccaacuguucauuggucugcuagcaguguuucuuguauauggaaauauauuuuaaauagauauguccugugaaauaauacuaaguguucuaaagaaauaagugagugaacguuaccucauugaacuaacuugaccuugcuccugggagagaguucauuugagauuaaacaaguucaaagucuaugaaucauaaaacgauaaaaaaaacuaaaagggaaaugguguuuuuauaagcucugcaauucaaaagccauuucggguaauauuguuauuuuuaugucaggaauuccucagugcugauaucuuagggcaaaggguuugguuauaaauuaagagaaugaggaaauagguacauaguaggauuguuccaaccaaauauguguugaaugucaaaggaauuucccugaggaauaaucuucagaauaauuugcuaagcacaggagaaaauuuggcuuauuacuuuauagccagauuucauuuuuaauugaaacuucuuucaagcaaaucacuuacuagucuauuaacaauaacaacauaaacacaaguaaacauucggaauauagacauccagguacuaagcugauugcuuuacacucacugucuuauuuuacaaguaaggaguuuuaguugcagcaaaagaaauaaauuuuccaaugucaaaugaccagaacuuaaacccaaucuguuuggugcuaaagccaauguucuuuacugcaauguuggguuaucuuguuucuaaaacuuaaauuuaucaguaaaaggcaaaauuugcuauuauugaggacauuaaaaucauauuuuuguagacucugaggacaaauccaacaaaaaaguuccaacuauuucuuggcaggcaucauugaaauugguauauagcuuccuuggguauugacuuugaaaaggaaguuggucacuuuagauauauaaguucagucuguuuguaaaaacaaaaugaaaacaaaacaguugccuuauaugcuaaaauuauccuaaucguuuucaccuuuaacaacauauacacacagaacuugaggaacuuuacacggcucaucuucauauugucagcaucuagcaaaguacuugccacauagugaucaauaaaaguuuuagccagccugggcaacauagugacagccuaucucuacaaaaaaaaauuagccaggcaagguggcgcacaccuuuggucccagcuacuugagaggaggauguggggagauccuuugaaugcaggagguugaggcugcagugagcugugauugcgccacugugcuucaaccuuggugacagagcaagacccugucucacacacacacaaauuaaguaaagaaaaaaaaaagaaucaaagaaaaaaauaauuccccagcuuaaguccaucuuuauuuguuuggauaagcuauaaagugucaaauaaugcuguuaauggacauuucucuagcucucccaaaggaggaauugagcacauaguaugugcuguauuuuauauacagaauaaaaauagagacaagauuucuacccucacagaacuuaaauucuucaggagaaugacacugaaguccuuaauuggacuucucucuucuguauuaucuuccucaaguggagguauauggugcuuaguuaugaaaaauaccuccagggcuuugaucuucucaauaacucuuugaggcugauaugaaaacaguaauuagaaaaaaaccauguauccaacuuauauagacaguugaugaccaaagcuagaauccaguuauuucagccucccauguauuuucuuauuacuuaaggagaaucucuaucucuaccucuuucucucuucuuccucucucacuuuucuuagaaacauggguaagauuuucagaaauaugagaaacuuauuaauaaaugaaaaauacugggaauucucaauguuucuuguuuuagccaguuaauuuuggccuucauucaaugugagugucccuuaauaaggagcaaacuccacugagagauagauacuaauaaccaggauucugaaaaugcauucucauccccaucuccaaacuuuuauaaaaaauauuauaaaauaauacacuuuuaauauaggaaauuucucaaauacagaaaaaauuaaaguaaacucagaccuaacuuucaucacuaaaagauaaucacucuugacacuuugauaucuuuaucucuaauauuacaccaauuaauuugcuugauauagugaauauuaugcuauuauaauuuuccccugccuuuuguccuugcauauuagcauagguauuuucugagguuaucacaaacucuguaagcacguuuuauauuacuacuuuuuuaaagaggauguauaauaauuaauucauccauauauaugugguuaaguauucaggucacugcucauuuuucacuguuauaaaauaaagcagcaaugaauaccuuuggcugauauuuuuuucuguacuuggaauuauuucuuuaagauagauuuccuaaaauugaauuacugagucaaacagacuuaaguuuuccuuauguauguuuccuuauucauuugaauaauuuucaacuccuacuuguuuauuuaacucuugugagcaugugauagucucauuuuucaaaauaucuuugcuguuguaauuugcauuucuuuguaguuagcaugaauauuucaguauguuuucuucuguguaccaguauacuacauacuuuuuuauaugaauugccuauuugcaucuuuugcucgguucuauuagaccuuugaauuuuuucuuauccauuuauauaagcucuuuauauauuaagaauauuaaccuauugugauauuugcaauaaauagcuauaugguuuguuguugguuuuaaaugugaauuuauucaauuuucuucauaauuuuguuguuuuuauagauuucuuuaaaaguaauaaaauuauugccauauuauuauuuauuuucaauguccauuacuagcccuuuccagucaucacuuuuacucucauguucuuaauuuuuauucauaucuuggcuccauugaccaucuuuauuaggauauuugggaaauaauacaauuuauacuaaacacacaucaaaucuuaccuuauuuucuucuuacaaaaacccuaggaauaugcuguuuuugucuuuauuugaaugacacagaaaucaagguuuuugagcaguggaguauuucuucaaaugacacagaaaucaagucuuuugagcaguggaguauuucuucaaagccacacagcuaguaagucaugaagcuggaauuccaagaguugccacuucauuuucuucuuucccuuuaucuuacucaguugucuucucuccucuuaauuuugucauucauuuaaaaacauuucuugugcuauuaugguagauuuauuuuaauagggggcagugacuuacucagagagaugauucucuaauggaguuuuaaagaucuuagaaguugauagaggaggcugggcgugguggcucaugccuauaaucccagcacuuugggaggcugagguggguggaucacuugaggccagaaguucaagaucagccuagucaauguggugaaaccccauuucuacuaaaauuacaaaaauuagccuggugugcuggugcacucccauaaucccagcuacucaggaggcugaggcaugagaauugcuggaacccaggaggcggagguugcagugcgccuggauuauuaacacuacacuccagccugggagacagaguaauacuccaucucaauaaaaagaaguugauaagggagauaguucauggcaacggaucuuugaaggcacgcuaaugauaacuuaggcauuuagccuacuaguguaauuuccauaaaucugccucugaugucauacucucagcaccuaauauuuucuacaaacauuuauugaaacuuuauuuuguauaagucucuguccaguuugaauauuuaaaaaauucauaaucauaugaaacauuaauaauaaauacaaaaugagagaugccgauacugaaaaguaggauugcggagugguagaaaauauuucuggcuguaguagauggggaaguguucaaagaggaguauaauucagguuuccauuugccaucgacuuaucacauggcuaacucacuaagcgacuuaauuaaaauuaaauuaauuuaucaucaucugaucaccauuucacacaacucaugucuguugcuguauuggcuaaaugauggcaagacaaacgaccucugaaaaugauccuauugaccuucggaaucuggauuuuuuuuucaaugcagguguccauagaagcaaucugauguaauccaacaugaguucaagcacagucauuuaauauccccuaucaaguacagucauuuaauauccccuaucaucacauguccuucauacauaaaaaucauuacaugugaaaggguggagaguguguggaucccuuauuauuguguuauuguaacacaauaacaauauuguguuauuauuguuaacacaagugagucauaugucuugcucuuuggacugaguggaaacuuguauucuuucucugccucaggucaauuaacuucauugaggugaguugcauuccuucuuuaagcauguugaaccuucaaucuggacucagaugggcuaaauagaggagcuaggaaaaauacagaaaauaaauuauuagagagaucagagaaagauacauaagauuuacaauaaaagaauuaugagaaaaacauccaaaagaauuaaaaaccauaggagaaggaaaaauaggugaacagcuuuuuaauuucuauaaauguguuguuaauacucauaauaaaggacucagagcugggauaugagaauaauaggucaaacguauauggauacauagaugugacuacauacaugaguugcaaagaaugcuaaggagggcaaaaagagauugagaagagggcauuauuacuaauauauagcaauguugaauguuuaggguguuucaggcacuguacaaaucuuuuaaauacacaaaucacuuaaucuugccauaacauuagaagauacuaucuacucuuuaccaaaaagguaacugugggauagcagaguuaaguaacccguucaaaccuaugcauaauaaucagcagagaugguccuuaucuaaguuuuucugccuuugaaguccaaauaguuuaaugcagccagguacuaaagaagaaaacuuuuguaaauuaguuuaguuuaaugauuuacauguggaaaagcacagagugaaaagcacauaucaucugagaagcccagugaguuuggcugaaauggagugaacauguacauguugagggugaggaagaugauuagagagaagugauguguugugguucuuaaaagcuaagaggaaacuguuagauaugauauagucuguggcagggagccauugcagguuuuccaagauggacucauaaggagaaaacacuucgugggacuggaaaaggcagugaagugguguguccuaugauaauguacuacaguguaggauagugguuaagaguacaguuaugagagagggacuacugguuagcaccuuaccugcugugugacugggcaaauaaugcaaaccucagugucuuuuauuguaauaugggaguaacaaaaauaguaacuacuucauaggauucuuguaaagauuaaaugacuuaauuucuuugaagugcuuggcaguuccugauaaaugaccaguaguuaauaaauguuaguuguuauuauuaucauuauauauuauuacucccauagauacauauagaacagacugcagcagagaggcaaaucuuuaauguugucagaguauagacaaguuggugaaauggcuacaugagagcggaggacaagaaggugcagauuguggcagucacuucaaauggaaauaucaccgcuugaaugaagguauaugagugucaacuugcaaggggaccagguagguuucaucagaaauuaaggaagcuuaaggagaacagccaaguucagcuugacagaaguggugguggcacaaaugcaagacuggugucuuucaagaaaccaaggacuguugaaaguagcaagagcuaguuuguuuuagguccaucauguuuuauauucacacuuucaugucaguggagcaaagaaauggaauacaauauaauagaaugguagaaucuuauuuuuaaaaucuguguuauucugaucuuuaacuuacuuauaucuuugauagagaucuuuaccugaugcucaagauuguagaaauaguauaaucaacauaacaguauagcacuguauuuauauccugcacuguuuagggaggguuuaaggccauucaaaaggauacauaaaauacaacaagauuacauaaaugaaaggugagauaaagcaacaaagcaaaacaaaagugaaaacagagaucauaggcacaaauaagauuaaaaacgcauguaaugaagaugaaagcuuuuacauuuaccccagauggaccacaggguuguuguuaagccuuuaaacagugaacaaugcuguacacuugcauaugcaauuagaacauguggaaaaaauaguggccuguuagaagccuaauuaacaauuugugaaaaaaaaaaaaaaaaaaaaaaaaagaggccgagcuguagcucacgccuguaaucccugcacuuugggaggccgaggcgggcggaucacgaggucaggagaucaagaccauccuggcuaacacagugaaacccagucucuacgaaaaauacaaaaaauuagccgggcgugguggcgggagccuguagucccagcuaccugggaggcugaggcaggagaauggugugaacccgggaggcggagcuugcagugagccgagauccugccacugcacuccagccugggcgacaaagcaagacuccgucucaaaaaagaaaaaagaaagaaaaacaaaagaaaacuucauuguauuguaaggccaagaacaaaauauaucaagauaaggaaaauuuguagucaagaauagaaaaaaauuauggcuuugaaguaugaguuauuuaaagaaaguggaaacauccucagacuaugcaguaaaaaacaaagugauuuucuucuucuaaacuuaugcaauaaacugauagguaauaugugaaagucauagaauguagacuagaggauacaacaaaccuauuuccucuauguucauaagaaguaagaaaagcucugaugugaguuagcauugcuuuacaauuuugaauugugcagauugcacguacuuuuccucaguuugaaguaaauaguggacaggaaaaaauauuaaauguuggcaguaaauauggaaggaaauuacaacuaauguaauaugcuaaaacaugcuauguuuauuuuacuaauuugaauuaaaauguaagaauuuaaaaugcccuggaaaaacacgggcauugaucugacgucugaaguuuuaaaauauuacacacuuugaaauagcauuuguaccuugaaauaccugucucuauauauuuuuuaaaacuuccuuuuucuuucauuccauuuaucaucaaauaaaggaugaacagauguaacucagaaacugucaagcaugcugaagaaagaccacugcagaaaaauuucuccuagccuuuucaaagguguuaggaagcagaaaggugauacagaauuggagaggucggaguuuuuguauuaacuguauuaaaugcgaaucccgagaaaauuucccuuaacuacguccuguaguuauauggauaugaagacuuaugugaacuuugaaagacgugucuacauaaguugaaauguccccaaugauucagcugaugcgcguuucucuacuugcccuuucuagagaggugcaacggaagccagaacauuccuccuggaaauucaaccuguuucgcaguuucucgaggaaucagcauucagucaauccgggccgggagcagucaucuguggugaggcugauuggcugggcaggaacagcgccggggcgugggcugagcacagccgcuucgcucucuuugccacaggaagccugagcucauucgaguagcggcucuuccaagcucaaagaagcagaggccgcuguucguuuccuuuaggucuuuccacuaaagucggaguaucuucuuccaaaauuucacgucuugguggccguuccaaggagcgcgagguaggggcacgcaaagcugggagcuacuaugggacaguucccaagugucaggcuuucagauuuccugaacuuggucuucacgggagaagggcuucuugaggcguggauagugugaaguccucuggcaaguccauggggaccaagugggguuagaucuagacucaggagcuccuggagcagcgcccaaaccguaguggcacuggaccauguugcccggagcgcgcacagcccgcgcggugcggggaccugcucucugagcccgcgggcggugggugggaggaagcaucguccgcggcgacuggaaccgggagggagaaucgcacuggcggcgggcaaaguccagaacgcgcugccagacccccaacucugccuucguggagaugcuggagaccccgcgcacaggaaagccccugcagugcccaucgcggccagagcagcuggggcaucaacggcgggcgcucccucuuacugcucucuggcuucgacgggggacuagagguuagucucaccuccagcgcgccugaggcucaugcauuuggcuaaugagcugcgguuucucuucaggucggaauggaucuugaaggggaccgcaauggaggagcaaagaagaagaacuuuuuuaaacugaacaauaaaagguaacuagcuuguuucauuuucauaguuuacauaguugcgagauuugaguaauuuauuucuagccuccagcucugaaauaaaugacauguuguuguuuuuaauuauuuuuaagaaacgcaagcuagccuuuggaaucaauaucccugcuuagagcagaaguuuguuggcugaguggagcacagcauaugcauuuucccugucuuuuuuguucuuucuuuuaaugauacauaauauuuuacauauuuaugaaaugggguacauggaagcguuuuuuacaugcccggaauguguaaugaucaaguccggguauuugaaggauacaucaccuuagguauauuucauuucuauguguugauaacauuuuaagucuucuagcuacuuugaaauauacaauauauugcuaacuguagucacccucgucugcuaucgaacauuggaacuuauuuguccuauccaaccguucuuagucauucaccaaccucuuuucauuucaccuuuuuacccuucccggccucuuucccuuagucuuggugugccucuuucucagcuuuccugccccagacaggcggaugcucauauguguuucugucuuaugaacuucugcuuuucaagugguguuggucgcccacacgugagccauaugcugcuggugaucugcucugugguccaggcucuugcuuccgguaaauggcuauguaaacaucgcguuuguggccuggcugaugagacagaaggucaaaaguacauuuagguuguuaacuggcaauaaauaucuguauauaauauugguaauguaaucauauagggaaaauaauuauuuaaaguaaauuuugaucauggugcucugccuuuauagaauauuuaaaacuucacuaaauagauucauuguuaguaguaaauuguaaaauagacuaguaaguuuaauaauauuagaaacuguaauguaaauuauaagauaaauuaguaaacacauuaauauuauaagaaaccaagcuuuucaguguaagagaaaaaauacaaauguggaaaucaaauacauuuuuaaaaauaauguuaaguuugaauuagaaauuucaauaugaauucauaaucuuuuaauaguucauuuucaguccacugaaagggacaguaacaaugagcacuguuaguaccagaucuggguuucuaaauaccauuccucccuaaaagaaaugaaccccucaguagcuaauuucagccaggucugggacaggaaaaauagaaagugagccuggaguaucuugugguaccugaaaauaaggaaguggaguuuaauggaguagucgaaagcacacugaagcugucuggaagaugcuuccaauggccaacucugggacaauuugagcaucaaagaacaucguaacuguaacugauuuugagauacugaaugcuacugcugaaugcuuaauauucugagagaagggaaacugaaagaaagugugagagguagagaaaauaaagcaaugaucuuuagagaaaaauuccagcuaucauuuuggaacuuccauuguuauaauagauucaggcaaggauugucaaugaacucuaaacuaucagaaaaauguuguaucuaagaauuuucuucagaauguuuacuaauuggaaggagaauaugcuucuccaauuaaagauuuugcaguuagcaccuuaaccgagugaucagaccugguaucucucacgguagaauggacuguaguaaaugacucaucacuuggauuuugaguaaacaacaucaccuagcaaauauuaauauaucugcaaaaacauuuagucuguauacaauuaaacuuguagacuggggcuguccaauggauauaucaugugagccacauuuguaauuuaaaauuuucuaguagcaacaguaaaaaaugaaaauaaaaagauaaaguaauuuuguaaauauauuuuauagaacucaauauguccaaaagauuggauuuucuacauguaaucaaaaugauuaauaagauaguuuacauucucuuuuaugcuaaaucuccuguuugauguguauuuuacauuuauugcaccucccauuuguauucaguuugauacagguauacccaagaugugggacauucuguaagacagcuguucuuguuccuuuacaaaagucaauguuaaaaaaauaaaaggaggacuucuagauuaauagagacuaaagagauauaacuaccaaacguagugugugaacauuacaaaacaaaacaaaaacaaucuaaaaguucaacaaggaaaaaauccuauggaaaacauucuugggagauuugaaugugcauuagauauuagccaauaucagaauuguaaucacuuuucuuagaugugauaaugguaggagaacauguaauugcaauugaaaauuuuuguaacaaaaauguucauauaaaccaugaaaaagacuccauagaguggaggguagguauuccacuuuuuguuuuuaacuuuguauuuuugaaaacuugauagcuuaaagaauuauguacuuaugauacaaacauuuagguagauuuaacuaagaaauauugaggguaugugaagagaaacaguaaagaaaauuguaugaucuuucacauauuucuauuauugguucuaucauggccuauagacuuuuuuuuucaaauuagagauuauauuuuaaaguaguucuuauuaaauuguguucauugccauugauuuaaaucuauuuuaacaugggauuguaaagaagcauauggcuuugguaauagauaaugcugggauaauaguccuauuuggaauaugacuauuagcaaagauucuuuauuaaaaugauguuugaugaaugacuugucuuucuaagcacuguuuuuugugcuaauggggauaaguaaguuaucuaguaggggugagaguuugugugaaagugcauuuuaaugugaugcgaugcaguaucucagaaaucugagguugcaccuuauaguuugguggucagggaacagacuuggcauuuaaauauuggcuuaguuauagcugugaaccuuggacaaguuaacucuucucacucuucuacgucucuaaaagaacaaaaaugugucuuccucauagaauuguuuaugaauugugugugggaagugcuuacuuagccagugccuggaacauuauaacuucuccagaguagcagcuguuuuagagaacaaaaaaauaaauaaaaggcuuagagcuaaaacucaacuauuuauggcuauuuuucuccuuucauccugguuccagggauacugaaaccaugccuuuacugggaauugggugggaccaaaccugaagaguuguguuuguguauuuuaugucugucuaacauuacuccaaagccaaauggguaaacucuggauuuuuuucuuuagaagucuccucaccucuuuugaccucacuuaguguaaagaacaaagacaaagaugaauuuaccuuaugaacuuaaaaaccguguaaaaaauaacacaaaucuuuucuaaaauaguuuuucuuuuauaccuacaaaaauacagaugaggcagauuuguuacgguugguuugcuuucacauccuagguagcaguuacacagaguagaaaaugggcuacagaguuagauucauuuguaucugggcucaaaauaauaguugaccuuaugccugaggagaacuuuuugacaauuuauagaacaucauuucugaccauagcuuucuagcgugcauuuauuucauaaugguccauuuaggacuccagacauuuuuuucacaauuagauuugcuuauaaggaguaauuuaauuuucuucugaggcuaguuaugcccagcaucuaauugccacuucucuucacuagaaagggaaggauuaagaauaauaucuggguaguggauggauaaaaugucuacugccaucauuaaucaaaugacaauuaaggggauucauaauuaaggggaagcaugaaugauuuucuaauuagaauaaaaacagggaacucuuuucaguauguauauuuuucuaauugcaaaggguguauguauguauucaucauagcaaaucaggaaauaucaaaggcacaaggaagaaaauauuuuuagagagauuccagcacucagugauaaccacguauguagauuucuaagauauauguaaacauauuuaaacauuauaaauggggucauacuauuaucauccuguuuuuuaacuguauaauauagacauauuucuucuuccuauuagucauuaaauauacauucuauguuaauuuggguaauuuaaaaaauauguacuuuuuaaaguuuuauguaauuccauugcuguuuugcagugaaaaagauaagaaggaaaagaaaccaacugucaguguauuuucaauggugaguuuugaauuuauuaacuauucaaaauacuucggaaauuugacaucuccuuacauggaaaagagauauuucaucugauguaagauuuucguauaggguauguuaauggagaugcaaaauaaauugguuugauuuagcuuauuuucaggagaaugcugaucauaacuugcuaucuauauuacuaaucuacagccaccauuccugacuuagauuucaauucuucuaaugaauuauguugccagugauccauuaccuacacaagcaccucucccaucugcauagaggaaaccaaucacauagaaugcugucuuuaauggcucugaaauuuggcagguuuuuuaggucaaagucaguugcuaucaauaaaaguuagcaauggauuauuuauuacuaugcaaauuuuaggucauuuagguuaguccauugcaaauuuuaguucaaaauccauuacuaacaauaaaagguagcaauggauuauuuauuacuaugauuucaaauaugucauaugccauuauuccccuguguuaaacagaugaaaaucuagaauucgaaaaccuuauuguaacucuuuauuucauuuucugguugcacagugguuuuuuuagaagcuuuucuuuaaucacacuuggaaucagacauguaucauauaugugugguugguugaugaccucagugcugugaucuuggcucacugcaaccucugccuaguuaaugaccucuuauuuaccuggauucuuacuuccuuuuuucuaagaguacaaauuuaggugaacuguuaggugaaagauuccagagauuagaaccuggaagacuacuaaaccaauuaaguccaacagcacaugcuuuauaauucagucauaacacagcaauuuuuuuaagguaagggaguggauagauugucuugcaaaauggauuuuaauaaauugacuauaaaaauaguuguagguagggaaaaaacagucaugugacuuuuacacugaggacucuaugguucccuuaugugaucuucguuucucugugcuaccauugcucuugccaugacuccugcuuuuauucuaucucuacgcccuuuggaauuuuggugagaugagacuauguacuugagucauucuuaggcuacuugaguaaccaagugacaguuuucauuguuacuuucuuguauggaaagaagcguuuagguuaaaguuguauuuauccccaggauuucagugcugucacuuugagacuuucaguuuuuauuauuuguaguuaaauuuuuuuaaaccuuaggagucuuauauuuuagaaaauuuaacagaccuacuauauagaggcaauguuaucaauaauucauuuuaaggcacaaaagaauaaaaauauggagcuuuaauaugagguaguaguaauagcacacauaaagcacugugugccaagcauuguccuaaguauuucauauuuaaucucauuuaauccuuacaacuccuuuugagaaagauacuauuauuauuccaguuuuacacaugaagaaacuggagccagacauguucacuugucugaggauguacaauggggccaggauagagagaauauauucuaagucucuugaugaaguacucuacuacuuagauagauuuuccucacaucuuuuuccugaaaagucaacauagaaaacauugaauguaacuucaauauaaaacuuauaaacacaagaacauaauaaaaguuuaacaauauauuggugaugucacuggcauugcuuauuaauaauaguuuucagugaagacaaaaaacauuguguguucaggguuuccaagaagcccagcuucagugauucagacuaggaggacccagaggauuuauggcuaauguuuauuacaacaaaaggauacaaggcaaaaucagccauggcaaaaggcgaguggggagaaguccagaagaaaccaggugcaagcuccuagaguucucuccuaauggagucacagggcacacugaauuuccccaagcaaugaguuaagacagcacuuguagaaugcuguuuaucagagaagcucauuagagacucagugcccaaggauuuuauuaggaacugaucauguaggcaccuacccagcaugcaccaaaauuucagacucauagaaggaaggcagaacugcagaaugaagaaucauauuguuuguacagauaguuuggccauacuuaucaguuagaauggugguaauccuccccaaauccaaguuccagccaagggccaaccuuuguauacaggccuuucuaaacauggcagccucagagcugcuguguuagcucuugucugcacacaaugucuguuaauuuauuuccacuaugagauuuuuuagcaaucuuaaaaaagugaugaaagaaguaaggaauagauucaaaauucuauacuagccuuuuaaauuuauaucagaccuuguuucaacauuuacagaaacacaaaaguagaauaaaaucuaaagcaagugaggaaaugugacacauagagcugggcuguaauuucuacacaaaaugaacuucuuagagauuauacacucuuggucaggugcuguggcucacgccuguaaucccagaacuuuggaaggcuaaggugggcagaucacuagagcccugaaguucaagaccagccugggcaacaugacaaaacccugucuaugugaaaaguacaaaaauuagcugggcaugguggcacaugccuguagucucagcuacucgggaggcugaggugggaggaucacuugaacccaggagguggagaugcagugagccaagauugugcuacugcacucuagccugggugacagagugagacacugucucaaaaaaaaaaaaaaaaagauuauauauucuugcaagaauugugcacuguagauugaacucugagcuuucuauuaugugugucuuagggaaacauuaauuuuuuucuaaauagauaauaccuaacaauguuaaguguuucccuuguaccaggcauuuguuaaauacccuauguuuauugugugacauaaucuucauauagggacauaaguaccugcaauuuaggaacuuguguuauucuuguguuccagaugaagaacuugacuuagagaaguuaaguaaugcauucaaaaucacagggucacauagcuacuaagcaggguagacucagauaugcccaguugcuuuuaacaacuguaaucauuuaugacugguuaaacuguuaucucucuggaauugaagaguucuuuauugcugcuaucuuuugaucuuaugaccaucucaucaucaaagacuacgccaccuggcucaguauccucccuuuccacuuuggugcuccaaccaacuugggugacuuuuaugguuauauggauaaucacuccuugagcuucacagcugcaauaaucauaaaaaccuaccugugucugaaucuguuuccuccuccuucuuuccaguuaugacagaguuuuagucuuaagacuaaucauucauacuuuggcuccuaucuccucugccuucucagggaccuuacaucauuauuaccacucauucucuucuguaucuuccaucuuucccucucaacuggaucugucccauuggcauugacacaucaaggcacugaugcccuucauggagccaccccugccagcucccuucacacacaaaaguggccuuugcguucugucuugauuucgccauugacuuaguucucaaccuauugaaguuuggcuccuguuccugucucucucuacauucaguggacauuuuaaaauucuaucuugaucucucagcagcacuuagacuuucuccuauauuuuuuguauuugcuucuguuaugucacgguuugcugauuuuccuccagcucuuuggcuuuuucuugugcugcccucgccuguaaaguuaaguuccucaaccccuuaucacaggagucagagaugauguggacauuccuauaguuccacaaagccauuuucaaauuuuuuuuauucucaugcaaacuccuuugucauuugaguuucauucugcauaauuauacuaucuucuaucuauuuucggugguauccucgaaguauacccccacccccauuccuugaggacuuuggcauuugauugcuucuacuucauucaccuuauguuccuguuauucuucugaguauuuuggugaccuuacaaauaagucucaacauucucugacugcuucaguuccaacaacgacgcuccauaaauuacaugaguaccuuaguaaauugcacguguggacaggaucuugggcuuauugucugggugagcuuuccucuaugaagguauaaacacacacacacguguaucagucuuugaccacaaccugugauuccuuccagcucugcccugccucuuuaucaucccucuuuugacauuguguauucauuuccuauugcugcuguaggaaaauagcacucacuuaguggcuuaaaacaacacaaguuuauuaccuuacuguucuggaaucgaaguuuuacugggcuaaagucaagguaucagcaggauugcauuucuucuggaggcucuguuuccuucccuuuuucagcuucuagaggacacuugcauuucuagacucacaggcccuuccuugcaucacuccaaccucuuacuucaaucaucacaucuccuacugacuccaggcccccuccucccucuuauaagcacccuuguaauuacauuugcucuccuagauaauccaggguaauccccuaucuggagaucuuuuaaaucugcaaagucccuuuuaucauguaaagaaauauauucacagguuccugggauuaggauuuggacaggcuguggggggagaauuauucugucuaccacaccuggucaagacuuuacucucucaacugcucuuucaucuccuaguaucccuccuuccuuuuugcucuucuaaaaauuuacccauagcagccacaucauaucaccuuggucccuaccuuaaaaccauuaaaugcuuuccuuucugcuuacacaggaaguucaguguaaaacccagacuccuuccugucaucacaaaaugcccuacauaucugaccucuguuauuucugacuuuacugcagacaaauauucccucucacucugcucuugccacaguguucauucucuuugguccuugggauacagcaagcugguuuuuaccuaaguaccuuugcauuggcucuuccugccuggaaugcacuguccccagaucaucacaggaugaacuguauccuuccugucacugaagucucaucauggauguuaccuccugagaaagacauucucugaccagccaaucuaaaccaggugacccugccugucucugugucauaccauguauggcuuuucuccugaauauuuaucacugucugauuucuuuuuuauguguuugucuucucucugaagguaggcuccguggaggcaggagauuuuuuguauauuuuguucucuacuauaacccaaaugcccuagaauggugccuggaacuuucauagcaacuuaaauauugaaugaauguugaauacaucuauucccccuuuuaguguaugcacuagaguguaugcuuugugaggauagguagcuuuucuuacucacuguuguuaccaguaccuagaaccaagccugaccuuauuagguucuuucaaauauuugaaagauauuuuaaaauauucacauaucccuugaauguuaaaugaauaaaugaaugaauuaauucucucucaaauccaagucauguuugccaucuaaucuggugaauguuaccuaaaccucucuccugucaguaccuucuacuucuuugcccugggaagcccagucuuuggcauuaggcacggaucaacaugccuuuuaugugguucugguucaccuucucucucuuuccuuucagcaucuaaucaaacuuucuuucuuucucucucucucucucucucucccucccucucucccucucucucucucucucucucucucucucuccucucucucucucucuuucuuuuuuuaggucuuaacucugucacccaggcuggaguacaguggcaugaucacagcucacugcagguucaaccacccaggcuuaagugauccuaccaccccagccucuggaguagcuaggaccccaggcacaugccaucacacccaaacaauuuuuaaauuuuuuuguagagagagggucuccuauguugcccaggcuguaccaaacuccugggcucaagugauccuccugcccucagccucccaaaguguugggauuacaggugugagccaucaugcccagcgcauuuccuuuuuuaaaagcuccuauuacaauuaguuuauacuucuauuuuacauuucaccuguguuacaacguuuuuuggucugccugcuuuuugacuuuaugagagugaaaagucuuguuaauuauuauauuuucaaaaccaguaacauuaucugcuuauaucauauauuugcauauuguaugcucaauaaguuucuuguauucucauuuuuacccucauaacagcuauguaagguuuucuguguguaugaauauuuuccucauuuuguaaauucagaaacugagacucaagguuauuaagauuuuuuuccccuaaagucuccuuccuaauaaacuacagagugagggcauuugacugaggcuuuuguccuacucagcauuauguuaccacuuucuucaaaucuucucacccccuucucucuagaaaucaaucuugcuucaugucauuaagaaauaugagguucuagcauuuauaaggaaccuaaacaaauuuacaaagaaaaaacaaacaacccaauaaaaagaugggcaaaggacaugaauagagacuucuuaaaagacauguggccaacaauuauauaaaaaaagcucaacaucacugaucauuagagaaaugcaaaucaaaaccacugugagaaaccauuuaacaccagucagaauggcuauuauuacaaaguaaaaaaauaacagaugcuggcaagauuguggagaaaaaggaacauuuauacacuguucagccauuguggaagacaguguggugauuccucaaagaccuaaagacagaaauaccauuugaccuauuacuggguguauacccaaaggaauauaaaucauuguauuauaaagacacaugcauuguauguucauugcagcacuauucacaauagcaaagacauggaaucaaccuaaauggccaucaauuguagacuggauaaagaaaaugugguacacauagagcauugaacaccaugcagccauaaaaagaaacgagaucacguccuuugcagggcauggcuggagcuggaggccauuauccuuagcaaacuaauacaggaacagaaaaccaaacaccacauguucucacuuaaaagugggagcuaaaugaugagaacacauggacaccuagaggggaacaacacacauuggggccuuucggaggguggagugugggaggagggagaggaucaggaaaaauaacuaacgaguacuaggcuuaauagcugggugaugaaauaaucuguacaacaaccccccaugaaacaaguuuacguauguaacaaaccugcauuuguacccaugaacuuaaaaguuaaaauaaacaaauaaaaaauaauaaaaaaaaaaacaaaaggaaauaugagguucugaacucuuucaauuuucugucuuuauuccuggaaaauuaguacucacuuuaaucuccuuccuucuagucuaagauuaagagauguaauuccaauuuucccagcucagugaggggugucuuuugaucagucagcuauuucuguuuccacacuuuacaccccaaacuugaggguccccagucuuuuuuaagcacauugugcucuuuucugucucaguuuacuuuucuuuuuggcuuaaaugccuuuuuuuuuuuuuuuuuuuugagacagagucucacucugucgcccaggcuggagugcaguggugcgaucucggcucacugcaagcuccgccucccagguucacaccauucuccugccucagccuccugaguagcugggauuacaggcgccugccaccacauccggcuaauuucuuuuuuuguauuuuaauagagacgggguuucacuguguuagccaggaugguauugaucuccugaccucgugaucugcccgccuuggccucccaaagugcugggauuacaggugugagccacugcacccagcuacacuugguaaacuuucaaagcuggaaggaagcaucaccucuuuuaucauaugaagccuuuucacaaaggagggaaugaugauugacucaguuuugugucuauucuauacacuguacugucaaagcaugcagagcauguauugcauauacauuuuucuuuaaccucucugaaggcaggguuauaucuuuggcauuuaucucuggauuuuaucugucauugaauaggcauucaguaaaugucuacuuucaugauccacuuauuuuuauuauggccagugacaguucuggagguaaaauguccuguguugguggugaugggagaaauuuuuucauaucaacuaucuucucuuccuguacuaaggaguuugauauuuuaucuacuuuaauauaaucucuaaaagaagaccucuucccuuucauuuuuguuuaaggaagcagaugaauucuuaucuaagacaaaguacauagugcaaaauuuagccaguguuucaaugaaauaugaaaaaauaugccaaaacguguugucccauuaauguuuuaaucuguaaauaugaugauguuuuuagaucaucaacccauaaauaacauggaaaguuaugccaugaacccaaacuuaagcucauuugauaacacauuuaagagcuagaaaaaggguaaaugcaaauacuuaaguaucuauuagauacucuuuuuuacacaccauaucuuaauuuucauuaauuauuucauaauuuggcuuuacuuuuuaucuccugcuuuauggacugccauucauuacugguaauaaccauucuuuauuucuccacucggcaguccaguaccaaaucccccaguugcuacuguaagauucauguaagcuaacucuaggauugguuucuauccccuugugaaguauauguaaguucuaaaaucuugcugucuguggcuaugucuuuuuugcugccuaaucuuuguuuugguuuauauuuccugccuaggccuaugauuuuuuuacccaguuuccucccugcauuacaaaccuguugccuacagcuacaccuugcauccacauguuaaccuucugcccugggauuuauccauagacacccacagcuggcuuuaccccauuucuguuuuuuuucccuuugguuuucuuucaauccuuagcuaguuccuugaguuauagggaagcaguauuaaucacuucccaagggggcccugagcccauuccucuuaacuguguccuuuuccuguaacuuuuuggguucagagaagcuuuucuuuccuuccuguuaccugccuacauuuaaagagauuaugcagaucuccaacgugggucauucauuauugccauauucugucuucucagaaaaaauguuccuugacaagcaugcaucagacucauuccuuucuuuuuucugcucauucuugaggccuaauuaucuucaaaucauuuuaccuuuauaccaguuccauuguuuggcaggucuuuaacccaaaccacuuucuuaaagcaacacaauguuuccuccaugguauccucagaggggccuuuggcauucaaguuuuugcccaugagaugauaaguggcuucuauucuuagaaacuagagcaacaaauaccauauuauauaccauuaaauacuuuuacaguuucccagaaugucccauccuucucauuagacuucauauaagaagacagaccaaguccaauaugaagaauuaggccagaacucaauggaagaaucaaauguccauuucuaauuagacuauugcaauaauuuagcaaagguagagggugucuuggacuagguugguaucaguaguagucugaaaaauguuuggauuuuggauauauuuugaaggaaaagcaaaucuuccaugaaacuguacuaauuuuuccucugcuauucuuuuuucucucuuuuuaguuucgcuauucaaauuggcuugacaaguuguauaugguggugggaacuuuggcugccaucauccauggggcuggacuuccucucaugaugcugguguuuggagaaaugacagauaucuuugcaaaugcaggaaauuuagaagaucugaugucaaacaucacuaauagaaguaaguauuguuuguguaccaauuuuauuggaaacuugcagcaaaaacaagcacuuagagugauguuuauggauucuuuacuaaauacacauuaguguguuuaguccuguaggaggcagacagucugaguuauaauucauauuuguagugaguuagaaaagauaauauuuacaagcauuacaacacacaacugaagugccagcagagauauguagaaaaagagagagcccugugaagucagaaauauucuggaaagcuucaagaagaaauauaggaacuuaauuagaaccuugaaugauaaguaggaaucuguugugagauuuccuaacagauugaacauggguguaagacgaaaagucggggaugauucuaaaguuuuuagcccuagaaacugggaggaugcaguuacuaucaacagaaaugagagauggagaaggagaguggauuugagcaauaaaucccagaaauuuaguuuuggacauuguuauauguugggcuuucuggaaguagaugcaggaauggaaaaguggggcaaaauuguguguguguguguggggggguauuuuaggauaggauaaauaauagcuuguagcuuguuuuguguguuaauggaaaugauccaaaagaaaggagaaagugauguuugaaugaaagauggaagagauuugcugagugauauccuugagaaaaaauggaauccagugcugaggaggaaaacaguaacaggugggaaaagugaauuugagugucaguacccagugguggguagaugagaaggugagaaucuguggaauuuuucuccugauaacuuuaguuuucucagugaaguaggaagcaggagaauuggcugauagagacagagaaaacagauguaacacagcucucaaggaaagugggaaagugaauagacuacagaaauaaucuggguguaacauacauauucuuuccucucucucccucucucucucucuuucucgauuggggaggaauggguugauaucucugaguuuccuagguuaccucuggucaagccuagauugauuuaaacugagcuacucaaaaacuuacaauccaguuugcacucagguggucaaauguugaaaaugccuguuugauaacguacuugaaaauguagugauaccacuuagcuuacaaggaccuuucaacuuuugaacuuucaaguuucugaugaaugcaaugaauugcuuccccagaaacaugcacaugaauauucauaccaaucucggguauauacggaucuuuugauacuugucaguggguccucagaaccacuucaugacccuaaaaaguacauuguuuacccugggguagaacuacuucaauucuguggaugcagguaaugagcugggccagaaaaauuuuuguauguuugagcuauguaaaauucuuaugcuuuauuacauccuuucacggcauccaaagggaccugcagaaagaugcugcaccaccucugaacugguaccuuucuuuuacaccauucaccagaggaaguccucaaugcuuucugaauucauuaguuccuauacuugcuauauuggccaauauucuguggcguuagcucucuuacugcuucauaguggaagaaucaaauacuucaucacucucugguggcucagcaggccuaauggguacaucucuguccauccagaucuugcucacuuuuuaaugacuucccagccuucagaacugugggaaauaaauuuuuauuguuuguauguuaauacauacaguuuauguauuuuguuauaucaucccaaauggacuaagacacacaguaaacucacuuacuuaauagcaugcaugagcucccaaacagaugaugaucuaguugugaagacuagcuccuuucuggauaggcccaugugucuguaugccuaucaaaaucuccuagguuaaacaggggccacaucaccacagcuugccagcugguaauuuagauuuccaucuucauagauaucuaguuucuaggugagguuguaauucacauugcaguccuugccagucauucucauucagcucacucuucuagucuugagaacgggaaagagaaagcuuagagaaauauuugaaaguuuacuuuuguuauucucuuaagaggugguauauuuagugguuagcgaacauacucuggaguuggacugccuggcucaaaaaccacacccuuaccaauuuuuaauuuugagguuuagggaauuuauucauacuuuaguuauuaaguuggauaacaauagaaccuacuucucaggaugguugugauauuuaaguggauucauucauugaagaaucacagaacaaagucuagucauaagaaguacucaacaaauauuaguuacuguuauuaucaacaggcuuucauguuccucacaaaugaaauuacauaacuuucaaugaugauaugguuccuuauauaauuucuucuuuacaaaauucugugauacuaccucaauuuucauaguuguugaaaguuugggacauacccaaaguuacucaguaccuauuauaugaugugaauaaucaucccuuuaaguagaauuuccuugguuaccagccaugccuuucagggaagguagguauccuccaacuaugaccccugggcuaauuuggccugcugccucuuuuuguacagggugugaacuaagaauggauuuuacauuuugaaaucauugaaaaaaaaucaaaagaagaaauuauauuuugugacccguggaaauuaugugaaauuuaaauuucaguaccuguaaauaaaguuuaaugaaauguagcuacaccuauucauuuacauuuuaugaauguaagcagccuauggcugcuucuaugccacaaugacacaguagaguaguuguacaaaccguauggucugcagagccuaagauauuuacuaucuggcccuuuauagaaaaagguugccaaucucugaaguaggguauugagugagggguuguuaucuucagucaauccaucaauuaauuuguauuagagcauucugugugccagucacaguacaugcccucaucauucccaacucuugaggagcuuaguguagugggagggauggacaagggugaaccaauaaauacagucgaauuugauuagugauauaauacagagauaaauaaaaugcauuggaaaaagagagaaaggacaccugacuccauauagaggaaucaugggaggcuuccaagaggaggugauaaccaaauauggucagcaucuaucuccuacacaaaguguaccuauucuguguaacagaugaaaccauuucaaaauaaagauuaaauaaguaagauuaauauccuucccucacugccacuccuuauuuccacuccccucaccauugucuauccuuccaugccuuuccaaagacagcaugcuaucuuuacugugauuuucacuuuaggacgcuuacuacacuaucacuaaucugcuugucugcagauucagacugccagauacccucaagucugccuggaaagcagggaauagcaucaaagguuuugaugcuugucccagagaugagggcaaacaugcucugucaugccuguggagggagaaccagccuacuaaauucuuggggcccgagauacagucagaucauucuucuuuuugcccuucccuaggcagaaccucauuaucucuccauggggguggacuagauaccagagccuccuuauuggaaaaguaguccuugcuuaaggggacuuggacuugcggaggcucuugaaagccuggggguuuuuacaauaaacauaggaucuaauuagacagcucuaaaaccuucuucaguaagcagauccuucucuguugcugcaauagaacccuuguaaguuuucucgucccaauacuuugccuuaauuaacagacaucagcuuuuguucugcuguuuuacuguggaccagauuuccugacagccacucccaucuaucucugguuuaauuauagaauauguguagccuuugccuuaaaaucucugaugacuggagccuagggaacucucugauucugucauaucacuuuuuuuuuuguaaacaaagcuuaaucacugaugaauuucuguaauauucugugaauucucaucuuccuuaugagacuggccacuaucuggaaaugauccuagauaaaggcgauugugguuuuaaauguguuguggugaagacggcagguggggugccuguaaaaugacauccaggcaguugaagaaaugacacuaaaucuuggcauaaagaacaggacuagaagcugggugugguggugugugccugcagucccagcuauuggagaggcugaggugggaggaucacuugaggucagaaguucaaggcuagccugggcaagauagugagaguuugucucuaauaaaacuuaaaagguuaaaaaaugauaaaauguaaggaggagguggaacaagauagccaaacaaaagccuccagaaaucaucccccccucccccaucccuacaggaacaccaaauugaacaacuauucacaaaacaaagcaccuucauaagaacuaaaaaccaggugagcgaccacacuauuugguuuuaacauuauauuaaggaaagaggcacugaagaagguaggaaagagagucuugaauugccugcaccacucuuccccucccccaccagcagcacauacugaagaaugaaucacagucucuuaauagcaaaauugaucaagcagaaggaagaauuagugagcuugaagacaggcuauuugaaauacacacacucagaggagacaaaagaaaaaagaaugaagcaugcccacaagaccuacaaaauagccuuaaaaggguaaauccaagaguuauuggccuuaaauaggagguagacagagagauuagaguagaaaguuuauuuaaaaggguaauaacacagaauuucccaagccuaaagaaagauaucaguauucaaguacgagaauguugugggacaccaagcauauuuaacucaaauaagacuaccucaagauauuuaacaaucaaauucccaaaagucaaggauaaagaaaggauccuaaaaggagcaagagaaaaggaacaaauaacauacaaaggagcuccaacaugucuggaagcagacuucucaguggaaacuuuacaggucugaagagaguagcgugacauauuuaaagugcugaaagaaaaacacuuuuuauccuaaaauagaauauccaaugaaaauauccuucaaacaugaaggagaaauaaauacuuucucagaugaacaaaagcugagggauuuauucaacaccagaccugucuagacaagaaaugcuaaagggaguucuuuaaucagaaagaaaaugauguuaaugaacaauaagaaaucaucugaagguacaaaacucacugguaauaauaaguacucagaaaaacacagaauauuacaacacuguaauugugguguauaacuuacucauaucuugaguagaaaggcuaaaaaaugaaccuauaaaaaauaauaacuacaauaacuguucaagacacagucuaauaagauauaaacagauacagauauaaaaaguagggagcugaaguuaaaguguagaguuuguauuaguuuucccuuugcuuguuuguguauguaaucagcauuaaguugccaucaguuuaaaaaugaguuauaugauaucauuugcacaccugaugguaaccucaaauaaaauaacauacagcagauacauaaaaaauuaaaagcaagacauuaaaacauaccaccagagaagaucaccuucacuaaaaggaagacaagaaagaacgaaagaaggaagagaagaucacaaaaaacaacaaacaaaauggcaggaguaagucuucacuuaucaauaauaacauugaaucuaaauggacuaaauucucuaaucaaaagacauagaguggcugaauggauuaaaaaaaacacauuaaaauauuauuuaagaccaaaugggguuuaucccagggaugcaaggauuguucaucguaugcaaacuaaucaaugugauaugucauaucaacagaaugaaggauauaaaauauaugauaauuucaguugaugaugaaaaggccuuugauaaaauucaccacccuucaugauaaaaacuggguauagaaggaacauucauaaacaaaauaaaagccacauaaacagacccacagcuaguaucacaccaaaugaggaaaaacugaaagccuuuccuucaagaucuggaacaagacaaggaugcucacuuucacuaguuauucagcauaauacugaaaguccuagcgagggcaaucagacaagagaaagaaaaaaaaaggcaucugaauuggaaaggaagaagucaaauuaucccuguuggcagaugauacaaucuuauauuuggaaaaaccuaaagacuccaacaaauaacuauuaggagugauaaaugaauucaguuaaguugcaagauacaaaaucaacauacaacaaucaguagcauuucuacauggugacagcaaacaaucugaaaagguaaucaagaaaguaaucucggccgggcgcgguggcucacgccuguaaucccagcacuuugggaggccgaggcagguggaucacgaggucaggagaucgagacuaucccggcuaaaacggugaaacccugucucuacuaaaaauacaaaaaauuagccgggcgugguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaagaaaguagucucauuuacuauugcuacacaugaaauaaauaccuaggaauaacuuuuacucaauaaaugagagaucucuacaaugaaaacuguagaacauugauguaaaaaauugaagaggacacaaaaaauggaaagauacuccauguucauugauuggaagaauggauauuuuuaaaauguccauacuaccaaagcaaucuacagacagugcaaucgcuaucaaaauaccagugacauucuucacagaaauagaaaaaagaauccuaacauuuacauggaaccacgaaaaaaacagaauagccaaagcuauccucagcaaaaagaacaaaacuggagaaaucacauuaccugacuucaaauuauacuacagagcuaguaaccaaaacaccaugguacaaagaaaagagacacauagaccaauggaacagaauagagaaugcagacauaaauccacaaaucuacagugaacucauuuuugacaaaguuucuaagaauguauauuggggaaaagaccgucucuucaaaaaaugguggugggagaacuggauauccauaugcauaaaaaugaaacuaaaucccuuucucucaccauauacaaaaauaaaaucaauauggauuaaagacuuaaaucuaugaccugaaacuaugaaacuacuaaaagaagacacuggaaaaacucucuaggacauuagauugggcaaagauuucuugaguaauaccccuacaagcacagggaaccaaaacaaaaauggacaaauggaucacaucaaguuaaaaaccuucuggacugcagaggaaacaaucagcaaagugaagagacaaccugcaaaaugggagaaaguauuugcaagcuauccaucugacaucagauuaauaaccagaauauaugaggaacucaaacaacucaauaggaaaaaucuccaauuaacaaaugggcaaaagaucugaauagacauuucucaaaagaagcuauacaaauggcaaacagguauaugaaaauaugcucaacaucauugaucaucagagaaaugcaagucaaaacuauaaugcgauaucauuucaccccaguuaaaauggcuuuuagccaaagauaggcaauaacaaaugcuggcgaggauguggagaaaagaaaacccuuguacacuguuguacaacuuguacauuuuugagaauguaaauuaguacaaccaugauggagaacaguauggggguuccucaaaaaauggaaaauuaaacuaccauaugauccaguuaucccucugcuggggaaauacucaaaagaaaggaaaccaguauaucgaaccugcacucccauguuucuugcaucacuauucacaauagccaggauuugggagcaaccuaaguguccaucagcaaguaaauggaugaagaaauuaugauacauacacacaauggaguacuauucauccuuaaaaaaaugagauccugucauuugcaacaacaaaaauggaacuggaggagauuauauuaagugaaauaagccaggcacagaaagacgaacuucacauuucucacuuauuugugggagcuaaaaaauuaaaacaauuggacuuauagagauaguagaaugacauuuaccagaggccgggaaguguagugggguggcagagguagaaguggagaugguuaaaggauacaaaaauauauaguuagcuagaaugaauaucaucuaguauuugaucacacaacagggugacuacagucaacaacaauuuauugcacauuuaaaaauaacuaaaaggguauaacuggauuguuuguaacacaaagaaaggauaaauuuuugaggugauagauaccccauucacccuaaugugauuauuauccauuguaugccuaugucaaaauaucucauacacccuguaaauauauacaucuacuauguaccacccaaauuaaaaauaaauuaaaauuaaaauuaaauaaauuuaaaaauaaaacuaaaaaaaccaggacuaucaacuuggcuuuauuuaaguugaaugugauguuaaauccucugggauagaauauggagaaaaguagaaagaaugggagccccaagccuugaggaagaacucaacuguuagcaauaacugaagccaacccucauugaacauuuacuauuugcugggucuuguucuuggagcuuuacaugcaguaacucuuuuaauucuuaaauacacaugagauuaauacuauuauauauguguguaaaaguaucuauauauacuuacauauaauuauauuuuauauauaauauauacuuacacacacacuuauauauaguguguguguauauguauagcucugugaaaccauuugcaaauuuuuugaauagguuaaguuauagcagauacaacagguugggcacuggauauauaaagauaaacaaaauauaguacaguuuucuaagaccauaauaauauaugguauaauaauauuuuugguuaaggguuuucaagccaaaaaguagaauuaguuacaauguaaucucugcaauauauuagaaaaacagcaaaaaaaaaaaagaucaauauacagauaguaccuaacccauucuaggugcuuaagaaauuggaugaauaaauaaaagacugaauaauagaauuuuguaggugaaaaggggcuuagauguuaucuagccugaacccauaauuuauagacauacaugcccaggagguugaauuaauguggccauaauggaauugcuugcggguugacagagcugaauuccugggccaggaauccuacuuuuuagucugguaucuuuuccacucugcuagugguuuucacacucugccuaaauuggaagcaaaugccagcacuuggucuuuuaaaucucuuggaugcugcccuguaaguuugauuuuuagugugucaggaaggucaggcaagaggcacagcucuucaggccagagguauauaaacagcucacauaaaaagacuguaguuccuggaaucaucucugucaccugcaguaagcccaacuacacugagucacagccuucaguuugggccaaugccauagggauuuaucauuuaggcaaaagauccaaauuccccuucccugcgguugauggagcuuucugcacaagaagaguaguuuauugguuuauuagagcuucuuaaauggguagaaaagcuaaaugaaaaaaaaacggaaguuccugggaaaaacugugcuaaauaggucagcaguguuacccugucaccugaaguuugaggccuaaaagugaaaggauuucuuacuugaacagaaauccgaugauauuagagaaaguggcucucauucuggguuuaucuucagugucuggaaugaugccuggcaugaagucucuguggaagacaguuugaaaaccaccuuuucaauauaauuucaguuuaccaauuagggaauuaucaaugcaucaucaaaggauaagacuauacuaauguauccauguuauauauuuuuuauucauacuguucuuaaguguucaguuauuaaaguuacuaaauguacugaaguauuuaggucaaauaaaaaaucccuaaaugguacagucuuauccuuuaaagucuugcuuggguuuagaaaaggcuuuucuugccagguagaaaggucuaauguaucucucuuuaaucuuaaaauaugugagacacuuguauacaaaguaggagaaugguuggauggaauauuuugauaaauggucuggcuuguguaguagcucugugaaaccacucguaaauuuuuugaauaugcuaaguuauagcagauacaacagguugggcacuggauauauaaagauaaacuagauauaguucaguuuucuaugaccucacaccagugggagugggaggaagagauagguguaaauagucauacuucuauuuuuguaugacuuaguaaguugaaucaucugucaauuacuacggaguucuauugcaagaugagucacucugcuagggguaagaugauguaauacuuuaguuuauucauggaggaagaguauauuccaggagaaaaauuuugauaaagggcauuccaguuagagaaagcagaauggauaaagccuugaaggaagaaaauaggauaguuagggaacaguaaacucuucggugugcuuacagccagggcuacacagaagugagcaaagcuggugaagauggggaugggggaguggagugaguugacgcuagaaagggauguagcaaauguaacuauuauuccagaauccaagugugcaaaaaucauaacuuuuauuuuguauaacauaauuucuauuuugagucccucuucaguaaauguggcaaaaacccaaucucaguuauuuugggguagcucucaccuuucccuggggugugucuuggaggccaacauaguuucagaugagugagaaggccaaguguuguucagcaucaucaucuacauaggcauuccgucaagcucucucguccuccucucuuagaagcuuugaugucauucuguuccuuccgugucucucuagguccaaggagauucuuggaagcuguucuaaagccgucccuucaacucacuacauauuuccuuuucugaggucuugcucuagggucugcuuagguggaaggaggcaggcuucuuuuaccuggacccuccagugccuauguagucagcaauucucaacuacuuauuuucuucucagcauguggaaaauauuuuuucagucuaaaggguggagcuuaaucucaugaaauuuaaacaaaauauucugucaugcucaguuuccucuccaacccucaaaggcauaggcuuugggaacauuuuauauauauauaucguguagguuucuucuuggcuuuuauuacauauauaaauuuuuuuaaugcagcagcagcucucucugaagacagugacugcacagugcucuagcuacugaaaugaggagauagguguggggguaaaggaaauaucugguaaaucauuguugguacuuuaaacauauuuucuuucauguguauauuguggcaagauugcaaaagaacuaauaugauguaucauggaucuugaucuuuauccuuuaugcaguggacugucauugaagguuaucaauggaagcacuaugauuauacuuuugcuuucaaauauaaaaucuggggacaauaugaagaccuaacugggguagaaagauuaguuacaguagucuuguuacaggagagguaagaaaugauggggacuugaaccagagcauuaacugugaagagggagaggauuugaauagcucuagauauauuuuggagucacugaagcuguggaaguggcugaggucagccuggagccugcauagaguucugggaaacaucaguguguaggaaagagggagagcauaaggggucaguaacugagacuaagggagaagcaucagagugguggaaguaggagaaccaggauaaugagguccuacaaacuggugauaaccuucaaugacaguccacugcauaaaggaugaugguuuuauuaaugggaguuccccugcaugugcccucuugacugucgucauguaagacaugccuuugccccuccuuugccuucugccaugauugugaggccuccccagccauguggaacuaugagugcauuaaaccucuuuuucuuuauaaauuacccagucucagguauguuuuuaucagcagcauacgaauagacuaauauaguuacauagguaaaugugugucaugggguuuuuguguagagauuauuucaucacccagguauuaagccuaguacccacuaguuauuuuuccugauucucucccuccccccacccuccacacuccaaaagucuccaguguguguuguuucccucuguguguccauguguucucaucauuuagauccuacuuauaagugaaaacgugguauuugguuuucucuuccuguguuaguuugcuaaggauaauggccuccagcccccucccugucccugcaaaggacaugaucucauucuuuuuuauggcugcauaguauuccauggcaucuauguaccacauuuucuuuauccagucugucauugauuggcauuuagguuuauugcuuuugugaauagugcuacaaugaacauaugcaugcaugugucuuuauaauagaauuauuuauacuucuuuguugaaugcccaauuuuuauuuugacugguacacuuugaaaggugaagcacaaauaaaaggaacuuggugcuagacuuguuuucuauguauuuugauggcugaagcuauagguaugguguaauuggacauacaaacauaaaggaggcaauuuugaccuugaacaaaauuuuuuacuuuuugagcuauuuagaaaugacuguagacuuagaagacaucauugcugaagaacauuuauuuaaauuaucuugguuucuuaucuuaagaauugagaaaacugguagaaacaaugaguagaaaacagauauuuaguuagacuugaaaacuggucuucauuugguagugacauacuggcaacaauuaauacuauauagagacauuuccugguaaauacagaagauacauaauguaagcuuucccaagauugauuuggagaaaaauccucaccugacuauucaauguccuguuucauuuuugaaaacguggagcagaagaaaucucacaacugauuuaaauaaaaauucaaucugaaaaaguuuauuguuguauugacauaaggcaaagcagucaagaaucccucuugcauguuuuucuaagcuucugcaucucuuuguuucuuccuuaccuucugucuuacccuuuaauggaguuuucuccaggauucugugcuuggccugcuguuuucucccuaucugcuggccuguccuuauggguaaggagagauggauuuagcuauggccucuagcacaugaauccuaaaucuuuagaucugaacugucucuaaaacuggaaaguuacggucugaauacuuauuggacaucuucaauugaaugugccaggcacugcaaaacaaaaauguucaagaccaaacuaauaaucucuccucugaccaggguagcucuuuuugcugacuucuuauuucccaccaugacacuagcauucuccaaaugcuuaggcuugauguuuugaucauuuuuaaaauuuuuacucucucuacuuauauucuaucaguugcuaaguccuguaacuucuuccucuauaagucucauaaguauuugcuuucuuuucuauucucauuuagacucucuuucccuacauaguuauaguagcugaagucccuuagucucuccacauuccaguuaaucguauacauugcugguggcuaaacucucguagaacauacuucuaauuauauccuauuuugcucaaaacugucgaacaacugcuggucuguuuucuugcaccauaccugcaggacccagauuaucuuuccagcuacauaaccaccucccuccauccacacaacacacuuccuaccccugucaaaaacaggcuuacccauucuucaaacuugccguugacuuuuguccauauuguucacuuugcuagaaauaguuuuuccccucuuuuccauaccaguugaaaucagacucaacugaaacaggcccuuucauuuuaacauaacuuuuugcagucucgauugugauaauuuauccuagaaaauauuuacucuuuguacauuuauaacauauguguauaaguauguuuaacacagcauugcuuguaacaguaaaauauuggaaacaagugaaauaguugcaacauugaaaaaauagauacacacauauauauacugacaggaaaaaauuuggccacuaaauguaaacuaugacuccauuguuaaaaaauaagugugugugcuuguguguauauacaugcguacauaaaaucugaaaauguacacacaaaaauguugaauugugcucguguguguauaugugucugagugugugugugugugucuguguguuagggguaaaguuaugaaauacuuuuauaauguacuuuuuauccaaaaauguuagcauuugcuaauauugggugaugagcucacugguguuuauuacacuguucuuuguauuugauauuuuuaaauaagaauaaaacuggaaaaaugcuaagauuuuaaauauauaccuuaguaccaaguacucaauggcauuuaucaggacaaaagauuuuucuuuagugggaucuuggagugauauuccaaaaaauauuuuaauucaaggacacugauauuucugcugacagacuaccucuuaccaaauguggguuucuucuugcaaauaaacaucacugaguugguguauaugugguugcacacagucagcagagaaguauuugaaugaaugccauaaugcuuacacacaauuaaaacugagucaguucgaccuauuuuuauguaaaucauuaaaugaaaugaguuugauucauuuuuacauguuuauuuuuaauggagacuaaagagacauaaaugguauguuuguuuugugguggucuaggugauaucaaugauacaggguucuucaugaaucuggaggaagacaugaccagguaauuagacauucuccuuacuauuguuaaguuuuucuauauucaucaaguuguagaaauguuuaaaacuuugcauuaucaucacagaaauuuuaaggagaacaauacucuugauaguuuuuagaagaguauauguagacuuuuuaagaaaagaauuggcugcauaaaguauacaaaaguuagaguuaagcuuaaaauggacauauaugcauugaucaauguagaauaucauauuaauauauaaggaaauuagaggaguuuaagguagucuuuuaaaaugcaguugaauuaagaaucauuauuuucuauaauauauaugugccaggugugguggcacauagcuacaguccuagcuacuugggaggcugaugugagaggauugcuugagcccaggaguucaaagcugcagugagcuaugaucacaucacugcacuccagccugggggaaagagcaggacccugucccccacacccccccacaaaaaaagagagagacagaauaauuauuuucaauggcuuauaauuauuaauuuguuuccuggauguuuucauacgacaugacaaugaaagcagccaaaagaaauuuuuuuuaaacucaacaucugauucugaacaauaaaauaaaacaucccagaaaaaauacagucucucuauucuuaacucacacuggggaagcuuuugguuaaugauuuacauaucuugaaguuuauucuccagaacagcuuauaacagauguccaaagguacguguaggugaaucagaagaaaaugauuuuacauuacuguguaaaugaucuggguacauuugaaaaaaauagauuuuuuuuuuuuuuuuuuuuugagacagagugucacucugucccccaggcuggagugcaguggugcgaucucggcucacugcgaccuucgauuccuggcuucaagcgauucuugugucucagcuucccaaguggcugggauuacaggcgugugucacuacacccagcuaauuuuuguauuuuuaguagagaugggguuucaccauguuacccaggcuggccuugaacuucugaccucaggugauccacccaccuuggccuuccaaagugcugggauuacgggugugagccgccaugcccugccgaaaauggagacacuuuaucauauuuugaaagcugaggaccaaauaccuccaaauauuccuguggagaggcauuguuuuuuacauuggggaaaaugaaacagaaugucuuuuaaucaucauguacaugcuuuugaguaaacauacacugacaguuuaaaauacauuaacuuauucucaaagcaugaguuuuccuugugaugugggguuucuauuagcuaucucuugcuauauaaugaacacuuagauagaauacuaucucuuguuguaucaugaacacuuagauaguaauuaguuauugaguuaucuguuaacuaaaacuuaguguucuaauuacaucuuccuugauaaaugcauuguaaguuacaagguagaguuuggggaaaacuuguuucccaagauuccugaugggcugagugcugaauugugaacagcaaugucagagacugucugcuuguuaccuagccaucuuuauagcuucugcaugauucaaacacacaguuuaauuugaagaugguaaguagugaaguuuaaaaagugggaauauuggaauacuguauuuuauuuuagaauguuugccuuuaaccuaaaaauuaauuguuuagugaagcccaagaauuguuugcauuuuuuuuuuuugagauggaguuuuacucugucacccagguuggaguguaguggcacgaucucugugcacugcaacuucugccuucaagcgauucuccugccucagccuccugaguagcugggauuacaggugugcaccaccacacccggcuaauuuuuauuauuauuauuauuauuauuauugucguauuuuuaguagagacgggauuucaccacuuuggucaggcuggucucgaacuccugacuucaugauccgcccaccuuggccucccgaagugcugggauuacaggugugaauuguuugcuuuucuuuuuuuuuuuuugagauggaguccagcucugucacccaggcuggagugcaguggcacgaucucggcucccggcaaccucugcuuccugggcucaagcgauucuucugccucagccucccaaguaaccaaguagcugggacuacagucgcacgccaccacgcuuggcuaauuuuuuuguauuuuuuguagagacaggguuucaucauauuggccaggguggucuccaacuccugaccuugugaucugucugccucggccucccaaagugcugggauuauaggcgugagccaccacgccuggccuguuugcuuuuuuaaauaugaaaacucagagcaaggaaacauuaauucaggauuucuagauugauuaagggucuguuuuuuaagacaauacucguguuuuuuaaugcuagaauuuaaauuggaagggccacuauuugauucguuaagcauuuuaggauaacucacgauggccaguugggcaaaugaaauaaaacuacuuuuuaaaaauuucauuugucucuuggcaucuaaacucuacuagauuaauagcccaagggauaaucccuagcccaaaaggccaagggauuauuuccauuucuugaucccacuuucugacaaguucugucacuucuuuucauccccaauguacagagaccaacccaaugcacuuaucaacugaugcugauguaauaaaaauauuacaguggugggucuuaccugaugcugugauuccccaauauaccacaccaucuuucacaguaacuggcauucucugagugcuuacuaugugcugggcacugguccaaguauauuucaugcaugaguauuuuuaucucuguuuuacuaauuagaaaacugaggcuuagaaaaguuaagcagcuugccuaagauuacauaacagugaagugaagagcugggauuugagccaaagcagaaaucauucuuaaccauuccaccauauuggugcaaacauaguuggauggugacuaucaacucugcuuguuacaaccccuucuuauuuguuaaggauggcgagauacccagauaagugaaaaaauaggaaugaguggucucuuuggaaaagguacauugauuaggaaacagagagcaugugcaguguucuuguuguuuuucagguaugccuauuauuacaguggaauuggugcuggggugcugguugcugcuuacauucagguuucauuuuggugccuggcagcuggaagacaaauacacaaaauuagaaaacaguuuuuucaugcuauaaugcgacaggagauaggcugguuugaugugcacgauguuggggagcuuaacacccgacuuacagaguaaguauuuaguuuuauguugaacuugggugucguucuuauccuuaguaaaaugaaauagaugucaucacaucuguuaggagguguuaauguaucauucaaagguacuuaugagacaaaauuccuucuaagcagcaacaaugucgugugcauccuuuuguucccagugccuugacaggguauggggggaccugcaugacuagcauuaaaugaaggacugggcuuugccagaaugaagaaauccucugagaaugugcaguagagcaaaacaagauacuuucugaggaaauuucugagcaauuugaaauuccuagguugaauacuucuuguguacacgauguccauuuccuggggccaugugggcuauggauuuuuguuguuaaugacaaauauccuaguagaaacuucuacccugcuaaauaaaacaaagcauaggcacaaaauacucuagccauaaacuacccuacacucaaaacaggcuucacgagaaaaguugauguuuacaauucugacaauuauuucuaacacuaucuguucuuucagugaugucuccaagauuaaugaaggaauuggugacaaaauuggaauguucuuucagucaauggcaacauuuuucacuggguuuauaguaggauuuacacgugguuggaagcuaacccuugugauuuuggccaucaguccuguucuuggacugucagcugcugucugggcaaagguaggugaagccugugaauccagauuuugaacugcaccuucucccuuccugcucucacccuacggaaaggucuuuuuacuacaugaugacucugauucuguacuuguuacuuuuacguuuucuguucaaaaucagcuggauaagcauauccagccucacugaguacuaccccugccaagacuccaugcuguucuuggccaugugauuauuuggggaagggaugagaaagaagaauguagcucucauaucuaccuucugccuuuguaagaaaacgagcaaguaaacaaacaaaaacaaaaacaaaacaaaaaaaaaaaacuugaacuccaaagaaccaugcucucuaguggaugaugccccauucacacggcaaguagagacucaaguuuagugaacuacagaugucccauucaauuaacauuuuuuuuuacuuuaauguuuuuggcuuucuagauuuuuguuuaaguuuuaaauugauuuuacaguuuugucagcauucaaacacaguuaaauuuuugguuauaaaauaauuuaagaaaacagauacuuucuagucccuaaggaugcauauaaauccuuggccuucagcucucucuccugucaugaaggcagagagguagaaguggcccucucuaccccagcacacguuuccagugaucuuuuaaaacuuauuuuccauuucaaggugaacaugguguuaauuuuaaacugauuugauaugaguguauuuucaguagagaaauuggcccaguauguaauuuuuguggaguucaacacaacucagauaaggcaauauaaauucauguagcaaaaguaaugaauggacaaccaaaaccaagcaucacacaaaauaagucagguaguaaguauuaagaaacuguagaaauuuuaaccuguauaauggauauuauuuuguuucugcaaauaauaauuaucauuuauugagcauuuauugucacgcaaaugccuguguuaucuuucugaaguauagguauuaucucacuuuacagagaaagaaacugaaguucucaggucucuguuaauuuuuugcucagaguaacauagaguucaaauaauguuucuggggauuaucaguuaacuaaaauauuuggcaaaagcuucuugucaauugauuuuucuguauacuagaauguuaagcaaguuagguggcaaacucuucacaucaguauuuguugaaaaauuacuuaaaauguuuugaugucuguuuuaagauuaaaaacagaccaugaguuaaucuuuuaaugauuaauuaugcauugcuucacaugccauuuauuuaguaaaaggagccccaggcuggcugcuagagaccuaagcuuuaauccucacucagcauuacacuuuugguaucauuucaaacaaauuucuuaaauucuuuggaugucaaucauaucaaaaaagaaauguaguucacucugugucugggaagccucuuugugucugugagccugaggcucuaccuucaaaccuagagacacagaagcaaauagauauagcagaaagggacccaaucacagcaagugaccuggcccaggaagccucuuuuguacuuugugcccaagacugucuucccagcgcccagagacacugggccacuagagggcauugguacaggaaaccaccacacucuucccgaccuggcagucugaucuugaaaaaccacuuucacucccucaagcagcagaagcaggggccagugggagccccagaagcuucacauaaaucaagccgaccaaaauaauacuacaaacacucugaauauuaaaccgcuccuggaaccacagcucacaaaaguagaccaauacuaucaugcuaaacuucaauggaacaacugccggcuagaguaaggcagguuuauuuuauuuuaacuuuuuaaaacuuuuauuuuaaguucagggguguaagugcaggucuguuccauaggaaacuugugucaugggcauuuguuauacagauuauuucauuacccaaguauuaagccuaguacccauuaguuauuuuuaaugacugucucccuccucccacucuccacccucuaauaggccccaguguguguuguuccccucuauguauccauguguucucaucauuuagcucccacuuauaagugagaacaugcaguauuuaguuuucuguuccugaguuaguuugcuaagcauaauggccuccagcuccauccaugucccugcaaaggacaugaucucauuuuuuuuauggcugcauaguauuccauggugucuauguaccacauuuuuuuuuuauccagucuaucauugaugggcauuuagguugauuccauccuuguuuugugccaguuuucaaggggaaugcuuccagcuuuugcccauucaguauaauguuagcuguaaguuugucauagauggcuuuuauuauuuugagguguguuccuuuaauaccuuguuuguugagaguuuugaucaugaguggauguugcauuuuauugaaagacuuuuugcaucuauugagauaagcaagugcuuuuguuuaugugaugaaucacauuuauugauuuacaucuguugagccaaacuugcauccugaggauaaagccuacuugaucaugguagauaagcuuuuugaugugcugcugaauucaguuugccaggauuuugcugaggauauuuguaucauauuuguucaucaaggauacuggcccaaaguuuuuuuguuguuguaucucugccagguuuugguaucaggauuauucuggccucauagaaugggucagagaggagucccuccaccuaaauuuuuuggaacauuuucaguaggaaugguaucagcucuucuuuuuacauuuggcagaauucagccaugaauucaucugguccugggcuuuuuuagggggugguaagcuauuauuacugccucaauuucagaacucuuuauuggucuguucagggauuuuauuucuuccugguucagucuugggaggauguauguguucaguaauuuauccauuuauucuagauuuucuaguuuaugugcacagaagcauucauaauauucucugaugggauccuugugacugaauuguucugcaucaugacuguguuguguacuaccauguccagcuaguuuuuaauuuuuuuguagagaugggguuucuauguguugcccaggcuggucgugaacucuuggccucaagugauucucccacuugucaccccaaaguccugggacuauaggugugagucaucacaccuggccuuuucauauccuugauaauaggauagguuagagggucuuuuuuuuuuuuuuuuucuuuucacagacaugaucuccugaaaaacacaacacuuaaugaagauucaaccauacuuuugucugcuuauaaugauggaaggucauagaaggaaaagggagcuagauuuguagaauucauugugguguuugauauauuaauaauaaauuaaaauaacauuuuuaaacacuccuaacuuuaaaguauuucuuuaaaguaucacuuugaagugaucuuccuauuuuugguugucuccauuguggcaauuguuguggcaccaugagguuucagaaggagcagaaaaacauuccuaaagcauguuguaugagccuccucuauucuacagauguuuguuaagggauggcgcuggccacccuaucucagaccuccuaccgugaaugguucugcaaauauggugggacagccccaggaagauugcuuugagaagucaggaaugucuagugaaucaauggaauauuauuuuggguacuaaagaggcuagguacgugcagcacaaugucugcacuuagaacauaacuaaucaauguucauuugccuucauccacccauuccucuagcugucauagcuccuuuuacuuucacacacaggaaagggagaaauccacugucaaaacccaaacaacuuugagcuuuuuaugccaagaagggauagaucaauguuacuuacauaaaugaguccacaagugccuaugaauuuuuuauugaaagaauauaauucuauuuaaucagaauuuuuaaaauaaauugguuuuguguaauuuugggggagggguggggagaacagggucucacucuguugcccaggcuggacugcaguggcacaaccacugcucacggcagccucguccuccuaggcucaaacgauccucccaccucagccuccugaguagcugagacaauaggcaugugccaccacaccuagcuaauuuuuaauuuuuuuguagaggcggggucuugccaugcugcccaggcuggucuagaauuccugggcucaagcaauuauucaucuuuggcauccuaaaauguuaggauuacaagugugagccaccacaccuggccugucauguguaaucuuuauuuagguaguugaccacuucagcauucuagguacaauaacguuagcccuuuucccauugcaauugauccagcuuucauaauaggacccucugggacccaaguucaugcaucaguggcugguuucagggagagguuuacuucaguggcuguuaauacagaccaaaggcaaguaaaagacagauuuugcucuacacaugcauuaauguauaagcagcauuuauguauacauuuauuuuuacuuuacaaaagauaaaauuaacguguuuuuuucaugauccaaaauuguauuuuuaaacagauacuaucuucauuuacugauaaagaacucuuagcguaugcaaaagcuggagcaguagcugaagaggucuuggcagcaauuagaacugugauugcauuuggaggacaaaagaaagaacuugaaagguuugaguuucuuuuuuaaauggauagauauguuaaauucugucuucucaaaugcccuucagauugacaguguuauuuauaagcauuuucucccauauauauguuuucuuaaauagcuuaauggauguauuacagcauaacuaauauuuuggagaaguugcaauucuaauuguacuuuucuuuuaucugcuaauucaaagaguuuucuagaugggcaauaacauaaaaauaguuuccaaagacugaaauguauuuuauaccucugauuuuuuuccucuaucaaguuaauuagugauucucuaauauugacugaguauuuuguguaagaucuauggggacauuuuaauccgugguucauuuuccuuucugccccuauucagcugacauaugcuacaugauuuggaagauaaaaauauaaccaaaaagcacuuauguguacaaaaguucaaaaucuuuuauauuauguguuguuuaguauuaugcuuacaacuguucccuuuuauuagauuucugaaagcauagaugguaauuuauugaaauuuagaauauaaaucagauuacugauuucuaagcagcaacagauuuuauguaaaauugaauauaaauuauaauauucugaugcuauaacacuucaaucuuaugaauauaaauaucuuugaagguaugaaaaaguaaacuguauugguuaaggggguuauacauuguuugguacagccaugaagaaaaccaagggaauuuucagaaaucagaauaaugguuagcucuagggaagaugagaaguuguguaaggagagccgaacacacagcaggggauucugugguucuggcaguguucuguuucuugaucucagguauacuuacaugaguauucauugcauaauuuuuuuaacugugcauauguguuuggaguacuuuuguucuaugguauauucacacauauaaauauaugucuucugagaauaauuuauaaugguuaagugccauaguucaaaggaaagcaauaucuauguuccauuuugauuuuugcuaaagucuuugcuuuugcuuuaaaagaugucuggcuaauaaaaugaggaguccugcuuaaugacugagcaaauauucaaugaaauaaauccccggcucucauggagcuuaaauucuaaugggggugguaagguuacagacaaccacaaauaaucaaauagguaauacaccaguugggguaaauauuauuuggggaaauaaaauaagagaaucaugaggauacuauuuagauaaguuauucagaaaaauauuuucugauuaguugauauuugagcagagacauaaugaaguuuugaguuuggaauucuuuuccaguuuuccucagagaaaagguggaccagaaaaauaauaugcccaacagcccaacagcauuggaagacagacaaaacuuaacagcuucuuccugguuucucagcuggaggaaaacaucuccccauagaaguuagauucucaggccugacugcuaucugcagauggggucugaauuuauacuacucugugaaguaggaaacaaucucucuccaaagcugaggauuucacauuaaaaaugaguccuaauccagugauaccagaguaucugguagaagaaauacaaaauuauugaaaauuaaagaacuaaacaucuaaaucaagaaguuagggaaagaaaaauaaaauauuagaaggaaauaauaaggguaagagcaaaaauuaauuuaauagaaaauaaaggcaaaagaguggaagauugacauauccauaaacuaauucuuuaaaaagacuuauaaauaacuauuuuauauguuuaaucaggaacaaaaaaagaaugaauagggaaaacuuguaacagauuaaaaaaucuauuuuuaaauugcagcuuuauaccaauaaauuuaaaaacccucaugauauagauaauaugcuagaaaaauguagguuaaaacucucacuuaagaaggagaagaucugaguaaacccauaaucguuaaaauaauugaauucaaaguuaaaaaucuccauuuuccacugcuucucucccacaagcagaaaucacaaaacaagucuggauaauuuuguaggcaaguucuaccacaacuucaagaaagagauaacccuaucuuacauaaauuguuguagaaaauggaaaaaaaaaguugugaguucauuuuauggggcuaguguaacuuugauacuauauuaccaggcagauauaauaugagaaaggaaaacuaaaggacaguuucaccuaaaacauagaugcagaaauuauaaauaaauaaauaauuagcuaaauaaauccaugugaaaaauaccaaauugaaaacauccugaacauguuggcuuuauccuaugaauggaaagaugguuuuaacauuaggaaaucuauuaauauaauuaaccauauuaauagacuaaaagaaaaaauuuguugugauguaaggggaaaagcaugaauuauauaugauucaugacaaaaacucguaaaacuaggaauaagaaacaaccuucuuaauauauuagagacccgcaggaaacauuuaguggugaaacauuaaaaauauuuuaacacuuaaaauaaugaaugaaauaaauacauacuauuuugucugucaauuuaaaaaauaaaaaacaaauaaugaaugaggcaaauguguuuacuaucauuucuauguacuguuguacuaguacuagauaauaagaccaauaaaacaaauaagaguaagaaugaaaaaaagaaaacgaaaaagaaaaacaguaaguauuggaaaauaggaagaaaacugucguuauucacagacgauaagauugucuacacagaaauuccaguagguuuuauaagcuaacaaaauacaauaagaucucuggguaccuaucauuauucagaauaaauggcauuccuguaaaccaggaaugaacaauuagaaaauauauaguauuucauccauucagaaugaauccaucaucucugaaauggaaauaaaccuaacagucagugccaucuuaaauuugcuauggaucuggauugaaguccaauucuaucaggcaggauuuauguuugcuucugcuauucaccaagggcacugcuaaccugagaccaccuuacauuaaauuaugugucuaguuguuuuuggacaacacugguagugugaauucaugcucagaccugcaugaguccuacuuugugguccagauucucagggagguuuuuuuccuuccuucaccugguuggugccaagacugagacaugcaaguucugcuguguguugcuuaauauacugagguauagcccuuugaguccuagcugcauauggaauguucuauuaaacucauuucuuaaugcuuuauaaaaugacagaauaccaguacuugcuacaauuaaagacaucuuaaauuugaggaacugacaauauuuuuaaggacauuauuagcaacaaaaacuauaaugauggauggaauaaaaccugagaaggaggaaauggacauugugggagugaagcccaacauuuguaacuuagauaaaucugauauuuuaguucacugaaaguuuaaagggauucagauuuaauggagugcuuuaauuaguuagauaugaaaauauuuuuccuagcaaaaaugaucaaauuuuaauuagaagaauaaacaaauggacuuacacagcuauauccagagauuccuauauuugcucuaaguaguauuuuacauguggaaucauuucuucagaaaauauaaguuacuugaauguaucuuugaaagggcagucuccuucagagaacugaaacuaauuuugcuuggagaucaagaauugacguaagacuacaaacugauggccuaauguccuucccaaguuggccauuucuuuaaaguuuauuuauuugacaaauuuauucagcaccuacaacaugccaggcacugugcuagguucuagguuuuccuuuucuuuucuuuuuuauuuuauaaaguucuaaacaaagcuagggcucuagguuuucagcugugaaucagaaacagagguuauuuugugaucuucagucaaaauaguaaaauggauaaaaauggaaggaauggagaaagggaggaagaaauauaaggaaucgucaaagaaaaaaauaaaaauauugauuuaaaaaugugaucugaaagaaucaaagagugugaggaugaugaauggucaaguuaacuuuaaauacggugguuggggcaggccucuuugaggagguuucaucucagcugagaccugagggaugagaaaaagcaagccauggugggaacagagaugggauggguuugaagaagagucuuccaaguuuccugggguggccaagaauuuaguauguucuaggaaacgucauaaggcuugcaugacugaagcucaguugaaugaggggagauuggggugggcaggggccagaauguggggaugaugggccaugaugaagaguuaggauuguauucuaagggcacaggggagugguugaggguguuaaaaagaggaaugacuauccacguuauguuuucagauuguuugucuguaaugggucucaugaauggaugcgagaagucaaaggguggaagcagggagaccaguggggaggccggcagaaugguccaggccagagcaucucccugaucuggagcagaggcaggagaggggugacagguaccuagauuugggauauaacuugaaaguagaauugaugacuauucuuagaccagacauaaucaguuuucuuuccuguucuucuccuucccuucucugcuucuacauaaaguaauugaggucuuaaucuggcuuucucuucaaauuagcagugcaggagggaagcuggcucucuuugaauggaaauuuaaccagaaguuaaaauaaauuccauucaaucguauagaauaguuuuguuccuuuucacuuaaaaauauuuuucucucuuuuaugugccuugaaaauauauuuaucuauuaauauuuauuucuguuggcuuaaccaaaauuguuccuuauucuuaaaguaguuacuugcauuauugauaaauauuuucacaauauuuaagaagagucauauuuccuacauaccaaugguuuuguuauauaacuuuagucucuuuuagucauuccuacuuucaugaccauuucuguacuaaagccuuugaugaauggaugauuuuaauaucuaguuuuauguauggcauuuguauggaaaaacaacaaagagcuuauggaaaaggaguauuguuuauaucucauuucccuuugcccccuucuuuccuuuauuucuccuuucugaugucuaaaugauuuucuuccuugugcuucugugcaaauguuuccucuggcugcauaggacaacaucagacugguuucuacguuagucuugguaagcgagaacugaaauaaaggagauaacagaguauaguacauauguauuaaauguccuuaaauauauucuuauguaaguuaugcccagugguagcuuuuaccucagaucaacucauaaagugagagauauguaugugucuguguguugugugugugugcauauguguauauaaauaauugaaacguuucucaaaaauaauuuuucuguucagaugauaacuggcaaguugaggauuuacauuuugggggguagaaacuaaugauguguugcuauguugucacuaugaaguucuguuuaaauuucaucuuuagugaacacgguagugauguaaauuucacuuggcaugcuuuuguaacucuguaauguaccuaguuaaaguagucaugaaagcaagaaacaaugcauguucauaucuggacagugcuugagcucugcuguacaugcuaauggaacaaguucuccaaaggaaauuaauauaaugcuauauaauauuuauauaguugugaauuuauggaucaaagaccuuaaaguaugacuuuuauauggaaguaaguucaugaauuucaacaauuauuagcuccuccucuauccaaggcaaugcucuagguucugcagggaguugcgauuaagaaaauacagacagauuuaaggcaaucuguccuguuucucuaauccuuuuaccuugguucuacauuugcaaaauuccuuauuuuucuuuaacucugggcuccauuagcuuaucuccauagcuauccucuuaaacagaguagucuucucuguuccuuucaaaugaaggucgaguuauagacaucaucuccuuuaacuuuaccgucaaaaauugaccacccucugaggguuuaaaaaauauuugaauuaucaguugggaauaaccuguaagucauuagaacugcagaaauaaaaucugucagugacuccaacauuguuuuucgauuuuuuuucauuugcucauuuuugccccuuuuguacaauuuccuauauuugcucuaagaaguauuaauggguccucaccagguuugguuaauguaggguaggccuuugugcuaugaauggguucagggcuauagauaugcuaauaauuuaauuuuucucagcccuugaguuagucagaagccguggauggcccaagccaccaggucagauccuguuaguucagcagcuggcagcuauggcaugacaaguguugggagcauuaauagagggaaggacacauagucaauauguagaaaggagaaggaagagagggaaugcugaugaauaaugaugugcuuuuauaaaccuguaagccaaauaauuuuuguaggucagugauuuuuaaaauaaaugucuacggaaguaagauaaauuguacagcuuauuuaaauguaaaaaguauuacauggcaauucagaacucucaaaaugcucucacacauguaaccucucaguuggucauuccgacaguccuagaggaaggcaggacagagagcaaacugucuccaaacuuccuuaauguucagagauuuaaaugacugucccuuuuuuuuuuuuuuaguacuuucuaacauuaucucuccauuuuauuaauuaaagaggcaugcagauuuugaaggaaagacacagguuuuuuccauggcuuuuacuuugucuuguguaugaaacaauguaaguuuuagaaguuugcuaaauauugcuucacuuauuugcuauugcuaaagccagagaaggaaauuuuagaagacucccccacaaauaaguuaaucucuauaaaugucaguuucuucuucugcaaaaagggaguaaaacaguacuacuauauagggucaauguaugagcagcaggacaaaaugcauguauaucacaggacugaacacauccuagccacucuguaacuaucaugcuauaucgacauguuuucauaaaauguauaugugaucauuuuuguucuuuuucucagguacaacaaaaauuuagaagaagcuaaaagaauugggauaaagaaagcuauuacagccaauauuucuauaggugcugcuuuccugcugaucuaugcaucuuaugcucuggccuucugguaugggaccaccuugguccucucaggggaauauucuauuggacaaguacucacuguaagugguuuacauugagaaaugaaccauuauuauaaaaugccaaugaaauccaguaauguuggcuugacuuuagaagaauauauuuugaacaacuguugaauacuacagacauaugcacuacuagguuaaaaaguggaaggccaggcacgguggcucacaccuguaaucccagcacuuugggaggccgaggcaggcagaucacgaggucaggagaucgagaccauccuggcuaacauggugaaaccccgucucuacaaaaaauacaaaaaauuagccgggcgugguggcgggcgccuguagucccagcuacucaggaggcugaggcaagagaauggcguuaacccgggaggcggagcuugcagugaccugagauugcgccacugcaccgcagccugggugacacagcaagacugucucaaaaaaaaaaaaaaaaaaaaaaaguggaaaaaaauuagaugcauccgacaaccaguuuuuucuuuuauuugcuuguuuguuuuugcagauaucuugcacaauuuauccuguagccuaaauaauauuaacguuagcaaucucaauagcaugaacuuuuauuuguugagauuauuugugccaaacuuguugcuaaacacuucacuuuuauuuucugauuuacuauucacaaaaauggcaaaauacacauuuugacuucuuuucaaauuauuucgaauggcagcuaauccaccucacaaauuauggaaguauaaauuguuccucuuccuaaaagauuguuuggaaguuuucugcauuauagaccuuugugcaagcacagaagucuugccauuuaauguuauccucuuuuauuuuaaagacaaugaaauaauuugcaaaccaaacucaauucauaucuggaucuaauaaaauacacuguuagaagagucacuuaguuccuuuuucguaggccaagcagaaauagauugaggcaaugagagaugauauuuuguagaaucccuuaaaacaauucccuuuuucaggagccagauuuguaauauggauucaauaaucacuucuuuuucuuuuuuuuucaaauuugccuuauccaacauugcucaguggggaauggcuuuucccaugaaguuuuuuuuuuuuaguauagugaugcugugggugauccuugguugucauaacagauguuuucuguuuaacugugauugagauaagcaguuuaaauccaguguucacugggcaugaauauacuucacacacuggaggcauccaaaauagggagugugggguuugauaucggaccaacuugauucaaauggcagcuuugucacuuauuagcuguaugauuuagggcagccagcuaaacuuuucaagccucugcuaccucuucugccaaaugauaugacaggaaugaacccuaacuuucagcguguuuugaggacuaacugagauaaugaauauagaaucacuuagcaaaguuccuucuguguaaauuauugagcaauauaauuccaugugauuuagaaaaaaugaauaaugacauuaauucucaucaaccccaaagagaaacacaguuaagucuuuaccaauaagaaacugauuugcacaaaacaaaaaaacaaaaggccuaaagagaacacggccuuguggcaaaaaagacaaccugauaaaggaucagugucuuaggugugugugcuuuauaauuaacaaaaaauguucauauacacuguuuuaucaugauacaacaucucuaugauugcuggguagggagaacagauagaaucuugccuguuuuugccaaugaagaaauugaagccaaagauucuaagagaauggccuaacaacauauaacuaguuauuacuaauuuaggauucagaacugggucuucugacuccucugcuagcauuuauuuccacuuuaccuuacugaugaucuaaauaaaaaaaaaacuagacauugaagaaauauaaaaauauccuauuauaauauucuagcccugugaaauuuaaaucauuguuuauugagcaaguaagacuaauucugcauucuaaauugaaaaguauuuauauuuccaaaauauuuuuaguaugggcaacauagugagaucucaucucuauaauuuuuuuuuuuaauuagccagauaugguggcacuugucuguagucccagcuacuucggagacugaggugagaggguugucugaacccagagguugaaguugcagugagccaagauugcaccacugcaguccaggcugggcaacaaagcaagaccuugucuuaaaauuuuuuuaaaaaaauuuuaugcuauuuuuaauugacaaaucauaauugcauuacacuuacggaauacaaugugauguuuauguauacacacacauacacacaaaauguggagugaucagagcaagcuaauuaacauaucuaucuccucacuugacaccuuuugaggugacacauuugaaauuuacucuuggcugggugugguggcccaugccugugaucccagcacuuuugcaggcugaggcaggaggauugcuugaggccaggagaccaggcugggacacguagcgagacccugucucuagaaaaaauaaaaaaaauuagucaggugugauggugcaugcuuguaguccuagcuacuugggagacugaggcaggaggauugcuugagcccaggagguagagguuaugacgagcuaugauugcaccacugcacuccauccugggugacagaaugagaaccugucucuuaaaaaggaaaaaaaaugaaaaaaggaauuaaauguacuguuaguuacaaacuuuuaaaauauuuuuaacaccuaguauuuauauguugccucgccauuuuaaauuuuaauuaccuauguuagaaaaagacagaagaaguaugaaaaaaaauugcugucacuaucucaguagccugaugguuuuucuucacauuccucagguauucuuuucuguauuaauuggggcuuuuaguguuggacaggcaucuccaagcauugaagcauuugcaaaugcaagaggagcagcuuaugaaaucuucaagauaauugauaauguaagucugaguuggccaucuauccaccuaucuaaaagauuguccaguuaagucaauuucuuugucacuuuauccagcucuccacaaaauaucacuaaaaguaguuauuguaaccuaguaaucucuuaaaauuugauucuguuuagaagccaaguauugacagcuauucgaagagugggcacaaaccagauaauauuaagggaaauuuggaauucagaaauguucacuucaguuacccaucucgaaaagaaguuaagguacagugauaaaugauuaaucaacaauuaaucuauugaaugaagaguuucugauguuuucuuguagagauuauaaaaaagugcauguauauuuaaaccuagugaacagucaguuccuauauccugugucugugaauugccuugaaguuuuuuucucacucguccugguagaucuugaagggucugaaccugaaggugcagagugggcagacgguggcccugguuggaaacaguggcugugggaagagcacaacaguccagcugaugcagaggcucuaugaccccacagaggggauggugagaugacccaugcgagcuagacccugcggugaucagcagucacauugcacaucuuucugauguugcccuuucaauuacaaauguaugaaagucacacuuacuuuuuauuccaggucaguguugauggacaggauauuaggaccauaaauguaagguuucuacgggaaaucauugguguggugagucaggaaccuguauuguuugccaccacgauagcugaaaacauucgcuauggccgugaaaaugucaccauggaugagauugagaaagcugucaaggaagccaaugccuaugacuuuaucaugaaacugccucauguaaguuguccuugcccuuugccuuucuagaggugcaaaaaauaaaaugcaggccuacuaugcaggaaguuaggaaacuacuauaaaucggaagaagggaaauccuaagaagggaaaguaagauuacuucagauuugaaagcucuagcaguaucaacuggucguagauacauuuuuaaaaacugagguugguuauuguguuaaauaagauuuaaagaacuggaccuguauuacuugugagacuugggcuguguauaggauuccuuaccaauuuaaaauaugagcugagauagcuuguccuuaugcuaaaucauucuggguuuucugugguagaaauuugacacccugguuggagagagaggggcccaguugaguggugggcagaagcagaggaucgccauugcacgugcccugguucgcaaccccaagauccuccugcuggaugaggccacgucagccuuggacacagaaagcgaagcagugguucagguggcucuggauaaggucagugaggcuuaguucaaaccaaccugauuuauaagcauaagaacauucuacuacuaauucuuguuaauauuggucuuagaaaaggaaauuucugauagcuucuaggugauuccuucagcuauuaaaauaaaagcauugggccucuuugaaaucuuuuucuauuuguuuguuuuauuguucaauuucuauuuauuucucugaucuuauuuuaaauguugaugaauacauuuucauuugaagacacuugcuaaucuuuuaaauuaaaaaauagaaauauagacacaugugaaaguucaucuucauugugaucuucaaaacuugacuauguggauaacccuguuauuuagguuuugagaguuuguaauauugccaagaagagaaaaauacaaccugaagguccauauauaauuuuccagguguugaaugccacuugaagacucuaugcgaaauaagaaaccucuuauuuccaggaaaggggcagauagccugugauacugaaaaccuaccuaagccaugacagguuauugacuaucaacagaguuugacuguccugcaauucuggaguccauaugacucauucaccaaauagcauuugaguguuugccgugugccgggcacugugccuuugaucuccagcacgugauaguaacggggauaauucugugaggaccgagaauguggagauggagacauuauaaccaaagguguuccaaguugagaugucacaguagaauucaaagaugaacucauauuuguuucaacucucccugucucuaauaaaacaacacuugaauguuccuuaacauccugucaaugugcuuaauaaauuuuugagagagaaaaaaagcagcuuacuaaacauucugugaaccaaaauagaggccgaugggauucugguuacuauuuuuccccucauuuugcuuaaucugugauuucaucucuguguuuuucuuuuucuuucuuuauuuccuuccuuccuuccuucccucccucccucaaucccucccucucuugcucuuccucuuccuuuccuuucuuuccuuuccuuuccugaccuucccuuccuuucauuuccuuucccuucccuucccuuucuuucccuucccuucccuuccuuucccuucccuucccuuccuuucccuucccuucccuuccuuucccuucccuucccuuccuuucccuccccuucccuucccuccccuucccuucccuccccuucccuccccucccauccccuccccucccuuuucuuuucuuuuuucucuucucuucucuuccucuccucuccugucuuuucuuuucuuaucuuaucuuaucuuuucuuuucuuguuucuuuucucacucugucaccaggcugaagugcaguugugccaucauggccacuacaaccucugcugcccagucucaagugauccucccaccucagccucacaaguagcugggaccacaggugugugccaccaugccaagguuuuuuuuuuuuuuuuuuuuuugagauggagucucgcucugucgcccaggcuggagugcagugggacaaucuuggcucacugcaaccucugccuccugccucagccuccugaguagcuaggauuacaggcaugcaccgccacaccuggcuaauuuuuguauuuuuaguaaagacaggguuucgucauguggcccacgcuggucuugaacuccugaccucaggugauccaccugccucggccucccaaagugcugggauuacacgcgugagcuaccgugcccagcccccagcuauuuuuugauauauuuguagagaugaggucucacuaucuugccccgacuggucucagacuccugggcucaagcaauccucccgccucagccucccaaagugcuggaauuacaggagugagccacugcuuacugguuugcuuaucuguguuuccuuauuaaucuauagugaaacuauguauuaaauuauaaauaaaaacaauuuuaaaagguuauauuuuaaaauacuuuaggguguaaauuuugaggggaaauuccacauaccccuuuuuucuuaaaaagauacaaaaauugaucuauuuucuucuguauuuucuaguuucuaccaccuaauuuuuccuuguguauuuuuucuuuuugaaguuuuccacuucuacuuauccuauggauccugaaaauguuguguguugguuuugagaauuguauugcuaguuauuagagagacauauagaguaacaaaaauuaugagcauugggaaaguuacaaagguuagagaagucucagacaaggccuggauaucuggcucuguuccuuuaugaaaauaaaagagacuuacgugacucuucaauuuuuccauaauucuucaaccuaggaauaaguaucacuaacuauggauaaggcacaguguugaguacuuuaugugcuuuauuuuauuuagucaucacaacuacucuaagaaguaaauacuauuauuauccccauuuuacauaugaauaaauugagucucacacaguuuccuuggauaaaauauuuuauuggauaaaauaaauucauaaauuuauuucaggucagugugacauugaggucuggacuuugcugccucacauuuauugucugucuuguucauccagggggucaugcgggauaggauauuauaauuccuagggcugauuacuagccgguguguaucaguacagcacaauggccuguguuuguuuugauuggccaacgccuggucuguaggaauuuguugguuuguacaagccccugauuauuauuauuuuuuuauuuuuuauuuuuuuuuuuugagauggagucucacucugucacccaggcuggagugcaguggugcgaucuuggcucacugcaagcuccaccucccaaguagcggggacuacaggcacccgccaccaugcccagcuaauuuuuuguauuuuuaguagagaugggguuucacuguguuagccaggauggucuugaucuccugaccuugugauccacccaccuuggccucccaaagugcugggauuacaggcgugagccaccacgcccggcccaagccccugauuauuacugcaaauuuagguuaaauaaaauauuugggggcuuacauaauauuaauaugugacuguuauauuuguguuuguauuuauuacaaggaaacaucauuuuuaacuauuaucaauugucuauacauuuauugaagucagaggcuaucuuauauagauuugaugguuuuacaaugcccacagcauugguucaguaaauauauguugaaugguuaaguuucuucagguaauuguuaauguauucaaaaaccaaauuucucucucuuuaggccagaaaaggucggaccaccauugugauagcucaucguuugucuacaguucguaaugcugacgucaucgcugguuucgaugauggagucauuguggagaaaggaaaucaugaugaacucaugaaagagaaaggcauuuacuucaaacuugucacaaugcagguauaguuuaacuucagaauuuuccuaagucaucucagugauaaacugauuuugcauuuaaugcuaaaaauaaauauuauuugauuugauuaccuuacaaaguaggaaacaacaccugggggauucaggaugagaccaguguuuaagauuuuuuuucucucuugaaagaggggaaaauaaagaaggauaaacagauaaaaaaauuaaaagguuucaaggugaguuauccguuauaguagucaguagccacaugugucuguacagcauuuaaaugguagugaaucugaauuggaauguuuuaaguagagugugcacaucuuguucugaagacuuaguacaaaaaaugcaaaauaucucaauuuuuauauugauuacauguugaaacgauaucaugggauaucaauaauauauuggauauauuaggugaaauaaaauauauaacuaaaauuaauuucacuucuuucuuuuuacauuuguuaacauggcuucuagaaaauuuaaaauaacauggcucauagcauggcuugugccauauuucuguugaaagcacugauccagaguaaacuugauugagucaaaacacccacaaaaaauggcgugagaagauaagauacauggaaugaaugccagauuauuucaguauaugcagugggaauucuucuuuggugguuuucguuuucaaauaucacacacacacacagacacacacagacacacauaaaacaacacagcagauuagcuuuauccuuuucugcaguuacuaaacaaauugcuguuuuccuugauagcugacauucagugauuagcuuucauugguuaacacacagccuaaugagcuuuugcauauuucuuauuuauuuuagacagcaggaaaugaaguugaauuagaaaaugcagcugaugaauccaaaagugaaauugaugccuuggaaaugucuucaaaugauucaagauccagucuaauaagaaaaagaucaacucguaggaguguccguggaucacaagcccaagacagaaagcuuaguaccaaagaggcucugguaugaagggagaugcggaguuuguuuuaaucucacuaacugugguucccuaguuuggugggcuagggcuacaguaggagugggaacaagagagguuauccagaauccuccuguccuaucccccagaaugucaacauuuuagaaucagguuagaauuuaaaaguauuaauuuacacagcagaauuuuuagaauuaaaauuuauaguguaaagagacuauagcgggucuucaaauaucaaaauuuccauucuguuuacuccugcuuauaaauacucuugucagguucugaguaccaaauaaaaguaaguguuuguggaaacaucauuuauuuuuuaaaaaauaaaggaguauuguagcaaaauuugucaacauuuuuuugaagcuaaauaauaaucacuaugacauuuuuuaaagcaaaauugucaucacuuauucauugauaaggaauaaggauaggauauauuccuuuacuaauuuuugugcguauguaagaauuguacauauaaaaguuuuuaacuagccuguuguaauaauuuguguuuucuaggaugaaaguauaccuccaguuuccuuuuggaggauuaugaagcuaaauuuaacugaauggccuuauuuuguuguugguguauuuugugccauuauaaauggaggccugcaaccagcauuugcaauaauauuuucaaagauuauagggguaagugugaugcccauuugugugauuuacuugugaauccugauggaagaaugaacgaauaaagugcuugugucugaacugggauacaaaaacaacaaaauccacguaucuccauaugaaacuaauuggcuugaagauguaagaauagcagucugguuugugauaggagagcuaacuuugugaaccuuccuuugucaucacaguugguuucuaaccugggcaacuaaagaccagcuuccugaaauagucaaugaaagugaugagaugacuuucucauaccugccaacauuuggcucugaacaaaucuugugaacuuucauuucaccaaugugcaaagagaguuccucaaauguuugucaggcuggcuugagaaugcacuguucucuaacauacauacuuuccaggaugugaguaagccuagcaugcuucuuuuguaagauguaauuuucaucccacuugcuaagauuaaaacaaauaggaacggcuuccuaaagauugagguugacauguguuaguuccaccucaucuuaaugguggcauuuucaacaguaaaguuacaaucugaaaggaaugcucucuguuuagugacauauguccaaacaucaagcugaggacacccuugccauaacugcugaaaacauuguggagaaagagauugaucaccacaagaagcauaagcuaaacacugacuuuugauucuacaaaauauauaugacuauucaggucuacucaugccugguuagcuuauuucaguuuaauauauucauucaugaauucauguuuaaugacauucaugcuuaauauuaaauauauuuauucaagaauuguuauuauuuuuugagucucgcucacucucgcccaggcuagagugcaguggugcgaacucggcucacugcagccucugccuccuggguucaagcgauucuccugccucagccuccuguguagcugggauuauaggccugcaccaccaugccuggcuaauuuuuguauuuuuaguagagauaggacuucaccauguuggccaggguggucuugaacuccuaaccucaaguaauccaccuacuggcaugagcugccaugccuggccucuagaauuauuuuuugugucugcucugugccagguauuuuucuaguuguugaaaaaauuccgagaaugugaucaaaugucugauucuguagaguauaugguccagggcaggagucagcaaacuuuuucuauuaacaguaagaugguaaauauuuuaggcuuugcaugccacaugauuucuguugcagauacucaacucugaccuaguaguacacaacagcaauguggaaaugaaugaacacgacuguguuccauuaaaacuuuauauaaacauuuggccaguggcccauaguuugcugauucuugcacuaacaugugucuugcagguuuuggggguuggcggggguagacuguggugucaucagagaaaaaaaaaaaaaggaaaugguuaaguuaggaauggguuugguuguaacaaaaccucaacuuaugauuuuauacuuuucucauucuucauaugacaauaagucuggagguaagugacccagggcugggauauuagcucuuagauauugaguaggcaaccagacaucugccucauugaagauagugggcucugcaucggauugccuggauuuauauccuugagucaucccuugcuggcuguguuaacuugagcaaauuaauuaccuucucuguacuucaguuucuaucuguguaaaaccgugaugauaauaaaucauacuucuggagauaguugccaggauuagaggaauaguauauaugaauuugcuuagaauaaugccuggcauagaguaagaauuugguaauuguuaugauuuuuguuggacugacuagucaaaaaaaauuauuuaaucucuucaaaaauccuuguuguuguuguuauuuguuuguuuuuuuaugaaggauaaaguugucuguccugggcuaggaauguuacuaucuuacaagacugauuuuggcccacugugaagggagauacguguuuucuuucccugaggaaugguuauccucuguguuccuugaguccaaaacauccuauuagcccuuauaacuaucucuggaaaaaauuucagguauggugcuaggucagguagcuguaguuuccaacuggcucucuuaacuggccauccuaccaagaaggcaggcucaaggaaauuccuuucuuuuugaaaggccugggcugagugaaugaccaccacucugugguucaccaaaaaaccacaucagguuuuccccagacaccuugggacaguuugaaauguccaaauaguaaagcaaugaacugccauaaauguaguuccccaccaagggaagaggagaguauuuguucugauuucaacuuuacacaguugagguggcacucaugacuccaagagggaauccgaacagaaaaaauacuggaucaauuuaugaaugauagaccuauccuuggccuccacagaagggagaaugcagacaccuuuaaggcuggcaauaggaaagccaaccccaauuuccagcguacuaaggcucuccugaccccugaauacugggccagaugggaaaugggucagguccaggauggguucuucacugauugaacuaaaaauccuuuaaauguuuucucacagguuuuuacaagaauugaugauccugaaacaaaacgacagaauaguaacuuguuuucacuauuguuucuagcccuuggaauuauuucuuuuauuacauuuuuccuucagguaaauguuuccauuuucacuauauucauuuugagaaaugcaucauuauucaacuggggggauuuauaaacaucaguguaauuggccuuuuaguagaacuucucuauuaacauggcuacuaacagccaaguuuuucugacauagugaaaaaagauguuugccuccucuggcucccuugcuuaccuucuccucuccacccuuaccucccgcaaugaaaccagggggaacagaguauuuggccugauaugaugauuggaggugaaaggcagggacuucaaaauggggugugggggagcccuggauguaaguuuggauauaaguauugccaguaaauguaaauacucaaagaaaugucuucccguguucuaaaagcaacaacaaacaaacaaaaccccauaagcgggucacauggguuuaaaaaggguuugaagaguuuaucguucaacuuuuguucaaggagaaagaaucauuucagugauggaagaaugucaauccuccaacaaaaaauguaggaaacauuuguaaagagucagauuuuuacagcuugcaaaucauuuggcugaaaugaaauggcaaggaauuaaguacucuaaaaguuuaguaugagggccaggugugguggcuuaugccuguaaucccagcacuuugggaggccgaggugaguggaucaccugaggucaggaguuugagaccagacuggccaacauggcggaacucugucuccgcuaaaaauacaaaaauuaacagggcguggugauccacaccuguagucucagcuacucaguaggcugaagcaggaaaugucucaggaacccaggaggccaggaggaggagguugcugugagccaugaucgugccacugcacuccagccugggcaacagagugagucccugucucuaaauaaauaaauaaauaaauaaauacuguuugguauggcaagacaguauugguuuugguucaagugcuccuuguaccuguuucugauuuuguguccuugggcacauaaguaaacugucuaagccucuguuuccuuagcgguaaacuagggaugcagguaccugccucuugaugauuaaaaggaucaugugaccaagugcucaggccugcaugaggcaguaguagguaaucacuuauuaauugaaugauuagccaccuguaauuuuuaaagauaaaacugugacuagaucucuuuauuuaacauguaagcauguauuacauuuuuaaaaaauagaauauuuuucuggacauuauaagaggugcaaaagaaaaaacagacugaauucuuucuuuacugaguacuuacagccucacuggggaauuugaccuuacuagaauaaaugugacacucuaacuacuuauaggauugccauaccaacuauuaauaccacagguguuuggaggagguaaagauugcucaauguaaauuugguuaagaaaguuggagugaggugggcuuugagcuggucccuuaaauguugacgauuugaauuggugaagcaaaagaaguuagaggacuaccuucauaacauggugcuuggggggacuggaaccuagcuugccuagaaaacaggugagaacaaagucuaugaguuauaggaccuuagaagucuagagauagcaaaaugccuaaagauguuagaccacccaacuccucaucuuaguaacauggggagggaguccaguggguaauuaaaagcucaggcucuggauucccauucugguuaggauucucaugcaucuggauuaagauuccaacucugugaccuuauaacugugggcuauggaucuuaucaggcucucuaagccucaguuucuucuguaaagugggcuuuucugucuacaccacccguacagccuugugccauggcacacagucacagaaacauagcaagcccuugaaaucaggcuuucugacuuugucugaucuccugcuuuagcaaagacaucaauucucccuccuuuuauuuaaaugguggcugggucccugacaagguauguuccugcccacaggguuucacauuuggcaaagcuggagagauccucaccaagcggcuccgauacaugguuuuccgauccaugcucagacagguaugucuaucgagggcugugcccugggauguguagaacuccccaugugugccccuuggacucagacagugggagcucugucauguuucccaggccuagcuccuauauugguugucccucagucucacgucagagaugcgguugaaccgcccacuaggcacagaugaggcucuacugucugucaggucugggugggcacaaggaacuggaccaguuugagacagagccuccagcguggauucaccuccagccugugucucagcaguggugggcagugcaggcagaaggcaucuuugauaccccucaucccuuuccucucuuuccuucuuucuccuggcaaacccagggcacgaguguuucuucccaccaagagaugcccucuguacucuuucuuuccgcaaaucaaaacucaucccuguguccuguucuucacugcccauuuucuuuucugaggcuagucugaaauacuaguucaagcugcaguguuacuggcugauaauggguuuaauggaaugcuucucacauuuugcagcuucaaaacccuaaccauugacacgugugaauguuuuccuggggaaauggggaaggaaauuagaggaauguaacucagagcagccugguucaaaggggaaaguuccuuuaacaaucaugaaaauuuuguaugugaccuaauaacuuuccguuuuaaaaaucacuaaucacuugccauugaguaaaaugaugcuuuagaagucugccccagaugugccagggguacucgaacccuggcuaagaggcaucaguuugguguguuaggcuuucuagagggcauucacauuuuaccagcugucucugguuccucaguucuuccccauuccucccaucaccauuuagaaagaaaauguauuuaugggaauugcuagcuagugacugacagagccaggacugaaucuaagugagagagcacaguuugaugggaaacccuguccuuggacugucaggucgaacuguauuuauaagucagauuccacuuaggucuacacugaccuugcuccagggccaaauuucccauuacccaaccagccuccaggccaacugcugugcccauuauacuuuggcagcugagcugaugguuuguggaaugucuccuccauaaauuguuaaguagggcaagcauuuauuaagugccuucugcuuacaaggucuaguacuuaguauuguaaggcauucaaaccugaauggucccuguguucaaggaaguuacauuccuguguggagacacuuuuaaccacuuaagaauauugaaaagcaaguugauacauacuauaauaaauuauagcacuauuuuuucuuaaauauuuuugggaaaaaugauagauacuucuuuaauguaaauaaccaguuuagauaacuucuuagggaccacaguuauuuguaaaacauauaaauucauacuucaaauucacaaucauguuaguaucuguguauuuaaaaauauaaaugguuuuacaaagaaaaucuuauuuuauguugaauguuauauuuuaaucuggauuacuuuugcugauuuguuuuugacucaaaucacuuauacugcccugagcuacauuuaucuaacugcuuauucaaccucucuauuggaugucuaauaagaguuucacuguuuaacauuuccaaaauggagcuuuugacucuuccccuccccaccagccuuauuccuuacccacucuuccccuauaucaguaagcgacagcuccguucuacuaguuguuugggcuaaaaaccuugaagccaucuuugacucuucucuuucuguuaacauugcaaaagcuuccuaacugaucucccuaccuccauuuuuaucccaauccuguagauucaccuaaaaacagccacagucauuuuucuaaaauagaaaucaaaucauaucccacugcccaaaccugcugaaggcugccuguagcucacaggguaaagucuggaaucuugacagucgccuguaagaccauacacuauguggcccccacucucucucaaaucucaucuccuauaaccgccuuuuuccaauacaccgucuacuccauaaacaguggcucacugcccaagaguaggggaggggaggaucagaggagccaaaucagaacacaaaucuguccagaggaaggggguggcuuuuacaaauucauacaaagguucuuuuuaggcugcuggcagccuuuaaggcuuucuugcugguguaugaacagauuagguaugccuuugccucagggucuuugcacaugcuguuucugcuuucccugagguauucucauccuuuccuucauucaggccucuguucagauguccccuuagaaaggccuucuguuuccccuccccagucucuaaaauagcaccuccccucacuuuucuguucuucuuacccugcucaauuuuucuuuuauuuguaccuuccaucucuagaaucuaaacuucaugaaagcagcuacuuugucuuuuuuguucguacagguccaacacuuagaaaucaugcguaggagaaaguaggcacucagaaauuuuucugacaaaugaaaugaucuauuuauguguuuuuauauuaaguuucuuucuuguguauugaaugucacauccugaguacuaaaugcaggggguauaaguauaaacaaaacugaccccaucgcugcccucuuggagcugagagucucauaaacagcuuuaagguaauaaaaucauuuucugugccacaggaugugaguugguuugaugacccuaaaaacaccacuggagcauugacuaccaggcucgccaaugaugcugcucaaguuaaagggguacgugccuccuuucuacugguguuugucuuaauuggccauuuuggaccccagcaugaaacuaauuuucuccuuacggguguuaguuaucaucauuaagaaaauguugaauaaauaucuaaccuacgaauauaucacaugcuuuuuguagcaacauguuaacuauuuaaacauuauauacuguagagcauauagauaacuuauaaaccauuugcuauugcuguuauucaugcuauuaacaagaugcauguagaauaguuauuuagaaaagagaguauaaagugcucaaucaacauaaaacaguaauugcuacugaagaaaggauguauuuaauugcuguaagaaaguuuagagucacuaugguuacagaagggagggaagacaauccucuaaaauauagguugaaggaaaugaaaagcacauuaaaaaauuaaggcaagaauagaauaacuucagucuuuaucuuuaauaacuuuaaacuuuaauaauuuuaauaacuuaaauuuugcuacuguaugaaucucuugauauaacuagauacuauugaaccagcagguuuugauuuuuggcugaagugacaauuucuucuacaacuguuuauggcaaaaguccacaaaaugauguagaauuugaaaaaauucauguaaucucuggugugucuuuuccccucuugaaccuuauccaucuuuaucuuuaaaucuuuucuguaaguuaguacuauacuaacauuucuucuaucuaauauauggggcuucuuuaagaauaaauuaagcuauaaaugaggaaauacauagaguuauaacguugaaauauaaaccuuaggagucccucuuuuucuauuguuuggaauaguuucagaaggcauaguaccagcuccucuuaguaauuguuguuuuaauacaaacuucuuugccuaaagcaaacaaaacaauaaaaacaagguuuagaucaaguuguauagaauguaauuacaggugcacgccuguaaucccagcuacucgggaggcugagguacgagaauuacuugaacucaggagguggagguugcagagcugagauugcaccacugcacuccagccugggugacaaagcaagacuaugucucaaaaaaaaaaaaaaugcaaagaagacagaguggcuggaauaaagugagugaaaagaagagucauaaguguguuaaggucagcauuauauccagaaguagauggaaaaccacuguaggguuuugaacacagaagugacaugaucugaaauuuugaaaggaucacuauagaaacugugugaauaggccgaagggggcaagcauagaaggagucuguugcaguaauccaggaggagaugauaguguuuuagacuaauuugguuauacaaaaggcuauaagauauaauuaauucuggauauauuuuagauguacagccaacaauguguugguuggauaagaugauggauaugagagaaaggguauuuaaagaugacuccaaauucuuuuaccugcacaguggaaaaaaaaauggaguuuuuuuuuuuuuuuuuuuuuuuaaagagacagggucucucuuuguagcccaggccagacugcaguggcaugauuacagcucacuauaaccuagaacucaugggcucaagcaauccucccuucucagccuuccugguagcugggaccacaggugugcaccaccaugucgagcuaauuuuuaaauuuuuuguagagacagggucucccuauguugcccagucuggucuugaacuccugggcucaagugauccucccugccucagccucccaaaguguugagauuacaggugugagcugccaugcccagcuggaguugaucuuuaugaaauucagaagccuguuggagaagcaggcuugggggagaauggagaguucuguaugagacaugguaaguuugugacgucuguauuagacauccauauguagaugucaagaaggcugaaauuugcacugcuaacuuuaguaaaccuuuuuuauaauugguuuacuaaauaaguuuuacuaugcuucuccauucauuuugguccucacaacucuauagacuccuacucuguaggaggaauauacaugagacagugagcauuagucuuuggaauaaaggaacaguaaccagugcaaugugacauugcacaauaugacacagacccugugguaugggcucaugugcuuugauggacaaauaucccgcaucacauuugacguggaagacacaauccuggaggcaacucagucuuuugcagcagaacccagagcagauguauucagggcauucuguauugcaguuuuucuuccugccucucaaauuccucugguguuaugaccugccuuaggccacagugaguuccuauauuuguaaaauugguggucacuuuuucccuccauagugcuguuugugaggcccuuugccauauucacugucucuaauugccugcuggggucaaccuucugcuuuucacuuguuuccucaaagacaccucaaacuuggcccugccaagauggcugcacucaccuuauaugagccacucaagcaaaacuguuuuccagaacuuaaaacaguggcuaaaaaggaaagaccagggaagaggaaaugagcagguuggcaaacauugucaaccuaggaaagcccaauguagcuguuaucacagauugacugagagaggacuguuggaucuacuuuacaccacuagcugaccuguuuuuggcugacggguuuuaguuccuccccucaacccuagucuuuacaaugaaaauuuucuggcuacuaaucugugcucuuccauucuucuuaguccccauauuucuauagacuccuacucuguagaaauagauguaggacagugaguguuaaucuucagaauaaaggaauaguaaucaguguaaugucugaagugcuaaaucaaaugaagccgagggguuaaaucuccuugcaguuuaaggucuuagacuucuuaguuacucuuuuugguacauuaaagaauuugccaucuuugauccaucuuauuuauuucuguggcccuucacuacuauccaaagcugcacauuuauaugucugaaaaguuaaauagccagguaauuccucugccaugaacucacaccuagaagugauucuaggugauauucuaagagcuucucucacaagcccauaagucaguagcugcagugggaaaugagcucugaguagaacuuguagauacugagaacaggagcaacuuauaucaucccugugccacagccguucuccagcuugcauccuuugaccuucaaacuaaagaugugaaaugcagagagcuggcuuugaaaaccauuccagucugauuuaucccaaauuuggcaaaucaucccuuuaauauaagcucaaugauugcaucaacaaaauauacagguguucuauuauuuaugauaccucuuucagcccuggugcagcuccaugguauggaauuuaauguauuuaaaggcuacugauaguuauagcacucuuuuccuaaauacuagucugguguuuauaucagacagguguuaaaugauuuuguagggauuaauguagggaauuauaaaggauucuauuguuacuagaaaggggucccgaugcagaccuugaaagaggguucuuggaucuuguacaagaaagaauucaaggcgaauccacagaguaaagugaaagcaaguuuauuaagaaagugaaaaaauuaagaauagcuacuucauaggcagaacagcagcaugggaugcucagcugcuuauacuuauuguuacuucuugauuacaugcuaaacaagggguggauuauucaugaguuuccuaggaaaaggggugggcucuucucagaacugaggguuccucccauuuuuagaccauauaggguaacguugccauggcauuuguaaauugucauggcgcuggugugucuuugagcaugcuaauacauuauaauuagcguauaaugagcagugagaacaaccagaggucacuuuugucaccaucuugauuuugguaggauuuggcuggcuucuuuaccacagcuuguuuuaucagcaaggucuuagcgaccuguaucuugugcugaccuccugucgcauccugugacuuagaaugccuaaccuccugggaauguagcccaguagaucucagccuuauuuuacccagccccuuuucagaaaaggcaggucuggggccagggcaggcauuuggaauggcuugagggcacagaauauuuccaggguagaggagaugugcuggacuaaauuauagagugauggacuaaacugacuuuguagcuugacuuuugguuucagaguuggaaaucugguuuacaguuggacauuauacagugguggauuaaauucacuuugcaguuugacuucuggcuuuagagcuggaacucagugcacacuagugaaagucaugcuucagacucccucuggaauucaaggggaagauaauaaugcgcgcuuacuaucuuaaauuaaauuccauaauuuucagcucuguauuuuuuccaaauuaaacauuauaucucaaacagacccagauauauuugaauauuauuaaugacaaacguuaggcuuaaauuacaaauaauaauauaccuaacauuggaaauuuccaucauuccuaguuugucagacuccuuuaucuugcuaauuugcagauauugcuuuaguaauguugccgugauuaaugaagguuuucuugguauuaaaagauccaaagagauaggaauauguaauugaacucuagauuguugauauucuacuuucagcauucugaagucauggaaauucuuacuguagaaacucaauaaacuuacaaguagaccuuuacuuuuuaguucauuacugauaaaauaaugaauauagucucaugaaggugaguuuucagaaaauagaagcaugaguugugaagauaauauuuuuaaaauuucucuaauuuguuuuguuuugcaggcuauagguuccaggcuugcuguaauuacccagaauauagcaaaucuugggacaggaauaauuauauccuucaucuaugguuggcaacuaacacuguuacucuuagcaauuguacccaucauugcaauagcaggaguuguugaaaugaaaauguugucuggacaagcacugaaagauaagaaagaacuagaagguucugggaaggugagucaaacuaaauaugauugauuaauuaaguagaguaaaguauucuaaucaguguuauuuuguuacucccuacugcuuacuaugcucuaagaauguguuuauaaccauuccucaaagcaaucuuuuucaugcuuauucaguaaauuagaaacuuacagaaaguagcaaagccaguucuuggacucaaaaacugauaauuaacuuuaacagacuuuuucaguuuucaggccauugucuucacacuguucuuccuuccuccccacuuuccuccuucccuuaguuauuuucuucuuucuuuucucucacuuucacucucucuccacuccuuccuuccuucuuuccuuccuuccuucuuuccuucuuuucuuuccuuuuuuccuuccuucccuucuuccuucuuuucuuuuucuuucuuuucuuucuuucuuucuuucuuucuuucuuucuuucuugcuuucuugcuuucuugcuuucuugcuuucuugcuuucuugcuuucuuucuuuucuuucaagcuuaaauccauuccuuuauugaggaaaguaagcccauuuuauuuguacaugugaggggggagauuaaauauggaaaaaugcuagggguauuuauuauaucuguuuuaaauuacuaccacucuuucuuuuuuuuuaucaugcuccucccuucauccuauuucuguuuaucuuuacccuuuuuuuacuucuuuuuuuuccccugcauacuugucuuuuuuuucccauuauuuaacaaaugcuuauguggcauuuacuguguuuccaggcaaaugucuuauuccuuauagcaaccauauggggucuauuaucucauuuuucuaguggggcugaggcacaggcaggucauggcucuggacuuuagagcugauaggucuuggagcugggauucaagcucagacaguugugcuccaaaguuguuucucuuucuguuauaaaacaaagaguuccucugauggcagaaugcagucugauaucacaugaucuguaucauaguggaaaugagaggucagagcagggcugacugccauaacuaacauuuaggacagggauauaugugugaugaacauucugagauucccaggaguuagggcagggacucacacagaucagaguggcucugguugucaguaggcccagcuaccucaccaagugaaugaugaagaaggccccagauguuggucauugccacuaaugcuuuguccuuuaccucucugcuaucucuucagacucuuuaucccauuuuugggggguucccucuggaaaaucuuuugggccagcuguaguaccuccccagccagugucuguaggggacaaaccucaugcgaggcauccuaucaggcucccggaggccuauuucuggagguacaucaggauggugcugacccacaggguucuauuguggucuggcucaaguaacguuggccccugccagggaauacauucugugccaaugacuuccuuuaauauuguacuuugggggucucccccaugguguugacucuuccccugagaagauggaaaaaucuaggacaaaauauaaaaaaaggagaaagcauucuaguuaacagugucauuauuuaaugagguauuugaaaugucccagaagggagucuuagauugcuuuuaggaagaagaugauacaaucugauccuaagcuaauucaugcaaaccacagguuagcaccuuugaagugacacaugagauuuaagacucuuggaguucugucagaggggccaaaggaaggggagcagauggaaaugaauuauguguggauauggcagauuuucugagcaaaggucagggaugugauacauuuucuaauucagggguggcucaugagagggacagaaguagguagggaaaguaguggaucugcaccaaccaguccacauaauauugaaaaucaacuuccaccugaacacacuucucaagcugcuauuuaguacuucuuauauaacaaguaucauucuaacagcucuaaauacuugaucuaauuuaaugcugucaauaacccuguugaauuaucccuguuggauagauaaugaaacccaagauucagagagaucaaguaacuugcucacagucacacagcaacagccuccuaaccaaucucccugcuucaacuucuuccauucuuauccaacuauagucuacauucuuacagaagucauucugaccucucauaaauaaaaaucuaauaaugccaacccuuacuuaaaacucccaaauggcuucugaucauacuuggaacaaaaucuaaucuuuuaucauggauuaccaaacucuguaugaucuaacuccugaugaccuuuauggccuuaucuggcaucacagucucuuaugccugugugcccuggcccagugggcauucuugcaauuccuggaauguuuuaagcugauugccucugcucuucucuuggcugacuuuacguuauucauaucccaaaauuauuaccucuucagagaggccauuccugacaccugaauuaauucaugauacuucgcagcccuugauguuucuuuccuauuucuuuguuuauugguuaaugguguaccauuuguuuauugauuaaugguguaugugacauuagagcccacacuuauucugacugcaugaugucaaaaccugcucauaaccucuacccugccugugaucugugcucugcaguuuuucagcacauuauuguggacuagugagcauuuuuauaaaauacaggugacccuugaacagcacggguuugaacugaguggguccacuuauauguagguuuuuuucaauaaauguauuggaaaauuuuuugaagacuugcaacaauuugaaaaaacucacaagccauguagccuagaaauaucaaaaaauuaagaaaaaguuaaguauguuauaaaugcauaaaauauauguaguuacucgucuuauuauuuacuaccauaagauauacacaaaccuauaauuaaaaaaaguuaaaagugaucaaauuuuaugcacacaaacacuuacagaccauauaagucaccauucacagucaagacacaugucaacaacuguaaagauacaguguuacauguuuuggcucuguguccucauccaaaucucaccuugaaugguaauaaucuucacauguuaugggagggucccagugggagguaaaugaauccugggaguggguuuuucccaugcuauucucaugauagugaauaagucucaugagaucugaugauuuuauaaaggggaguuccccugcauaugcugucuugccugcugccaugugagaugucccucugcucuuccuucaucuuccgccaugauugugaggccuccccagcuauguggaacugugaguccauuaaaccucuuuccuuuauaaauuacccaaucuugggcaugucuuuauuagcagcaugagaacagacuaauacauaguguuaaaucauaaaauaaaaccauaguauguacuguacuaccccaguaauuuuguagccacuuccuguugcuacugcagugaguucaaguguuguaccugcuuaaaaugcagugacacuaacaaucucagcaggagcaguucaucucuccaguaaauugcauauugcaauaaaaagugaucucucaugauucuugcguauuuuaaaaaucauguuuagugcaauaccauaaacauuaaauaacaccagggaacccauaucaagugacacuaguguugcuggaagugcucccaacaagcagagaaaagucaugacauuacaggaaaaaguugaacugcuugauacauacuauagaugugaggucugcagcugcaguuaguugccugccauuucaagauaaaugaaucuagcauaagaaccauuguaaaagaaaacaaaacaaaacaaaaacaaaauucguaaaagccaucacugcagcuacaacagcaggugcaaaaaccuugcacuuuuuguacaauacauuuaucucauauugaaaaugcagcuuucacaugggugcaggauugcugugagaaaggcauaccuauagacucuaauaugauuagaggaaaagcaaagucaauucaaauuaaaaguaagauuaaggaucagagcugggucauuuaaugccagcaaaggaugguuugauaauuuuagaaagauauuuggcuuuaaaaaaaugucaagauagcaggagaaggagcuucugccaaucaagaggcagcagaaauguuccuagaugcuauuaaaaaaaaucauugagaagaaaggauaucugccugaaaagguuuuuaaugcagucgaaagugcccuauuuuagaaaaaaaaaaugccacaaaggacuuuuauuaauaaggaagagaagcaaguccaaggauuuaugucagaaaggaguaggcuaacucuacuguuuuguauaaaugcaauccgguuuaggaugaguccauaucuauagauaugcucuuauguguaaagcuguucaucccugauccuugaagggaaaagauaagccucagcugccaguauuuugguuguacaacaagaaggcauggacaaugagagcacuuuuuccggauugguuacauugaugcuuucuuuguucuugaagucagaaaguacuuagacaguaacggacugccuuuuaaaguucuuuugauauuagacaaugcuccuggccacccagaacccaugaguuuaacaucaaagguauugaaguggucugcuugccuccuaaacaugucucuaauucagccuuuagaugaggggguuauaagaaucuuuuuuuuuuuaauaaauuuuuuguagacaugaggucucacuguguugccugggcuggucucgaacuccugagcucaagcgauccuccugccuuagucucccaaagugcuaggauuacaggugggagccacugugccucgccacucauaaggauuuuuaaggcucaucacaaagcacaugguacucuacagaaaggauuguuaaugcuaugguagagagccaccagagagaagaacaucaugcaagucuguaauccuaaaacgauaaauuucugcuggagaaaacuguguccagauguacaugauuucacaggauuuaugacagagccaaucaaggaaaccacaaaaagaaauaggagauaugaaaaaaaaaaaaagguggugggugaaggcuuucaagguauagauuuuggagaaccucaagagcaaauaaacaucacaccagaggaauuaacagaagaugacuugauaaagaugaguguuuccaaaccacugccaaacaaugcggaagaagauauaggagaagcagugccagaaaacuaacuuuacgcaaucuggcaaaagaguuucgguuauucaggacugcuuuuaacuucuuuuaugacauggacccuucugugauacaggcacugaaacugaagcaaacaguggaggaaggauugguaccauauugaaacauuuuuagagaaauaaaaaaggaaaaagucagacagagaccacaaugcaugucagucacaccaggugugccugccuuucccgccuccccuuccacuuccucugccucuuccccucugccaccccugagacagcaagaccaaucccucuucuuccuccuuuuccuuagccuauucaauauaaagaugaugaagauaaagaccuuuaaaugauccacuuccgcuuaaugaauaguaaauauauuuucucuuccuugugauuuucuuaauaacauuuucuucccucuagcuuacuuuauuauaaaaauacaaauauguauuacauauaacauacaaaauacauguuaauugacuguuuauguuauugguaagacuucugguugacagcaggcuauuaguaguuaaguuucuggggagucagaaguuauaugugaauuuucaacugcacgaggggucagucucccuaacccccauguuguccaaggcuccauuguagaugcuuuuuuacuuuucagaaauaaaagccauaaacuuguuuauuugaggguaggaagaguaaugucaggaggcuauuuuuucuuucuagaaacauacauuuuuauuucuucaaaauuauuuaguacacaacaguuuccgagggaaacucgaugcuauuuguucuuggauuagaaauucucucuccugauggugauuacugagucuccauuuaaaacucuuggaauaaacaaagcugugaggaugcggggugcuaauuaagccuuuuccuaauugcuucauugugcgucaagaugaagacaguccugaaguuauuauacuguuuuacucaccacuuuuaggucugugacucaaacucccacuuuuauucggcuauauacacacuaaaaagcaaugacauuuacaaaccaaucucagaccagacacuccugccuuagaacauggugcacagaaaauauuucuuaaaaccauuacacugaaauauacaguaaaaucuguuuuucagcagacauuguuauagucuguugaauuuucuuacuaaucuagaaaaccuguuuguuagaauucugauaauuagaaauauuucuuuuuuuuuuugcuugugaaacuucagcuuuuauuuuauuuuuuuauuuuuauuauacuuuaaguuuuaggauacauguacacaacgugcagguuaguuacauauguauacaugugccauguuggugugcuguacccaccaacucgucauuuaacauuagguauaucuccuaaugcuaucccuccccccuucccucuaccccacaacaggccccagugugugauguuccgcuuccuguguccauguguucucauuguucaguucccaccuaugagugagaacauacgguguuugguuuuuuguccuugcgauaguuugcugagaaugaugguucuaaugugucugacaaaaggauugucuuugggaauuugaaggugaauuuuuucuccucaccuuuugcuuucugcacuuuuacgauuuucuaaagugacuauauaucauuuuuauaauguguaaaagaaguuuauacaauauuuuaaaauaaaccugccauuuuccuaauuuucuaaguaucuugugguaaacauaauucaaucuucuuggccugucaguguaagaauaauauuuuaaauuuuauuuuuaaauaaguuuuuguuucuaagaauguuacuaauuuuuuuuuuuacuucugauagauuuugauauuagucuucaaaacugacuuaaugucuuaugaaaugcuugcuguuauguuugaaguuagguaauuuauguaagauucagugaagaauaaguggaauuccauguuuaugauuuuaagcuauaaaacacucuaaauuaaaugugucuuuauuagaaucuguucugaccagugcagaggccaaagagaggaagaacaucuuaaacaauaaagagucauuucucuuggugacuuauaauucuggaaguuauuucucuuaaaaucauagcauuaaaagggacuuuagagacccucuaguccaucguccucauuuugcaaaugaggaaaaugagacagcauguugguucaagguggugcggcugauguaggcugaaaucucaucuuguacacugguguucuuugcuuuuuccauaucccuuuacucagacuccagaggugaugaaggauguauguuuccuaaucagauugccuuguuggaaguaacauuugauuacaacauaauugaaugauggaaacuuucuuuuuaagauggagucucacucuguugcccaggcuagagugcagugacgccaucuugacucacugcaaucucugucucgccaguucgagcgcuuccucugccucccaguagcaugggauuaaggcaugugccaccaugcccagcuaauuuuuguauuuuuaguagagaugggguuucaccauguugaugguggcuggucucaaacuccuuacuucaaaugauccaccugccuccaucucccaaacugcugggauuacaggcaugagccaccauacccagcccaaaacuuucuggaaaacagauugauaguaugugccacauuccuuaaaaaauuaaaaaaauuaauucaagccagguguagugccaugugcuuguagucuuagcuacuuggcagacugaggcaggaggauugcuuacccaggugugugaggcugcagugagcuaugaugaucacaccugugaauugccacugcacugcagccugggcaacagagcaagaccccguuucuaaaaaaaaaaguuaguuuucuuugacuuauuaauuucaccuuaagaaauuuuccuaauaaaccaauucaauauggacaaauguuuagguacaaagauguuuaucucaccacuauuuuuaauaaaaaaggaauugaaaaccuggcucaacaauaaaggaauacuuaauugguuaugauauuaaaggacucauuacacaucucauuauuaauguguauuuaaugaacuuggaaaaugcuuuugauaugaagguaaaaauaaugauauagagcuaaauauagaguuucauuccaaucuuuuuaaauauauuuaugcacuuaggaaaaaaacaauauggaaauguguaaaauauacuuuuuuuuuaaaaaaaaggacacauuuauucagcauuaugaucagacuauuacauuuaacaaucaacaguaugggugccaaaaaaaaucuacauuaaaacccuuuguuguaaugcuuuacacuuuccacagaacagaaacuaaaagaaucuguuacacaauuagucacaaauauaguccucgaguuuuuuacccauacacaugaguauuugucuaaaacaugucuucuuguagcacuuaggcccugccaccacugugcuugucugaguucacaaaucuguuguaaacuguagcuucccugucacuucucuggcucuuaucuccugcuaagauuuguuuccuggcaguaauuuaaaaucuucugccacugcuguagcuacugcugcuacuggaacugccauagccaccuugguuucaugguuuggcaaaguacuggccuguaccagcauaggggccagagcuucugccuccaaaguuuccucccuucauggguccaaaauguaaaacuaauuguuguaauugccaaaaucauuacaccaccuccaaaauugcuuccaugauuaccaaauccauuauagccauccccacugccacuauauccaccaccaccacagcugccaccaaagccacaaugaccacugaaguuuccuccacgaccaaaguugucauucccaccgaaacuaccuccacgaccaccaccaaaguucccagagcugcuuugccucuuuggcuggaugaagcacucaccaucucuugcuuugacagggcuuuccuaacuucacaaguguggccauucacaguauggguauuucucagugacagucuuacccauggagucauggucgucaaaaguuacuaaagcaaagccccuuuucuuaucacugccuuggucagucaugauuucaaucacuucaauuuuuccauacuauucaaaauaaucuccuaggugauguucuucagugucuuuaaugccaccaacaaauaucuuuuucacaguugggugggcaucuggucuuugagaaucuucucuugagacagcucucuuugguuccacaacucuuccauccaccuuguauggccuugcauucauggcugcauccaccuccuccacaguggcauaugugacaaacccaaagucccuugagcgcuugguauuuggaucucucauuaccacgcaauccaugagcauuccccauugcucaaaauggcuccucaggcucucauuggucaaccaauguagagcucaaccuccaaugaagaauuuccucagcuguuugggcucauuaggagacucugacuuagacaugacggcaggggaaagagagacuuuaaggaugcuuccuugguggcguccacgggcagaaagggguaagcguccacaggcagagaggaguaagccuuugaauguaucuaaaauuuacuuuuuauugccugcauucuuucacuauuuuccaaacauucuucaauugucacaaauggcaaugauaaagagaaaaauauaaacaucacauuuuaaaaauaaguguaaaauaacugugaacuuaaaaugugaucaucauagaagaaagagcacugcaauagaaguacugugaguucucugguuaauuuugcgaagccacguaaagcuguguggcuuuaagcaaugccauaauccauuuaagucuuagcuucuauuucugcaaaggagaaguuugaauuagucaaucuuccuuccagauccauaacucaguuugauaaauuacuuaguaucuuuuucuacagagaaaaugcucauacauaauaauaaauauguaaucauaaaauuauuuucauuagucuguuuuauagaauucaaauuaaucaccacuauuuacucuugugccucuuggugaucggugcugucuguuacagaucgcuacugaagcaauagaaaacuuccgaaccguuguuucuuugacucaggagcagaaguuugaacauauguaugcucagaguuugcagguaccauacagguaauaaccgcugaagagugggaggagagugugaauaauuuuucaaucaucauauuuguuuucagagggauuacuuuggcuagaagguagggagcaaguggagaaagugcucgaagguaaaccauugagaaacaguuguaauuaugcaggagagaaaguacaagacccugaacuaaggcagggacaucucugagguagaaccuguaagaaugggucacugaugagaagggagggagacaugaugcugagaaugacuaucugauguccagguaggauaugacccuauaauuugcucuaguugaaaaugaguuauuuauggaaccugaaauuugagguaccugugggacacagagaggauggugcuuccuggguuuaccugucuuucugcuuuuuaccccuucuccagugcagaccuucuuccuuuaauacagucaucccagugagggcucuaauaaguggugugaacauaagcaagcccaaccuuucugagucuguuucuuauaauaaaaggaaagcuggacuuuauugauggauuuuuaagcuuuuauuuaaaaaaaaugaugguagagccuuuuugucuaaaaaaaaauuauuugaaaucuucauaugugaugaagguaaaagcagaguugaucugguagcaggagggguuggaagcccagggcugcccacuugcuaaccugcccccacccacaccuccauaucacugagcuggauccauaucaugauucuagaaugucaaccccuuuuuaaagccuucucugagacccccgaagaauuuagugcuucuccuuucuuccuauaacagauuauucauaaggcaccucuaaugcauaaauaguaauucaacucaagucaggucuccuaagucaagaacaugccuguuuccucuaugucaacccaucauggccccugcaccuuguagguguuggguaacugugugcagaaugaauauuuacguagaguacuuccauacuguguguccaaaaguggggagaaagggagauaacuuuuacuuauugaucccuaaccggcucuuuacagucauuggauuauuuucucuuuacaucaacacuuugagguguaguuaauucuacauuaaagauaaagacacugagucucagagguuaggcaguuucccaaauuugcacaacuguuaaguguaaagugaggaccaaacuuaguucuuuggaaacgaaacccauuuuuguuggucaugccucugugcccuacugccaaccuaucaaaaguuacauuuuaaggacugagaaaugaaaguggaaugaguuuucaaaugucuucuuuucagaaacucuuugaggaaagcacacaucuuuggaauuacauuuuccuucacccaggcaaugauguauuuuuccuaugcuggauguuuccgguuuggagccuacuugguggcacauaaacucaugagcuuugaggauguucuguuguaaguauugggcuauuauuuaguuaagcucuaaaaauaaagcugggaugaacaugcuucaugucuagauaggaaacccuacugugaagccucaugaagagauucuggugauuccuaaaucggcauuucugccucugagucuucaugugccaccauugaagcacccccuuucauuuggaggagcaguaacuucuuuccucauugcuggcucacacauaguugaccuuuucaaaucugugacugaguggagugauuccauucggagauuuugagaaggccuuggcauuugggaagaagccuagcccugagcaaggagucugacuggcuccuuuuaaaggacuuucuuacagagcaaguaaaauacagauguguuguacuaaguucugcaagccuuuggcaauuccaggauauguuuacuuucccuugauaagagaggaauuggaagguaagagccaaaugaauucagaaaugacaaaggaaaaguuauauugggauuuuucugcuacauuguucugaauguagauaauuguaccucggucagaggaagauaagccugaagcaauuauacuacaaaaguacccaaauaugcaauuugguggucaaaaguauguguaaucuuucugagcuucuagauuuggagguggguaagauucugccucuugauagcauaacauaauuaguagcgauauaauuuuauauuuaaaccagaaucauauaagccuggcaguauaauguguuaguauaguauuucuguccuuuuuaaacauugaguuguucaugcauuacaguuugcucaggaugacccccaaaaagacaucuaaauuuccauuaaagauguacauuggacaaaugauaugcaggugcuauuugugauuauggccuagagaucaaaaccaaguaucacuggcauuggggcuuugauuagauaauuauuugauauauugcuuuacuccaaaaaauugaauugaugaaaguugcugacauuggggcauuuagguuugcaaaaucaaccuuccaaguuaaggaaaaggaagaccugucugaagaacagugcauuagaaaaaggucccauagguuuaaaugaucacaaguccaagauuaacuaucgguauuuuauuuagugcuaguuaaacaaacaaacaaacaaaaacuaaugacacaauaugcuacacaaacauaggcauagaguccagaggaaagaaagcgaugaauucccuguauucugggcggguucccaaguauuaugucuguuccaggcuuguguuuaaaaaaagcauauuaauaaaugugucuagagaagggcagugaaaggaguuaucaaagaagcaaaggaguuuuuagcaauauuucaagacuuguaggccugucuuauguaaaaggaaguaaauuuuuucuucaguuugaaaaagaacuguuuaacaauagacaaucaaacaugcuacuuccuaaaacagaggauggaagccaauuuaggggagguguccaggcacgaacauggagagcuggacuugauaccuguaagguccuucccaacuuuaaguugcugugauucccaugucauagauaagaacgucaaugcaucuuaagagcaacaugauaucuggcucuguaagaaacuuucuuuugguugcacaauucauagguuuuuaagaaucugauguaauuccaacaucacugacuguauccguuguugauuaccacaauaaugcuguguaacaaccagccacuaaaccucagagacauacauauuuuugcccacaaaccuauggguuagcugugaaguucuacugaucuggauuaggcauaguggaucucggcuggacuuacucaugugucuguaguggauugugucuguagcugguugguugggauucagacagcucuccuccaugugugccucauccuccagcaggcuauccuggguuugagacaguggcagaauucugagagagagagagagaaagagagagagaacacaugcaugcaugcucacaaagcauauaaggcccccugagucauaggcuuggaacuggcaaaagugauuuccaccauauccuguuggccaaagcaagucacaaggccagcccagauucaaagggugcugcaaaggucacagugcaagaagaugaggauacagagagagguauacagagggaaaaaaaugggccauuuugcaaucaaucuaucacauagacaugaacuuauaaggaaauguguuuguuuuauuuuuaacaucuguuuuauaacuauuagaggcaaagcucucugguuauagaagugucaacuuuuggccaggcaugguggcucacaccuauaaucccggcacuuuuggaggcugaagcaggagguucacuucagcccgguaguucgagaccagccugggcaauauagggagacccccaucucuacaaaaaauaaaacaauuagcugguguggucaugcacaguuguagucccagcuacuacagaggcugaggugggaagaucgcuuaagcccuggagaucauaucuuuagugagcucugauugcacuacugcacuccagccugggcaacacaggaagaccccaccucaaaaaaaaaaaaaaaaaaaaaaaggagugucagcuuucuagcauugugaugguaaugcugugcacauguuuuguguuugugcuuuccagaguauuuucagcuguugucuuuggugccauggccguggggcaagucaguucauuugcuccugacuaugccaaagccaaaauaucagcagcccacaucaucaugaucauugaaaaaaccccuuugauugacagcuacagcacggaaggccuaaugccggugaguuugauguuucaacuguuugaucuacuccugacuccugaaugaaaguauuuuaaguggaaacuuaauaaaauuuguacuuucaaauaugcugaugauaaaauaaaacuuccuagaucauagauuccuuucaauuacugcuaauaauauacaucaacauucaguacuuuuacguagcaaagguuauagggaaauaggaauacugcucacuuuauaagcaaaaccuauuaaucagauuuuuuaaaaacaauuuuuuuuuagagacagagucuuacucugucauccaggcuggagugcagcaguaugaucauagcucacugcagccuugaucuucugggcucaagcgauccuccugccucagccucccaaguaacugggacuacaagcgugugccaucaugcccagcuaauuuuuuaauuauuuguagagacagggucucguuauguugcccaggcugguuaucagauuuuauuguauguaaguuacuguauuccugaggaacagauuugaguuauuguagcuguauugcauauucauauugucuuaacaauacaugcuaugaaagcuuuuacucuuuuagaucucauuuauuaaauucuagcagucugaggucaagcacaguggcucaugccuguaaucccagcacuuugggaggccaagguggguggaucacgugaggucaggaguucgagaccagcuuggccaauauggugaaacuccaucucaaauaaaaauaaaaaaaaaaagauuagcugggugugguggcacacgccuguaaucccagcuacuugggaggcugagguacgagaauugcuugaaccugggggguggagguugcagugagcugagaucaugccacugcacuccagccugggugacagagugagacucugucucaaaaaaauaaaaaauaaauaaauaauaaaauuaaaauaaaauaaauucuagcaguuugaagugaagccaauuguaacacaaauuaauuaucuucugacaccugguaaucgagagaguuagcuauacacuuuauuuucaguauugcagcauucaaauuuacuguuauucuucucauugcagaacacauuggaaggaaaugucacauuuggugaaguuguauucaacuaucccacccgaccggacaucccagugcuucagggacugagccuggaggugaagaagggccagacgcuggcucuggugggcagcaguggcugugggaagagcacagugguccagcuccuggagcgguucuacgaccccuuggcagggaaaguggugagcacacuuucacauuuagcucaguucagguuuucaucauccaaaugucugaauguauuuaauucucaacuauaagccauguuuuuucaaaccuuuaaacaacagucccacuuggauaaagucugagagccuaaauauggucuccaaguggugucaucugucccagccaacuucuccaggcuccccucaacacuaccccucuacccuccuuugcaagcacccuuuguaccaccugucucccuugcuguacuuagguuucagcugacuugaaaagaaccaacaaaaauggaaguagccagaaagauacaggacaggugcuaggagugagaugaaagccaaggauggagacuguuucaaagaugguggucagcaaugacagaugguauagagagauuggguaaggaggagacugagaagacaugauagaaucuagcaaugaaugggcuauuucugacauuuuaaaauauucuuagugaaguagugaugguaggaaacaguuaaggguggcugaaguaugauuaggggaagaaauggagauguaagugagcauagauuaucaagaagauggaaaguaaaagaaaggcaaauaaggacagcacuugaguggggaggcagaguccagggaaaauguuuagggguugaacucuugagcauuuuuaugacuggggaugagacaaaaucauugauggagagagggcauugaaacaucaucugaggaaaaaaaaguagaaucaacaaauuugggaaauguaaaaagaacauggaaguaugcccuuuugucuuaguugcuggggaugagggaagugucuggcagggaguagugaguuuaaacgacuaugaugggggauaggaaagaagacaaacuaggaaggaauagaauuaagagcaagacauuuucauuauguaggcauguaauuaguuguacugagaagugauauuuaaaauucuuaacaaugggaacagcauggacacugaccaaucagaauggaugccugcuaguacaagucagauggaugcccacccgcuguguauggacgcugguagcauuuaaugacucaaaugaaaagagaguuuucaaucuuuagucuaggacucuuuuuacuuccucacagcggucacucuuacucauaaauguuuguuauuguauucaaagacaguuaugccuuuauucaguuuacucuuaaaucauuacaagcuuguucccuacuuuuacucucuugcuuuauauuuucugugaacucugauuguguccuucaauuuuguggugaacuuaaaaacaggacucuaaauaaagacgucgcugacagccaaagcaauuagaggaggaaauguuagcucucagacacugauuauggcccucaacagacaguuauuaagugguguguuaaagauugugcuauaaugaauuguagggcaugauaucugcccucaaauacuuuaacugaggagauggggcauauaguuuugugaguuaaaggagauaggccuagagcuaguucuuaagagauaaggauuugcauaugggugaacaguagggaugacauucaauguaagagaaaauacaagcugcgaucagugauuuguucccaaugcagcaaauaggacacuuuggcugaaaugggaguuuaguuugaguagugguucucaaacuucucugaugagaacucauguaggaaagauuuaaagaugucaccauccacuaauguacucauagucacuuuccagugggaaaaacacuuggugauaacaaaauguuggaguugaaaacaacaauacaauacagcacaauaaugauacaauaaggaauaauuaaugauuauucugcaaguauauaaacacaagcagaacauaauaaaacauggacagcaucaguuacaguucagaguaggaaacagaaacugcccuagguauuucaaguagauaaguauuuaauaaagggaauuacaugcuuacaaaaucuuuggaagggcuggaagagugaaaggaggcuauuugcucccagacuuccaaaucacagcacugcagcugugauucuguaaccaagaagcugcagaaaauuaugccgauaucacagcuguuccaaauuuaaagacacgagacuagaaucuggcuguugcagaaauucuugucugccaaagaugaguuaagccguuagcuuaccacagcugcugaaggagagcuggugucuaccucccagauuuuacacugugcaucucccucguagacccugacuuacuuccagaaccaagggaaacugggaaauaguuuuuagccuucuagucccuugauguauaaaaggucagacacagaaguauaugaaaaugaaugcugagugcauaggacaguaagcaucccaagacauuauugauaaugcacugaaaacaaaguguccucauuuauugcaggaauauccauuaucuucuccugugcauuugcacuagggcuuggaaauacugccagauggugcacugcagccagacuucucagcagaaaguguccacaauaaacucuaguaaauguacaaaguuuuguuuauggacaucaaugaguagcccugaauaacucaguggauuacuacuaauuaguuuuuauugccauguaaaaaugagucuguggauuugagcauaagaauuaaagaaaggauuggacccuaaggacccccugaagucaggaaauucucgugaccaucaguggaccuugaaucccauguugaaaaacauugaccugaaauggugguucuaaagcuucggugaauauuagaauggccucaagagcuaguaaaaaacacagccggccuggauuauucaaguaggcuaggguuuggccuuuuauuuuuauaauauuccgaggugauucugaugccaaccaucauucgagagccacugaacugguaaauuugaagaaagauuuagguuaaauuguggagagucuugaauaauuaagcuaugaaauugugaagaugggaggauccuccaaguuuugagggaccugaagguuauacaauuguagggauucaacuuaaaguaaaaaaaaaaaauuuuuuuuuuaaugcaaaauuagauacaaagguggauauuuacuucaaaugaaaaaaaaaucauaaccaaauacuggaagcuuaaagauucuggucccuuuucauuuuuagguaauuuaucaucaauacuuacagggaagagcuuccugacuacagccuugccucccucccacccagaaaacuguucgacuucccagaauuuacauguaauugagggcucuugaagcuuaaccuucaucagugucacuguuaaaucaccccugcuuugagucuuccccuuaccuuuccuuucuccccuuuccagucucucccauauacaacagucagaacccccuuugggauacaauuagaagcugcuugucauugucugguuauaacccaagaagugccugagccaagaugggggcauuccccuuucaaggggggacacaaaauaucuuucaguugugagguauuaguguuaccaaaacccaaccuagaguguuuagauccagucuugguuuucccccaauuacuaauugugugaccuuguauaaguuacuuaacuuugcucauuuccuuaucaguaaaaugggaauuaacaucacagugaccuuauaaguguugcuaugaagguuaaacaagagacuguaugagacaugcuuaucacagaaccuacaacguugucagugcuugauuuuuaaaaaucaauuauuauuucacaguaaauaugcauagaagaauacacauuuaacauuuacauuuuugcgcuaaugaaagcaagcaauagacuuaacagucuacaauagagauagccaaucauuuuaaucuggccuuucauuauuucuuaccaauagguuuacuuuccuaguuauauuuuuauuuaggccaggauuuuuugagcacuucucauagauuccccagaguuccuuggucuuuccucagaccaacaccauuccucagccaaagaagcucugcuucuuugaucuguuuuacauucuaggcaucuaaacuuguuuuacuuaaagaaagaauucuucagucaacacagguuuuaaauaguuugcaauucuaggguauuaugcggggacgaggaggcccaagaguguauucaguguaaugaagaaacucauuauaacuugcugagaucauucagauuugccugugauuauauuaguuaggcagugucuguuuuccucccagggguauaaaccuggaaaauuacaacaaaaacaaaagcaaaaaccaaacuccuccuuuccuuaaauuuccacuucucaaguacaguguuuuaucuaacaagaucugcugcuuagccacauccuuguuuggcuuucacugucucucuccacccucuacuuuccaccuucauuuauuaacauuguaaggaagccuggagcauacauguguggaauagucuccauggcaacucagcuuggaacuaauaagguuaugggagagcuuccaucccugcaccugccagugucacaagcagaagccauguuccuguagcaaagauuguacucuacugcuaggcagcuguccccuugagccacccagccaggcacaugggauacagagaguauauggcucagcacgcacuagucacuacuauuagaaaagcucaaagcugagucacuggugccuucuucagaagggaugaacagcucucucacuugaaugccagaaaauuaucuugcaaagcagaccuaucugauagacauauuugcaucagaguagggcuuguuaucagcaaggcuguaaggugcccuccccagucuucugcaggauaauccagggagccagauuauagagaaagggcagcccucuguuccuacucaucuggcucaguauugaggaucuccauucacccuuuccuaccccuguucaccuauccauccccuguaguuccugaccugcaaagcuauuauguggucauaguuguuauuuauuuccaugcuaauccugggcacuguuucucugaaaaauggagauuuaagaauaaggcugucaggauacaucucagaaguauuaggcguuguauuaguguggcugcuauaaccacuugccacaaauucaguggcuuaaaacaacaccaauuuaugacuuuacacuucuggaggucagaagucuaaaauaggucucagugggcucauaucaagugucaggagggcuguguuccuucuagaggcuccaaaggaugaucuguuuucuugcuuguggccccuuccuccauuuucaaaaccagcaguggcugguugagucuuucucacacugcauuugcugauacucuucucccuccuucuucuucaguuaagagcccuuaugauuacauuaguuucaccaagauaauucaggauaaucuuauuuuacagucagcugauuagcaaccuuacaucuacuacuuuaguuucuuuuugccauguaacauaacacauucacaggauccagggauuaggacacagaugucuugugggagagggaacauuauucugccuaccacaugcauacaucagaaaccaugguugaaacacaggaaacaugacaguuccucaaggcauacaauuaugaccuuguuggguuaaccuucacuauccaaauuuuaaucacacaaacuuuuccuuaaucucacaguaacuuggcaguuucaguguaagaaauaaugauguuaauugugcuacauucaaagugugcugguccugaaguugaucugugaacucuuguuuucagcugcuugauggcaaagaaauaaagcgacugaauguucaguggcuccgagcacaccugggcaucgugucccaggagcccauccuguuugacugcagcauugcugagaacauugccuauggagacaacagccggguggugucacaggaagagauugugagggcagcaaaggaggccaacauacaugccuucaucgagucacugccuaauguaagucucucuucaaauaaacagccugggagcauguggcagccucucuggccuauaguuugauuuauaaggggcuggucucccagaagugaagagaaauuagcaaccaaaucacacccuuaccuguauacaagcaucuggccacacuuccuguuuggguuaguuguuaccuuuaccugaucaccugacccuccuugugaggaagggaugaaaguguucgaccacuucagguuuaggagagaggaacauuucugggauaggagaacuggaacaauugucuugauccaaagcuauaggcuugaggcuccaccuuugucagccuuagggguaaguacaauaucuggaaagccuuucacuuuaaguccaaguacagagucuggguccccaccugcacaugcugcuucuggccugcugaggaaguaggcaugacugucucuccccaugucucuccccuauuucucuuccuucuuccuccuugcagcucucucccaagccucaaaacucacuguggagucaguccaguccagagggcugaacccaugccagaaagagugcucucucugaauaaggguugaaccauuaaagugaccaugguaucauguaaucucucaucgucauacauuucaugggccccaaacuuuguuuacagugaaugguugaaaucuuuucuagggcucccugggcugugguccuauggguguccucugaauuccuccuaggaaguuggauaaauggaaccucucauccucucucaagcccucuuagguccuguguauuaguuuuuguguuuuguuuuguuuuggaauacaaguugacuauuccuuguccaaaauacuugggaccagaaguguuuuggauuuuggaauauuugcauauacauaauucacuuauauuucauguauaccuuauacacauagccagaaggcaauuuuauacaaauuuuuaauaacuuugagcaugaaacaaaguuuugacuguguuuugacugugaccugucacaugagaucaugugugaaauuuuccacuuguggcaucauguuggugcucaaaaaguuucagaauuucagauuuugaauuuuuuggauuauggaugcucaaccuguauuaaaaguccaaaauuagauuuuuuccaaccuuuauuuuagacuuaggggguacauguacagguuuauuauaccuggguauauugcaugaugcugagguuucaggguacaaaugauccugucaccuagguacugagcacagaacccaauagguaguuuuucaacacuuaccccccuucccucccuacacuaauaguccucaguuucuauuguugccacuuuucaucuaugaguaccugauguuuagcugccacuuauaagugagaacaugcaguauuuggcuuucuguuccugcauuacuuugcuugggauaauggccuccagcugcauccauguugcugcaaaaguuagguccuauauuuugaagugcuucucaaccuagguaaucuaccucacccauuaucaccaguuaugcucuuuauucuaaggaagugcccccuaaaacaaagcucaggagccucaacccggcggggaagacaguuuccucacgaggcaggcaagcaacaccagguggcucucuuucccaagauucccuucuuccauaggcucuucuuuggauaacugcugacaccaaucucauuaagucccagggagguggccuugucucccacucuccuuucacagucuagcccaacuagauaauugacccuucuccaggcucaaacauuuaaaacagaaagcuccaauccccuuuacugaugagaggauagugguucucaaguauagacacggaucagcaucaccugggaaccuguuaggacugcagauccagcaauccacguuuuaagagcccagguaauacuguugcaggcucaaauuggggaaccacugggcuagggguuaauaaaacacaaacacagagaguaacuauuaucuaucuuuuuaaauauacuuugccucucuggcauuugucuaccacaggacaaauccuggucucuaaucugucacacagaacacaccuguagacaccauaauucucuuccucagugucuagaccaggagagaaaagguaaaaccccuaaguccuauuaccuaaggauccacuucuccuaagugauuaauacuaggauuuaccucacccuguagguggcugguuuagcuaccuccuuguaagacugccgcacugccuuuaucugccucaacaggaucaguacuauaucaagagugcaacuaguaaacccuccacucacaugagauacacuucagugcuccugccuucugagacagccacagcucugggguagagccagucccaagcaucugccaaaaccucaucuggcgucuucucccucuauuuacagggggaaacccagggcugagugccacaaaacuaggguugccagauauagcaaauaaaaauaggcaacccuguacuaaaauuucagccuggaaauaauaagauaguauuguuuucuagguuacaagugcagucacauccuguuucugcucucuccugaguaaccuuuaacugcugucccuaucaucauagugaauaguuggugacaauuauccauugugggaaacaacacgggaagaauuuugggagcacucuaacaacaaaaauguuuaaaaaggagauguucauuuucaaaguuagauaucaaaauggaauccauuuugauagcauccauuaaaauuguuuaaguguuggagauacuuucauaaaaacagacacuaaaaggcugauaucccaagaaugucuuuccucaauuuaaaaucaugcagagagugucaccugcugguuacaaguaagaugagcuucaauuauuuuauuaugaauacuuuguucaaaucaaauuuccuuucuccugccaaucuuugucccaaauauaaugaaaucagaagauggaagauacuaacauugcaacaauauucuucuucauuaaaaugcugaccuguuuacacuaaaacauaucaucuuaaggcccaaacauuuauuuucaaauagauaguaaaccugccauuuugggcuuuuuuacuguucuuuccuuaauuauucaugaaccauucuuagcuucugaaccuaaauuuuuggaguauauagaaucgucuauccuacuuucuauaagcaagcuguuagaacuuuacuuucaguucuacuuucauaacaacaaaaccuuauuuacagaaauauagcacuaaaguaggagacaaaggaacucagcucucugguggccagaaacaacgcauugccauagcucgugcccuuguuagacagccucauauuuugcuuuuggaugaagccacgucagcucuggauacagaaagugaaaagguaagaauuuaaauuggguucauccauacuugaaucagucauccuuaaaaaugcuguauucuccauaguaaagaacaaaaugcagccagauuauugacaguuacuuacaucaccuuucaguaaaauguaaacacuuucuguagcuguuauucaggagaguaaagaugacacaaggcagauuagucuuagagcacauaugcuucacaaaccaucacuagaucaguuugcguugaccuaagaagcugcuuucaggaaccauauuuccuacuucuacuggcagcaucucuucagcaaccauaaggaaaagugguaguguaagacaguguuaaaaucuggcuguaccuuuuaagauaaauauuagcaaucauuucuagucagagaaaacguuaaaaauucagauuaucugaaagacgaacucaguaugagguauucucuacaauaaaaaaauucgggagucuguauuuggccuuugcucaggcuucuugaauuuacugugagcuggauuugaggucuguuuucaaggauguuguaacauccuugaaacuaagguaaacacauuaguaaauguuuuuaaaugagucagugaacuguauuuacugccuuaacuuuaagaguagaugacugcuggccggcaccuacugccguggcucacaccuguaaccccaacacuuuggaaggcugaggugggaggaucacuugagcccaggauuuuugagaccagccuggguaacacagagagacauugucucuacaaaaaauaaaauaauuagcuaggcaugguggugggaacuuguagucccagcuacucagaaggcugagguggaagaaucgcuugagcccaggagguugaggcugcaguaagccaugauuguaccacuacacuccacccuggugacagagugaggcccuguuucaaauaaaaaaaaaaaguuagggauagauaacugcugccucggaacuaacccaaauuaggguucagucaucugauaugacaaauccuuuguuuucaaaaaccuguucuauuucacugacaccuuguuaagaaggaucuauuguuguauuguuguggagcuuuuuuuuuuuuuuuucuuugagauggagucucgcucugucgcccaggcuggagugcaguggcgcaaucuuggcucccugcaagcucugccucccggguucacaccauucuccugccucagccucccgacuagcugggacuacaggcacccaccaccaagcccagcuaauuuuuuguauuuuugauagagaugggguuucaccguguuagccaggauggucucaaucugaccuugugaucugcccgccuuggccucccaaagugcugggauuacaggcgugagccaccaugcccguccuacuguggagcuuuuuauggaagaggaauuagggaaaagaacuauuaugagaauuaaucuaugugauuauggaauagguuguccaagaagcccuggacaaagccagagaaggccgcaccugcauugugauugcucaccgccuguccaccauccagaaugcagacuuaauagugguguuucagaauggcagagucaaggagcauggcacgcaucagcagcugcuggcacagaaaggcaucuauuuuucaauggucaguguccaggcuggaacaaagcgccagugaacucugacuguaugagauguuaaauacuuuuuaauauuuguuuagauaugacauuuauucaaaguuaaaagcaaacacuuacagaauuaugaagagguaucuguuuaacauuuccucagucaaguucagagucuucagagacuucguaauuaaaggaacagagugagagacaucaucaaguggagagaaaucauaguuuaaacugcauuauaaauuuuauaacagaauuaaaguagauuuuaaaagauaaaauguguaauuuuguuuauauuuucccauuuggacuguaacugacugccuugcuaaaagauuauagaaguagcaaaaaguauugaaauguuugcauaaagugucuauaauaaaacuaaacuuucauguga

SEQ ID NO: 191447 - RNA, 117375 nt, Homo sapiens
aaguaaccagagugcuaugucugcaugcuguucagucuccuuuuggaaggugggaaauaaagucauuuguauguuuuucucucuugcacagccuaaaaugaccaaugugugauuucaguggaauaaauggcguccaaagucacagaugcuauagucugguaucaaaagaagguaaguugauagucaaaacuuuuagcuuucuaaauguuugaauuucaaaaauacauguuuauuucaugcuauagauguuaggauuuugagugggaaaggaagauuauuuuuauuuuucuuguacuuauuuuacuucuaaauaaauuggaaagaugaugcuuaaacauauuuuuucucuacuuuuuacucuacaauagcaaaguagcuagauuaauuauaauagaaagcaaaucuccaggaguggauaaaauuagcauuuuauaaaaacauuaacacuuuccuuaguuuaauuuuuuaaaagaaagauuagcagagcuguuacauaacuuauaucaauaguuuuuaauuuguuucuuguaaguuacaauucaauagcugaauguuucaguaaaauaaaguuuugggaacucuauuuuacaaacugaaauauuaaaguguuuauuuugauguuuuaggauugucguaccuacuuuaaauagcuguaucaucuuauauauuucagaauaagcuuuaccaauguaauguuuuucuuuauaaaguccaaaagaauauaggcauuuuuugacaauacaauaaacuguuugcuccuaaugaguguuguuuauauucuuuaaaauuuauguuguuuuguguaauaccuuagaucuuuuguguacauaguggauuauauuuguguucacauuuuaaaacauuuuuauaccuuauucuucaggucucuauuaacaaaauauaaugauacauuuaaagcuuuucuuauauaggagaaaaaacagacuuuuuuuuuuuuuuuuuuuugagauggaaucucucucucugucacccagacuggaguguaguggcgcgaucucggcucacugcaaccucugccuccuggguucaagcgauucucuugucucagccucccaaguagcugggauuacaggcauaugcuaccaugccuggcuaauuuuuguauauuuaguagagacaggguuucgccguguuggucaggcugaucuugaacuccuaaccucaggugauccgcccgccucagccucccaaagugcuaggauuacaggcuugagccaccgcgcccagccaaacagaugauuuuuaaguuuuguucaauugaaaauaagugauaauuaaaacacuuuaaaaguuagacaaacuaagaauauggccuuuuuaaaaauauuuuuugagacaggaucucacucuguugcccaggcuugagugcaguugcacacucauggcucacugcaaccuuaaccucuugggcucaugugguccuccuaccuaaaccucccuuaguagauggcaugggauuauggucuguuuuuagauguguuauuuguuuucuggguagaacaugccauagguauacaauuauauuuuucauaugagguacuuuauuggaaguauugauauugauauacuauuaauugucuuuuguguuuguuagugccuccuuuuaaacuuuuaaacuuccaaucaaguuaaaaaucagucugcuuagcuaaagagcuaaagaaaauuguaaguuaaggaaaacaaaacaaaacaaacuuuaaaaauuuuccugucuauaucuuugaaaguuuuucucuuuccuaauuucuaucuacgggaguaauaaacauuuucucuguuuggcuuuuuacauuaaacacuuuagacuuuacugaagaucauuuauagaacauacuugauugaccuuucuugggaucagaggguuugaaauauuauacucagauucaguuagcccuguaacugaaguuagcccuguaauugaaaugacccucuuauccaagggucauuuaccugacagcuuuggauacaugcaaccaaaauauucuccagagcaacuauaggaaaugucauaaaauauacuagcaaauguaaucacauauucuauuauauauauauuuauuuauuuuugagacagggucucacucuguuaacacagucuggagugcuguggcacaaucacggcucaccgcagccuugaccuccuggguucaagugaaccucucaccucagccucccaaguagcugggacuacaggcaugugccacuaugcccagcuagaucuuguauuuuuaguagagacgggguuuugccauguugcccaggcuuaucacauaaauuagggaguugccagaaccauuaacuggauuugauuugcucuauuuuuuuccuuuugcuuuuaaauuuaauuuuauugaagaaauacaugugauacuuugaaagauuaguguuucaaggauuauugcaaaaaaaaagcagccugcaauacuauccaucccuauccuuaccuaaccuuugaguuuugcucccccagaggcaaucauuuuaaagucuuuauagcucauugguucugaaaccaaaguucucccacuccucauccuaauaacuuuugauggaauacuggcauuuaugggugggagucagagauacaaaaugucguacaacauucuaaacuaggauuggauugacugacuuuuucuuuaaagggccagauaguaaauaauuuagguuuugagucauaggucucugcugcaaccacucaaccuugccuugccauuguagcacaaaagcagccauagacacuauauaaaauuaaugagcauggcuguguuccaguaaaacuuaauuuacaaaagcaggcaagggucuagauuugaccuguaggccuugauuugcugacccacacucuaagacagccuuuguugaauaacaccauuuuuaaaaaugauauuucauguuuugaagcaugccugccuuguuuuuucuuggucauuuuauuguagauguuacuuguugacuucugacuauaugauuaggauuuagcuuuuuuauaagcuuccccuaaguuuccccccucuaucaucccagugacuccaaauuuugguaaaaucaguauuuggugcuuacauuauuauguuuguguauguaucauuuaaagauauguuauguuguaauauuuccaaucuguguaacuuuuuuuccccuuugcuugguuuuacgaauucuuuuucuaagucucugaugaaauuguaacacuucucuuauugcagucagucauauucagguuuaucucuucccuuuuuccuuucuuggaacugacucuccuagaauucucuguucaucuaguccauacugaauagauuguucuuaagucaugucucccggcugccaucuuaguauuuucuuuuaucauuagccugaggguuccccucacuggcuuaggucacacagaucuguuuuucucuuaaauauaugcuuacuaaaaaaaauuuuuagaggcauuuguacuucagugaaaugaaggcaggagaacugcagcuguacuuacugauuauuuaaccacaggugaauaacuuuauuucuuugagucucaauuuccacuuuucuacauugacuagcuaaugguucucagccucuuuucaaucauggaccccuuuguguugaaagccaaggaucauauuuugagaaaaauguauacaauauacauauacagaaaauaacacaucugucuuaaaacccagguuaagaaguccuggauuauaugauuuuuaaaaguuuuaauauuauaauguucuuugauuuugugacuaucauucaauaguauccagcuuauacugaguaguauccuuguaaauaaaaaccaaaaacauuuaucuucauuuucuugaauauuuguuugguuaguaacucacuucuuuuuauuuuugagggagggucucacuuugucacccaggcugaagugcaguggugugaacacggcucacugcagccucgaccuccugggcucaaacgauccuccugccucagccccccaaguagcuggaacuacaggcucaugccaccacacccaccuaacuuuuguauuuuuuugacgggauuucaccauguuucccaggcuggucucaaacuucuggccucaagcgauccuccugccuuggacucccgaagugcugggauugcaggccugagccacugugcccaaccauaacucacuuuagagucaccuuucuccacuagaaaauugugacguuuuuauauuuaugauuugaauacugaauggccaaaaaccaucacuugauuuguagacucuuuugaacaugagcucuaauaucagaugugaaauuuccaggagaaaaugaaaacaaacuuugaaauuauuauaaaugcguacagaaauucuacuuaauuaucaaguauuuuugaauaaguuauucuuuuguuuuguuuuuuuguugagacagaguuucacucuuucacccuggcuggagucagugguacgaucuuggcucacagcaaccucugccucuuggguucaagcaauucuccugccucagccuccccaguagcugggauuacaggcaggugcuacuacggccagcuaauuuuuguauuuuuaguagugaugagguuuugcuguguuggccaggcuggucucgaaaucuugaccucaugcgauuugcccaccguagccuccuaaagugcugggauuacaggcaugagccauugcacccggccuaaauaaauuauucuaugcaugguuuauuuugacauuuuaaaaguccuuuaauauccaauuuuaaacuucauuuuauccuauuguagccuucauaguuaugaauaauuuuaaaauuccuguugguccagaguaauuuucaguuauuaacuuggaggaacuguuaaugcaacaagaaugacaacaggggagaaaccagaauaguuuuuaguuaauaaugagcuguugaauguguuuuguggcaaaauacucugcuuucauauaucuaguuucucauuuccaaggagagggaauggaguuacuuaucuuuuggaaguuauuugaaauagggaccugaaauuacauguauugaaagauaauugacacacuaaguauuccuuuaaacaauauagugaccuguaagauuccacugugacugugcagauaaaauuaugagagaaugagguucuauuuucacuagguaaauauauaagagaagaguggcuuagaaaaacuccccaaauuuaaaagggaaaaaaagcacuggcaacauuguauagucauaguaaaacagugaauuuagcuuauagggcugaggaagaacuguaugauacagaucuuggucauugucuuuaaggagucaguugccaaugagaaaacuaaugaauauguuuaauggccuuuaaauaugagccagcuuugggauucauuuaguaauuuaaaugagaaacuagccugaguaacaugaacuugacugguaacugcuaucaauuguaaauaguugggaacuuuaaauuuuccaccuuuuugguaaaguucagccauguuaaugugugugugggcaugcacacguguguguguguauguguguguacuuaaguauguguagggcauuucagaguacuaacuugccuaagauugcacagauggcucaaaaguauuaagucucagcuuucaacuccaaaaccaugugcagucauuuaauauuauccuuccuccaucagucuccuggauucuuucgcagguaagacaaaucuaacucaaacuaucuuaaaggggaaauuuauuggcuuucaagcuaaaccgugcugaguagugaagcuuuucucaggguuuacuuaaucccaagaccagagcaccaucagauguguccgucugccucuuuuuuuccuauugcuuuucuagaguuggcuuauuccuucccaucacagaugccuuucuccauguugugagaauaagccccaaggucccuccauaccccuucucuuuuagcuccuugagaagaaaggauguguggaggaccgccauauggggguuuccuacccaaaauuauuccugaccuuuuuuccugguggaagagccucuauuuuguuaaggaauucauuccucuccacaggucuuacagccaaagaauguguauccgaagucucagagggggugaauccugauaagucuaacccaaucauggcauucuguuucccuugccagugacuggcauagaauggggcauguauuccaauuauggcuaaugagaaaugaagccuucugggaaaagucucucacauccuaaaaacaaccaauaauaauaauagcaaaccuuaugugaugcuuauuaugugccacuuuuucaaugcuuuacauauauuaaauaacacaguauaaugauaugaaauagaggguugccuuccugucuugggacauuggugggugaggcacuguugccugaaauuaguuucccuucccuucccuccccuccccuccccucgccuccccucgccuccccucgccuccccucgccucccuuccccucccuuccccuucccuccccuccccuccccuucccuuccguucccuucucuuccugccuaucucgcucugucacucaggcuguugugcagugacacagucauggcuuacugcagucuccaacuccugggcuuaagcaguccucuugcucagccuuccgaguagcugggacuacagacuugcacuaucaugcccagguaguuuucuuccuuuuuuguagaggcugggucuugcucuguugcccaaguuggucuugaacuccuggcuucaagugauccuuuugccucagccucccaaagugucgacauugcaggcaugagccugcaagccugaagcuuuuauagugacuuaguucccaugaaaggagcuuucuaauaggcugaggaugucagaaaugaaagauggaaagaaaacuugagcuuuuuaggacuuuaugaaccauaaaauuaaucaguucugaaagugaccuaauuugggauuucuuacuguaugagagaauaaaucucuguauuuuuucagucauuugaaguuggguuuuuuaguuucuuguuucugaaagcauccuaagugauacacagaagugcuuucugaugggguauggcuuucuauacaguccucuugccuuggcugguuauaguaguagagagaaaauuaagaucuaccaaaaagaaguacugaaccauagacaaaugcgcuuauuacauuuucacuuuuauguccuuuucuugaauguaauuuuaaacuaccaugcuuuauaguaugauaagguuaaaagagcacuguguauagcaucgcgaccucuauuugauuuugugacauuuaccagcuuaugauauugaacauguuauuuaauuuuucugagccuuaguuuuuucuuuuguaagcugcagauaguaaugcuucccuuggaugaaucacacagguugugacagaauaagucaacuuuaaauaugauuuuuaaaucuauguucauguuuauagguacauaguagguuuaaauauuugugggguacaugagauauuuugauacaaacauauaaucacaucacuguaaauggaguauccaucacuucaagcauuuaucauuucuuuguguuccaaacauucuaauuauacccuuuuaguuauuuuaaauuguagaguaaauuauuguugacuguagucacccuguuaugcuaucaaguacuggaucuuauucauucuaucuaacugugguuuugcacccauuaaccaucucuguuucccaucccuacuacccuucccagccucugguaaugaucacucuacucuacauuuucaugaguucaauucuuuuaauuuuuagcucccacaaauuagugagaaccugugaaguuugucucucugugccuggcuuauuucacuuaauauaauguccuccaguuccauucauguuguugcacaugucgggaucucauucuuucuuacgacggaauacuacuccauuguguauauguaccaauuuucuuuauccauucauucauugauggacacuuagguugguuccaaaucuugguuaucaugaauauugcugcagugaacaugggagugcagauaucucuucaguauacuaauuuccuauuuugggguauauaccuaggagugggcuugcuggaucauaugguaguucuauuuuuaguuuuucaaggaaccuccguacuguucuccauaguggcuguacuaauuugcauuccugucaacgauguacagggauucccauuucuccacauccuugccggcauuuguuguugccugucuucuggagaaaagccauuuugacugagguaagaugauaucucacuguaguuuugauuugcauuucucugaugauccaugaugugaagcaccuuuucauauaccuguuugccauuugugugucuucuuuugagaaaugucuauucagaccuuuugcccauuuuuaaaauggauuauuagauuuuuuuccuauagaguuguuugagcuccuuguauauucugguuguuaauucauugucagauggguaguuugcaaauauuuucuaucauucuguagguugucucuuuguugauauuuuccuuugcucugcagaagcuuuuuaacuugguguaauugcauuuguccauuuuuacuuugguugccugugcuuugguaguauuacucaagaaaccuuugcccaguccauuaucuuggagaguuuccccaauguuuucuuguaguaguuucauaguuuaaagucuuagauuuaaauauuuaaucaauuuugauuugauuuuuguauaugaugagagauaggagucuaguuucauucuucugcauagggauauccaguuuucccagcaucauuuauugaagagacuacuuucaccauuuguugaagagaacauccaucgugauguucuugguaccuuuguugaaaaugagcuuacuguagauauauggauuuguuucugggcuucuauuguguuccacugaucuucaugucuguuuuuaugcuaguaccaugcuggaguuuuuuuuguuuuguuuuugcuuuuuugagauggagucucccucugucgcccaggcuggaauguaguggcgugaucccggcuuacugcaaccucugccuccuggguucaagugauucuccugccucagccuccagaguagcugggauuacaggcaugcgccaccaugccuggcuaauuuauauauauauauauuuauuuauuuauuuuaguagagacgggguuucaucaguuggccaggcuggucuugaacugaccucaggugaucacucaccucggccuccuaaguugcuaggauuacaggcgugagccacugugcccagccacugugcuguuuuuguuauaauagcucuguaguauaauuugaagucaugcaaugugauuccuccaguuuuguuguuuucacucagaaugucugacuauucuuggucuuuugugguuccaaauaaauuaaauucuaggauuauuuuuucuauuucucugaagaaugucauuggcauuuugauagugcuacauugaaucuguagauugcuuuggguaguaugcacguuuuaacaauauuaauucuuugcaucaguguuuuguaguuuucauuguggagacauuucauuugcaugauuaaguuuauuccuagguaucuuauuuuaucugcagcuauuguaaaugggauuacuuucuugauuucucuuucagauuguucacuguuggcauauagaaaugcuacugauuuuuuuauguugauugcauucugcaacuugacugaauuuguucaucaguuguaauagauuuuuggugcagucuuuagguuuuuccaaguaaaagaucauaucaucuguaaacaaggauaauuggacuucuuccuuuccaauuuggauaccuuguauuuccuucuugucugauugcccuagcuaggacuuccauugccguguugaauaacauuggugaaagugggcaguggcugggcaugguggaucaugccugcaaucccagaacuucgggaggcugaggugggagaauugcuugaagccaggaguucaaugucagccuggggaacauggcucaacccugucucuacaaaauuuaaaaaaaaaaaaaaaaaauccaggugugguggcaugccccuuuauuucuagcuacuugggaagcugaggugggaggaucacuugagcccuagaauugaggcugcagugagccauguuugugccaccacugcacucuagccugaaagacaaagcaagaccuugucucaaaaaaaaaaaaaaaaaaaaaaaaaggcacgauggcucacacccuaaggcaggagggucucuugaacccaggaguucaagagcagccaggcaacauagugggaccucgucucuaaaaaaaauagagaaaaaauaagccaggcaugguggcauacaccuguaguugcaacuacuugggagguagaggcaggagaaucacuugagcccaggagauugaggcugcagugggccaugauugugccacugcacaccaaccuaguucacagagugagacccugucucaaaaaaaaaaaaaaaaaaagaaaagugaucuguuuucuucccagaaugugggggcuuuggggggaaaaaaacaaaauggucauccuuguuguguuuuagaucuuugaggaaagucuuucagcuuuucccuaaucaguuugauaccagcaaugcauccaucauauauggcuuuuauuguguugagguauguuccuucuauacccaguuuuuuuaguguuuuuauuaugaagggauguugauugauuuuguccuucauuuuguugauaugauguaugacauugauucauuugcauauguugaaccaucaugcauccauagauaaauccuacuuggucaugaugaaugaucuuuuuaauguguuauuguauucgguuugcuauuguguugaggauuuuugucuuuaucagggauacuggcccauaguuuucuuuuuuugauaugucuuugucugguuuggguaucagaguaauacuggccucauaaaaugaauuugaaaguauucccucuuuuucuacuuuucagaauaguuugagaaggauugguauuaguucuuuaaauguuugguaaaguauagcagugaagccauuggguccugggcuuuucuuugcugggggacuuuuuauuacagcuuugaucucauuacuuauuauuggucuguucagauuuuggauuucuucauggugcaguuuugguagcuugucuguguuuaggaauuuguccauuucuucuagguuuuccaauuuauuggcauauaguugcucauagcagucucuaauaauccuuugaauuucuguagaguccauuauaauauguccguuuucaucucuaauuauauuuauuugugucuucuuuuuuucuuaguguggcuaaagguuuguugauuauuuuuucaaaaaacaaacuuauuucauugaucuuuuguauuuuuugguuucgauuucauuuauuucugcucugauuuuuuuuuuuuuuuuuggagacagaucucacuguguuaugcaggcuggucuugaacuacugagcucaagugaucuggcugccuuggccucccaaagugcugggauuacugcucugaacuuuuauuauuuauuuucuucuacuacugauucuggguuugauuugcuuuuauuuucuaguuauuuacgaugcacuguuagguuguuugaguuuuucaacuuuuuugauauaggggcugauuggauuaaagaggauuaaacuuuccucuuaguacugcuuucacuguaucucauaaguuuuaguauguuguauuucuauuuuauuuguuucaauaauuuuuuaaauuuucuucuucauuucuucauugauucacugguaauucaggagcauauuguuuaauuuccauguguuuguguaguuuccaaagguuuuuuugugugugugugugagauagccuugcuuuguugcccaggcugcagugcaguggcacaaucauaacucacugcagccuugaauuccugggcucaagcaauccuccugccucagccucuugaguagcugggaccacaggcaugugccacccaccuggcuaauuuuuuaaaguuauuuuugacugggcaugguggcucccgccuguauucccagcacuuucggaggcugaggcaggcagaucacuugaggucaggaguuuaagaccagccuggccaacauggugaaaccccaucucuacuaaaaauagaaaaauuagauuucuugcuuuuuauuuuuuguguaucuguuguagguuuuuugauuugagguuaucaugaggcuugugaguaacaucucauaacccauuguuuuaaacugaugacaacuuaauaccgauugcaaaaacuaacaagcaaaugccccuugcuuuuuaacuuuuuguuguuucuauuuauaucuuuuuauacugucuuuaucuuaaaaaguuguuguaguuguuaguuuuaauacguucaucuuuuagucuuucuacucaauaugugagugguuuauauaucacaaauacaguguuacaauauucuguguuugucuguguacuuaacuauuaccaguguguuuuguaccuucagauguuucuuauugcuuuuuaaccuccuuucagauugaagaacucccuuuagcauuucuugaaggacagaucugguguugaugaaaucucucaccuuuuguuugucuaggaaaguauuuuuccuucauguuugaaagauauuuuuccuggauauacuauuaaaggauaaaaguuuuuuuccgucagcacuuuaaauaugucaugccacucucuccuggccuguaagguuuccacugagaagucugcugccagauguauuggagcuccauugcauguuguuucuuuucuuuugccaguuuuaggcuccuuucuuuauucuugaccuucaggaguuugauuauuaaaugccuugagguagucuucuuuggguuacaucugcuuguuguucuacgaccuucuuauacuugaauauugauaucuuucucuagauuuguuauuaucucuuugaguaaacuuuuuaccccaauaucucucucucugccuccuuuuuaaagucaguaacucuuagauuugccuuuuugaggguauuuucuagaucuuauagccaugcuucauucuuuuuuauucuuuuuucuuuugucucuucugacuguauuuucaaauagugugcucacuaauucuuuuuucugcuugaucaguucugcuguugacagacuuugauguuuucuucaguaugucaguugaauuuuucagcucuggaauuuuuuuuuuuuugagacagagucuugcucuguugcccaggcuggagugcaguggugugaucucagcucauugcagccucugccuccuugguucaagcaauucucgugccucagccucuugaguagcugggacuacaggugugcaccaccaugcccagcuaauuuuuuguauuuuaguagagacaggguuucaacauguugccccggcuggucucaaacuucugagcucaagcaauucgccuaccucggccucccaaaguguugggauuacagguaugagccaccgugccuggccacucagcucuagauuuuuuuuucucucucucucuuucuuuuuuuuaaagucaaccaguauaucuugaagccccagaauuugauuaacauuuuaaaauuauuucaaucuuauuguuaaauuuuucuaauaggauuccaaauuccuucucucuuuuaucuugaauuucauugagcuuccucaaaauagcuauuuugaauuaucugucuucauggucucauaccuuuguuacucgggaauuggucacuggugccuuauuuaguucauuuggugaggucauguuuuccuggauggucuugauguuuguggguguucauugauguuuggacauugaagaguuagguauuuauuguauucuuuguauccuggguuuguuuguaccuauccuucuugggaaggauuuccaaguauucaaagggaauuuaguuuugugaucuaaaucuuuggucacugcagccaugucugcaucagggggcaacccaagcuugguaaugcugugacucuugcaaacuugugcagguacugcuuugguugucuucaguaagaacugggaagacucccuggauugucagggagagucucuuccuuuccuuuaguuuucaccaaacaaauggagucucucugucugcugagcugccuggagcugggggaagggugaugcaugcaccccuuuggcuaccacuacuaggacugugcagguuagaccugaagccaauauggcacugugucuugcccaaggccuacagcgacuacuaccugggcuaucaguaacauucacucaaggcccaagagcucuucagucagcagguaguaaauccagcuaggcuugcguccuucccuccagagcaucaagcuccccugcccuacuccccguaccccccaaccccagcccagggcagguacagaaaugccauccaggagccagagccuggagucaggaaucuuagaaaucuacuccaugcuguauucugcugcaguuguguuggcacccaagccacaagacaaaguuuuuugcacucuucuuucuccuuugcucauguaggaguuucucucuguggccaccaccgccccaggcccacagcaaguacugccuggcuacugccaguguucacucaaggaccaagggcucuucauucaguguuuggugaguaaugccaggccuguucucucuguucagggcagcaggcuuugcucuggcccaugcuggguccagaaaugcugaccaggacccaaggccuggaaucaaggaacccaggagccugccugguguucuacccuacuguggcugagcuggugcccaagcugcaagacgaagucccccuuucucuuccuuaagcagaaggaaucacucuuuguagccaucacagcugagaaugugcugggucacacccaaagccagcaggacccugggucucacccaagaccugcagugaguaccgccuggguaccacuuauguguauucaagacccaaggggucuuuagucagcaggugaugaaucaugccauggcugcguccuucucuucaaggcaguggguucccuucugucccagggugucuagaaguguugucugagagcuacagccucgaaugggcacuucaggacucugcccagugcccuauucuguuguggcucaccugcuauccaaguuccaagacaaagucuucuuaguccuccuuacucuucacucuccucuccccaaauggaaggaaggagucucucccagagcugugagcugcacucccuggaguuggagaaggaguggugcaagcauucucuuggcugccccagcugcuaucucacuggguugcaugcacgccaaguccacuggcucugagcccagcacaguaccaggacuugccuaagaauugcaguccuuguggccuagagugccuuucaaguuuauuuagggccacagaaggcgguaaccuguggugguagggcuagccggaacgcaguuucugacugcuuggcuggaugauaccccucugccuaggacuggucuaaaugcucccuccaggggcaccagcugaauucugccccauguugcuuuccacugugacagggcagcaccgaguuccaaugcaaagucucauaaucacuacacuuucugucccccaagcacguugauauacucuguccacaccacguggcugcugcugggaaugugggaggggugguguugacaauucaagacugucuuuccuacccuuuucagugugucuuuccuugauaaggguuaaaacaaaguacuuuguuuacucaccugauuuuugguuuuuauagaggugcuuucuuguguaguuuguucaauuugguguuucuucugguagcaugauugcuagagguuuguauuugaccaucuugcuccaauaaccuaaauaugauuucuugaaaguuuuuuuuaccaggugugauguugcacaccuauagugugcacacccagcuacuuacaaagcugaggcauugauugaguccaacauuuugaguccagguugggcagcauaacaagacccucaucucuaaaaaauaaaaauaaauguuuaagugguuuauaaauugucaauaaauaugaaguacagucagcccuccaggucugugggcuccacaucuguggauucaagcaacugugaaucaaaaauaaauuuuuaaaaauuuuuacuuauuuauuuauuuauuuuuagagacagugccuugcucugucucccaggcuagaguacaguggugugcucauaucucacuguaaccuagaacuucuggacucaaaugauccucccacaucagccucccaaguagcugggacuacaggcacgcaccaccacacccagaucauuuuuuaauuuuuuguaaagauggggucuugcuauauuccccaggcuggucuugaacuccuaggcucgaaguccugggauuacaggugugagcuaccauaccuggcuuaaaaguauuuuuuaaaaaugggugguuuuguuuguacugagcaugugcagacuuuuuuuuccuugccguuauucccuaaacaauacaguauaacaacuauuuacagaacaguuauaauguauuagguauuauaaauaaucuagagauuauauaaaguauaugagaggaugugcauauguuauaugcacauauuacaccaucuucuauaagggacuugagcauucauggauuuugauaucugcaaguguuccuggcacuaaucccccacagauacugagggaugacuuuaucacucuuaaaaauaauaauaguaauuaucuuaugacuugcaauauaacagaugacaaauuagaguaucuuucaguacuuaagaauaucucuaaugaccauguuuuugcuacuaauacucuuccuuugaucuggccaaacugguggguaugugguuaaggcaaggccagagaugguucuucauccccuuggccacagugaucaguccagguaugcgcagugaccuaagcuguccuuucauaaacuuuucaaaaauuagagcugauaggaaagacucuugcuucuuucaugggggaguuaacaaggaugaaagucuggagcuaccucuagauguguuacuguauuggagaaaguuguggaaagaaggaggaaaugagauagccccagaggucaugaauaggaaaaagagacaaccacaggccaucaugguacucuggucuuuggauucucucuacccugagauuagcuuugccccaagcuuugaguaguucagccauuauccgcuaaggaauucucccuuuguugaagcuaguuugaauuggauuuuuuuuaagagcccugacuaaaacauggaaggaguauguauauacaaacacguauuaauuuuuaaagaaguaacaguauauauucagaaaaucacaugaaauauaaaucagccugaugaauuuuuaccagcugaacaccuguguaaaauauggcucagaucaaaaaccuuccgucacaaccaucugaugguaaccaccauaugaggcaguguaucuuaguaguuaacaagaacacagguuuuggguuuuagaaagcagagauuugaauccuuguucuugagagucuguauaacuuuggauaaguugccuaauuucucugaauuccacuuuguucauguauauaaagggauaacacugucuuuuauauuuauuuaaggauuaauuauuguuacaugggucagcugucaacccagaguuauugcuuuauauuccuuaaacuuaucagaguacuuuauuucauggauuaaaaaaauucucaugaggcuuaaaauuucuuguaaaugaaaaaucugaaauacuagacuucuaauauccaaagguagaaaaguggguauuuaguugguguuuguugucuaacaugcauacagcaaaaucaugauuaaauagcacuuauaaaccucaauuuugcuugcuucagucacugaucauguuuuccaucucuuccucuuuaaugucacuuacuugccaaaaauaagacuuauccuagcagaaauagauagguuaguuuaguugcuguaacauuugccuuuucacuuaggauuuuucuucccuauuuugguuaugaaguucuuaauuuuccuccuacacacugucuccaguuuggguaucuguagccuaaauaauuuggguuuuaguuuuauuuguuuacaaggaaaaaagaaacuauacuaugugauaguugaggguuugacuuuagagguuaucuaguuccuguuaaacuuuuugcuuuauaggcaagaaaucggacacccuuagaaguuaauaacuugaucaugaauuagugauuaaaaccaaaacuaaggucugcugacuuuuaggccacuggucuuccuguccuaaaguuucuuugagaaacagaccgaagagacuuugauguaacucauuuguuuaauuugagagguuuuuuuuguuuguuuguuuguuuuuaggugaccucugaugucucugucuuuggagaaguauacacuuuuuuuuuuuuuuuuaaagauaggguuaguauuacagauacauauguguugauuuaacaaugacaggaaugaugaugauguuagaguaccaccauacauuuaaauagcauuuuucccaagagugcuucuguauauagucucaugguuuaauuuauugugauaaugaaauaaauuaacucagugguuauaacaagauauaagaaguuauauugguuuucuaugucuuucauaacaaaugaccacaaacugggugacuuaaaacaauagaaguuuauuuuuuucaccauucaugaguccagaaguccaaaaucaaggugucagcaaggauggguuccuucuggagagagacugugagggaaaaacuguucucugcuuucuccuaacuucuagugaacaauccuuguuguucccuggccuguagauucaucauuccaaucuucaccucaaucuucacauugccuucuucacacucuuucuguguucucuccuuuucuuaugaggacaguagucauuggauuuaagucucaucuaaguuaagaucuuaucuugagauccuuaacuaauuacaucugcaaagaccuuauuuccaaauaaggaacuauucugagguuccggugcaugugaauauuugugggacacuauucaaccuacuacugaaggauaacugaaguauauuuacugguuuuaauggauuucguguggagauguguagcuuuauuuccaucuguguagcuguaucguagaccaccagugaagaacugaguaagagaaggucaggaucccaaauauuuucuucauguucuuaaaaguuacgauugucgaacaccuagguccucuuuuuuuaaaaaaaauuuuucauuccuuaaagauaccuugcaaaacaggaagugagaauuucuuuucuuucuuucuucuuuuuuuuuuuuuuuuugaagcagggucucucuguguuaccuguguuggaguacaguggcacaaucacagcuuacugcagccgcaaccucccaggccuaagcgaucuucccgccucagccucuggaguagcugaggcuaugacuauaggcaugcacuaacacaccuggcuaauuuuuuuauuuuaauuuacaaugagacccugucucacuguguugcucaggcuggccuugaacucuugggcugaagcaauccuccugcuuuggccucccaaagugcuggaauuacaagugugagccaccaugccugguaccuagcuccucuuauaugaaguguuaaggaauacguuuaugcaaaauuaagcacaauuuucugcuuucaguucuuauuaaauagauauuuggguuguuuaaccuaacaguuaugagguuuccuuucuuacuuauuauaaauaauaauaacauucuuucacuuuuaaaaaacugcauguaaguuaaaccagaguguauauuucucaauguccuaaucuuggaggauugucaaaccuacuuugugauaaauuauugauugucucuuaaaaugcugauugucucuauugggaccaaaaaacauugaauauaaaaguuuacauuuagauguguauaaaauauuaaucuguuguuuuuguuauaaaauuggagcaguugagucgacaugugcaguuuaaaaaauuuauacucuuauugaaaucaaauguaugagaauauuauuuuuucuauaacugcuacaggcuaccgaaaagccauuccugucuuugaggcuacaggauuuuguauuuggggcuaauuauacacaacaauuuaaagugauuauguacuagaggacauauuuggcuguccuagguuagcugguuuuauuuuuauuuagcaacuuugggugaguuucuuaacuuuccuaagccuugguuucuuuaucuguaauauugagauaagaauccuuuuaaaauugcugugaugauuaaaugacacaacauauauaaacaccaaguacagugcuugguguauaguagguauucaauaaauacugcuauagcacuuccucucccuucuguucacuuuugcuaaauauagacuguuguuauuaaucaaauguuaaauuaaagguuuuuguuaauugcucuuuuuuuuugaggcaggcucucacucuguuacccaggcuggagugcaguggcacaaucacgguucacugcagccuugaccuccucggcucaagcaauccucccaccccagccucccauauagggacgugccaucaugcccuguuaauuuuuuguuuuguguauuguagugauggggucucacucugcugcccaggcuggucucgaacuccugggcucacguuauccucccaccucggccucccaaauuguuaggauuacagucaugagccaccuuaccuggccuuaauuguucucuuaaauuggacauuucuauaucaguuaaaauggaaaaacaccauuagaaguggucaguuuuccuuuguauuuuugaaaauuauguacuuacauuuaauugcucucucccuuauucuuuaauuucuuuuuuuauuuuuauuuauuuauuuuuauuguuugcuuuaauuucuaacacaauuuuuuccuuagggugugucauucuuuaucugggauccuuugaaguacuuuguuuucaugguaaagagggguguuuuaggaaggaacaaaacaaaugaugcauuaaaaaguggauagaauagauagcuauaaaggcagauauaguuucaguuauaucuuacacuuaauucuacaugguaauuuugaggaaugcacuauccuacguggugaauuuucuggguauuuuuuuuuaaaugaucaaauuuucuuuuacuuuugacucuuuccuuuaacacugcaaauagaguagaaaugaccauuuucuaauauuuuccugauuuguggugguuauugucuauuaugacuuugguuauaauacauugugauagaucuguccuuuauugugaguucucaguuuagccuuaucuugauuuguuguuuaaucaguuugcagaauuguagguaaauaggccaggcacaguggcucaugccuguaauuccagcacuuugggaggccaaggugggcagaucacuugaggccggaaguuugagaagagccuggccaacauggugaaaccucgucucuacuaaaaauacaaaaauuagccagcugugguggugcaugccuguaaucccagcacuuugggaggccauggcaggugcaucaccugagguugagaguucaaggccagccugaccaacauggagaaaccccgucuccacuaaaaauacaaaauuagcugggugugguagcgcaugccuguaaucccagcuauucaggaggcugaggcaggagaaucgcuugaaccuggaaagcggagguugcagugagccaagaucgugccauugcacuccagccugggcaacaagagcgaaacuccaucucaaaaaaaaaaaaaagaaggaaaaauagaaaaaaauaccuuucacucuucccuagcaguaccuuuuuaggcuucuacacaguaauguuuauagacuccaaggggauccaucuauaguucuccuuaguauaaaaguacugaguucauaaaaacauuaucaguagaaaauucuuuaagguuuuugaaaugucuuuuuuacaguguuaaggcacuauaauacauacauuucuacauuuuuaacauuuauuuuauauuuguucucuuuagaaguuaaguguuucauaauagaauguuuuugguuuuuguuuugcaaauaccuugguacaucaagacuaggaauuucuauauaguauauaauuuauuugaaauacugcagucauuugcuuaugacuuuuuuuggauaaaaggaauaguuuuuccguuaaaaggaagcaaucauuggccuguagcgguugccagauacagcaccuaaaaauuaaaguaguaguuuacacagguaugaggagauccaagaaaugaugcuauuugaauagagcugaaguucuuuauugaauaaagcuucuuauaccugugggguauuggaaagaaaaauauuuuaugacuuacuggaaaacuagccuggaaucuuuuucauuuuuugaugaauagguuuaaaacagagauguucaucaaugauauaauauuugccgguuauauuccaagugucuugcagucaguuuauuuuuaaccauagcaacagacaugauggugaaauaaaguaguagauuacuguuggcagccuaaaauuaggcaaauguaccaacuuugaaaggccugggagugacuaaaacacuguaguuaaccugcuguauguuuacaguucuacaaagaaugacauaaaugccauuuaacagguaaacuuagaagcuaaauugcucuuugccuaauggaccauagaguuuauucaaauaaaagcuguagauucagcaccaaggauugauucacagagaauaaaaugcugaagauauacaaccuaaaaguuucccauuugaacuuuugcccugaaucaauauccuuauuggcauauauuugccuggccauuuuaagugaagucuugcuuuaguuugcuuucuguuuuuggugucuuuuucucuaccccugugauggauucgaauuacaaagaguucugguuuaccuaguuuguggagaagggggauaguguaaucucuaaugaaguaggaugguauauaaagagcuaguuaguaagguagccuuauuaaaauguacuucuuuuacagcuuuggggaaucagaggaaugacgucuuauuuuuccaaucucaaaaugguaggcagcaggguguauuucuaauuacugcuguuuuguccacugugacacuuuauuauaugguucauuuuuauuuacugguagaaaaccaaggaguaaauuacuagguagaaccuccuuacauugauuucauauaaggaaaauucaguacauuuaguuuuaccuauagagauugauuuuuaggauuaaagauuuuuuuuuucuucccuguccaccucaccuggucucaguguaguucuaaagcuaaaguuuauuacacauggauuauuaaagacuuuuuuuuuuuuaaccaagacuuucucuuuccaaaaaaucauguccugauaggauuuacacgcauuuauguuuaaauaacauuuaugaugugccuacuauguaucaggcacugaguucccuguuuuguuuuguuuuuuuuuuuuuuuggaagauagguucuuacucugucgcccaagcuggagugcaguggcacgaucauggcucacugcagcuucaacauccugggcuccuaccucagccuuccaaguagcuggggacuacaggagugagccaccauccccgcuuaguuuuaaaaaaauuuucuguagggauggaguuucuccauguugcccaggcugggcucaaacuccugagcucaaguuauccuccagccucugccuccuagaguguugggauuacaggugugaaccaccuuacccagccccacggaguucuuaucuuuaggaaacucugcaucaugggggagccaagauguaaacaaguaacuauuaugcuuuaugguaaaugcuacaguagaauuaccuugaaaguguuacaggaacucacauaaaguucccuguaaauuuuuuccucuagucaccauucuguuacugcuuuugucuucuaaauauuucucaaaucuguugugaucucccuaccuucauuacucuuucauucuugugccaguuaaauauuuuuucucacauccaccagagugauuuaucuuaaacaaaaauuugaccuugucacuuaucuuuuuaacacucgucaaagccuuucuuucauaugugguauaaacucuuugcaaggccuauaacgauuuuucuggucuaauuccaguuagcuuuguagccucauugccuaccccuuucagccuucaacuuuucuuaccuucuaacaccaucccuccaaauaaaacuguuugaagucuucccaugcuauuuuucaccuuaguguuuagacugcccacuuaugcuuuuaauuuuuuuuuuuuuuaacugaaguugcuccuuaaaacucaaagcuggcaucuuccccucacggauaucuuucauaauccccugaaaacuggauuagguaucuccuccugcuagugcuccuaugggaaaguuguguguguucuuuuuguggcagugguauagcgcuuuuuuuuuuucuugauucuuucucuuuacaguuuacagaguaauauuguaguuaccuagcauccuccaaaggucaccacuguguugcuuguuuguuuaauuaucauuaugaacuuauggcuuuaaagauauuucauauguuuccaccuguuggaguuauuguccauaauaaugucuuucccauugucagacagauuguucugucuuaauaauaggagcuuauuuagguuggcuucugaaucuuuuugacaugacccuaguaguaugauaguauucacugaggaaaaaaauuugaaaugggagcaauuguuucugcauggagacagggaaagcuacagagagaucuugauccucuuuuaccauccuagauauaaacauucugagauguuccauauaagcuaaauucauucugcuccauuuaacaauaauuaccugggaaucuccucuuuuuucuuuuuuuuuuuagacagagucucgcucuguugcccaggcuggagugcaguggcacgaucucagcucacugcaaccucugcuucccggguucaagcgauucuccugccucagcccccugaguagcugggacuacaggcaugcgucaccaugccuggcuaauuuuuguauuuuuaguagagacgggguuucaccauguuagucaggcuuggucucaaacuccugaccucauguuccacccagcgcagccuccuaaagugcuggcauuauagaugugagccaugucacccagccaaucucuuuuauaauaucaauuauuauucuacuucuguauuacagugguauuuuguuuauucuacugcuuauuacagccugacuugauaauuaaucuccccugcuaauccaugagaguaagaaucauuaucuuuauaucgccauuauuucagggucuuacuguauacuugguacuugguaaauguuuacugcuuugauaacagugcugucaggagacaguauuuauauuaaacuucuaauuuauauaguuuuuuauucuuaaauuaaguaccuuugaugugccauguaucaagccaggcacuuauuucaagggacuugauuugaguugucaaaucugugaaauaggcucuuuauacugauuauuacauuaaguauuaggcugggcucgguggcucaugccuguaaucccaguacuuugggaggcgaaggcgggcagaucucuugaggucaggaguucaagaccagccuggccaauauggugaaaccaugucucuacuaaaaauacaaaaauuagucaggcaugguggugcacaccuguagucccagcuauuugggaggccgaggcaggagaaucacuugaacuugggaggcagagguugcagugagucaagaucacaccaccacacuccugccuggaugacagagcgagacuaccucuccaaaaaaaaaaaaaaaaaaaauuauuaaacguaauaguuuauucuguaguaacauuuccugaagugugcucuacaugauguuaauaaguauuaggagaauaaaaggauuuuguagucaaaucaguuugggaaauauugagugagacacaggcaaacaaguuauaugauuucaggauuuuccagugcaaauaaugugcaguugacugucuaagaggcagacagagaaaauaucauuucucaauuuauuugacuuaauuuuuuccccugaguaucuguugaacauacuuaggaaaauacuggccugugguuaacaaguuacguaaaagaguguggugcaguggaaagggcauggaauuggaagucagaagcuggguuuuaccaucuguaaaaccugacgucucuuaaagccucaauugucucgucaguaaaaaaaaaaaguuaauacuggucuguacagcauaagauuguucucuuuaauggucucuuauuugauuucaaaugaaugaauagcaauaauauguuagguauuuuuaaaauaaguaaccaaguuauguuaauauuuuuggcauuuaaauugccuuaaaauaugacauagcuuuucuuguuauaguaaacuauuagaaauauguaaacaaggauggugcuguagccuugauuuauauuuuguacacaugauuuagucaggguuauguuuuagaaugauaaaccagaguauaugcuaugaugaguaguaaaagaaugcaaauaggcauauacauucuuuccuugucacaugcugcaauaugaaggaaaaggaagcauuagguaauagccagaugacauaaugguuaauuauugagcuuuugcaugucuguuccuguuguuugcuccauacauauuaguacauuuaguccuuauaauuacccuuugauuaauaauacuaauuauuuuacauguuguuaaggcuaaguuggacuucuugaagaguuuuguguauuuuuauuugcuuuuuaaauaagcccugacagcuugccugcuggcaagauagcccacagaagguaauacagggagaaguauaugacaaugauuagggauuaaauguaacccuucccagacaucucuuagugaucagaaccaaggcaagugaacguagggucguuuuuguggauggauauuaaugaaauuacugguggguaagagcacagcuauggagccagguugucuguguuugaauuccuguuuauugcuacuauuuaaccuuguacagccuaagucuuuauacuguaaacauagagauagcuguaauaccuacuuaauagugcugugagaauuaaauaaguuaauacguggaagggguaucagcacuugauaaaugcugacuacuuauuauugcuguuauuguaauauugugaacauuaacugccucaacuggcauuugaggaguaaaaagcagagacauuaguauacuucaguaacugugguuggacuuucuauccaaggugggggaaagggcgcagcuaaggaguucugguguaucauaggaaaaaauuaucuaauaguagauagcaguugacaagaguaugugagagcuuucauuuuuuucuccugacaucaucuuagauugggugauagacaguguaauaaaguaaauacuuaaucuacagcuugaugcuguaaaacaucugugcaguucuccuuuacauacgaucuuuuguuuuaguagauugaugaaucccuguuuaaggaauuuacaaaguuggcagaacuuuaaagcaaguuguauucuagggggcaaaucaugcccaguaccuuuuauaaaguaguuaauacagaugagaggauaucauaaauauacccauuaauguuaagaaacauuuccuuuuuuccccccauucuauauaaaguaccuugguggaaacuucccagucuccuuggauggcauuuagccuuuuauaugugaaagaaguaauaaaauuggaucuuuuguuuuuuuuuuugagacagggucucacuuuguugccaggcuagaguaguauccugcacuaucauagcucaaugcagccuccaacuccugagcucaagcagucuuccugccuuagccucccaaguagcuggagcuacaggcaugcaccaccucgcaaguggcuaauuaaaaaaaaauuuuuuuuuuuuuuuuuuuuuuuuuuuugcagaacagagucuugcuuuguugcccaggcuggucuugaacucccggcuucaagcaauccuccuaccucagccuuccagagugcugggacuacaggcaugugccaacucgcccagccaaaauugaacuuuuuauuacaaucaugaauacaaagaaaaagugaaagcuauucuucauauucugauuaauuaaaaacaaauuucaguaagucaaagaauggauauaccugaaauggguagcacauuuacuuaauucucaucuaaacaaguaauuugaaacgguuucugcuacuaagaauagcaauuuccacaaauugcuauuauuuugagaaaagacaaaucagauuuauccuaggaagguagcauuagauaauggaaagccuaugggcuuuuaugcuugcagauggaauccaacuucuguguuuuaaaaacuaucuggccuugggcuaacaucucugagacucaguuuccucacguuuaaaaggggaaugauaauguugacuuuuaaaugauuuuugagaaaguucuagcacaguaucugagaaauuuuaaaauaaauauucccuuucauuuuggcuugaacaacuugaauuuguaccacacauaaauauagauccuauucguacuuuauuaaucuuagugacuuaaaaaucaagcaggaaaaagcaaaaaaacaaaaaagaucuuuggaauagaacauccugucuuucagucugguucugucauugguucucuuuugacuuugagcaaguuauugaaggucuuuacaucuguuucauuuuuucaguuuuuaaauuuuuaauugauacguaauuaauuauacaucuuaugggauacauguaauauuuugauacauacaauggguaaugauuagaucaggguaauuaggauauccauuaccucaaacauuuaucauuucuuuguguugggaacauuuuaaaacuacucuuccagcuauauugaaauauauaauaaauuauuguuacccuccugugcuaucaaacacuagaacuuaauucuuucuauguguguuuugcacccauuaaccaaacuuucuuuauccuccucacuucccagucuccuguauuacucucuaccuccaugagaucaacuuuuauagcucccauauaugagaacauagcaauauuugucuuucuaugacuggcuuauuucauuuaacauaaugaccuucaguuccauccacguugcugcaaauggcaggacuuccuucuuuuauauugcuagaucauaugguaguucaauuuuuaguuuuuuaaggaaccuucauacuguuuaccaugguggcuguacuaauuuacauucuuaccaacaguguauuagcauuccucuuucucuagaucucaccagcauauguuauuuuuugucuuuucaauaguagccauuuuaacuagagugagaugauaucucauugugguuuugauuuguauuuccccgaugauuagugauguugaguuuuuuuguuguugcuguuuuuguuuugauuuuuuaacauaccuguuggccacuugguuugucuucuuuugagaaauaucuauggcgaucuuuuacccauauauuugaauuggauuauuuguuuuuuugcuguugaguuguuugaguuccuuauauauucugguuauuaauccuuuguuggauaguuuguaaauauuuucucccauucugcagguugucucuucacucuguuguuuucuuugcugugcagaagcuuuuuaguuucauguaauuccauuugucuauuuuugcuuuuguugccugugcuuuugggguccuaccccaaaauucuuugccuagaucaguguccugaaguguuucuccaauguuuucuucuaguaguuuuauaguguuagguauuacuuuuaaaucuuuaauccauuuuguuuuuuuuuuuuuugguauguuguauuaggguucucuagagggacagaacuaauggaaaaaaauuauauauaugaguuuauuaaguauuaacucacacuaucacaaggucucacaauaggccaucugcaggcugaggagcaaggagagccaauccgaguuccaaaacugaagaacuuggaauccgcuguucaagggcaggaagcauccagcacaggagaaagauauaggcugggaggcuaggccaggccagucucucuuuucacauuuuucugccugcuuguaugcuagccacacuggcagcugauuagcuugugcccaccuagauuaagggugggucugcuuuucccagcccacugacucaaauguuuaucuccuuuggcaacacccucacagacacacccaggaucaaaacuuuguauccuucaguccagucaaguuugcacucaguauuaagcaucacaaguccaccccuugucaaccugaacccauacacaucuccugagaucauauauaaucuucaaauaaagacaauaauaagccuaacauaacacagcuauccuuuguacaaccagaaaugcaccaauccccauuccaaauacuauuacauaaaguuaacaauacuuaaaugcugaugugaagucaauaaaucuuuauaucacaugauaaaggagaaaggaaauaaaaaugaagauauuuucuuaguauaaguguauacaugcacaaacauuuuuaacaaaagaaggaggaaacacucaugacaguuacaguccuuguuucugcagcugaucguguggucguagcugguauugaugacuaccuucuucuacuacccauucuguauucccuuggccuucagcaagcaccucagcaagucaugguguuuucucugguggagugacccaaaccuucauuccugaauggucucggggucauuuguaguccugccugaauugggcuguuguaguuucccauugaccuuaaucacacggcauggugauauuaagagacgccuuaauggaucuuguguauuccaugaauacucuuccuuaccuccguuguggaguaguagacugauuucaucuugauaguccaggccaaucacuguaacucccuucuuagccuguugacuuaaagguagggggagcccaaaguguccagguggcaaucuuaacuuccaguuuaauggaguugugucuccucuuggcaguguuccucccucuggaacuaagaccuccaggccaggagaacguaaugucucaggaacaggaagcaaaaauuuuacuaguguaucacuaggggugaugguaaguggugcuacuuccaauucuaccccuugauuccugaaccugugaauccuggcuauuggagaaacaguaccauauauuggaugcugauucagagcauacacuuugccccagcccugcaaaguauugucaccuaguugccguuguaauugugacuucgaaaggguauuccacuguugugucaauccagcugcuucagaaugauggggagcaugguaagaccagugaauuccauaagcaugagcccacugccacacuucuguagcuguaaagugagugccuuggucaaaggcaaugcuguguggaauaccaugauguuggauaaggcauuccaugaguccaugaugguagucuuggcagaagcuugcaugcaggauagguaaacccauaucuggaguaaggguuuauuccagugaggacaaaccucugcccuuuccgugauggaaaagguucaauauaaucaaucugccaccagguaacuggcugaucaccccgaggaauggugccauauggagggcucaguguuggucucugcugcuggcaaauugggcacucagcaauggcugcagccagaucagccuuggugaguggaaguccauguugcugagcccaugcguaaccuccaucccugccaccauggccacuuuguucaugggcccauuggacgaugaugggguggcuggggaaagagacugaguggugucauccucuccacuugauuguuaaaauccugcucugcugaggucacccacuggugagcacucacaugggguacaaauaccuucacaguuuuugaccacucagagagguccauccacauaccucuuccccagauuuguauaaacuaaguaggaaugcaauaggcuuccuaucaguuuuacuucuaggaacacugugauuaauuagccaaugccagagcucuacaugagucagacuauucugauugccgcuuugccucugcuguccauuaugguagccacacccaccuugccuuugaugguugauugcugccacuuggccccugccaccucaggauccaguuauucccauuguaauuuaaauuuuguaguugagugacugcacuucccacuguuagaccugacauaccugaaagagcaauuacagggcucuucagagaugcaggugcugcccucacaaaucuaguucacaaggcauuggucaagaguaccucuucuggacccuucuagcuggggaggucaguaggucuaaagugacuaauccgcuccaccaucccagucucccuaagccuuuagaucccuuccucuacauuaaaccaagggagaucagacauuucuagcucacucagagugggccaucuuuuaauccggauuucagcaaaccaagcaaauaaacuauuagaaccuuuuuuuuuuuggagacagagucuugcucugucaccagacuagagugcaguggcacgaucucagcucacugcaaccucugccucccggguucaagcgaguccccugccucagccuccaaguagcugggauuacaggcaugugccacuaugccuggcuaauuuuuuguauuuuaguagagacgggguuucacaauguuggccaagguggucucgaucuccugaccucgugaucccccugccucagucucccauagugcugggauuacaggcgugagccacugugcucggccuagaaccuuuuuuaacucccggagcugcagcauuaaaugcagagucccuacuuagugggcccaaauccauaaauucagcuugauccaacucuguguuccuuccgccguuaucccacacccuuaacauccauucccaugccuguucugcagauuucuauuuauauaaauuagaaaacucaagcaguucuuuuugaguuuagugcaccuccucaucagucacacuaucaacccccccaucucuaggggccggcugggacuuuagucuaguuauaguucuagaagcaaacaggggugugagagguggcaccugaggagaaucaguguuaucuugccucacagcugccucaggggaggccaucacuguugccucaggcagcacaagguuuaucucuucagacaaagguggaaaggcugauggcagcaugggucggggaggggauguugccacuacuggggaugaggaagcuguuccuucuggcaaaaaaagauucaucagaauuuacaaacucaguguccugccucaucaggguccucccacacgucuccauuccaaguuucagggucgcauucuuuucuaucaaugcccucacuuuaacaguagacaccuggcgacgcugugcauguaccuuucagugaaggucagccacuugcgugauaauagcuugugucuguuuuucuacaauuucagcuauuucucuaggggagauaagacucucacccagggcaaucuuagcagauuugaggcucaguaucugcuucugaagccaggagauagaaucccugaguucauaauuuucuuucaucacuuuguccacugaacuuaggagcaaccaaccaacuucauuauguuccuugguucuccacauauggucaaagguauuguguugagucacuaaacuccuugccucucaugagugaugaaucaggagugucaaaugcauuuauuuugcaaaacucuccaaacaguucaugccaaggacuaacaguguucuccauacuauuagaaauagaguccuuagcauuuuugggucuaaucacauuaagcagccaacuccagaaaccccaaaaccaacaaaagaacuccauccuuaauauucuguuccucuagaaccacuccugguaccaaaaucuguuggucaagguucucuagagggacagaacuaauggaauaacuauauauauaaaggagaguuuauuaaguauuaacucaugauuacaaggucucacaauagaccgucugcaagcugaggagcaaggagagccaguccaaguuccaaaacugaagaacuuggaauccgcuguuccagggcaggaagcauucagcacaugaaaaagauauaggcugggaagcuaggccagucucucuauucauauuuuucugccugcuuauauucuagcuacacuggcagcugauuagauugugcccacccaaauuaaaggugugucugcuuuucccagcccacugacucaaauguuaaucuccuuuggcagcacccucacagacacacccaggaucaauacuuuguauccuucaauccagucaaguugacagucaguauuaaccaucacauaugugguaaaauauaggggucuaguuucauucuucuguauauggauaucaguuuucccagcaccauuuauugaagagacugucuuuuccccaauaaacguucuuggugccuuugucaaaaaucaggugguuauaaauagguggauuuauuucagaguccucuauucuguuccauuggucucugugucuauuuuaugccaggcccauggucuuuugguuacuauagguuuguaauauauuuugaaaucagguggugugcugccuucagcuuuguucuuuuugcuuccagucacuuuggcuagugcuguaugaauuguaggauuguuuuuuucuauuucuguguagggguugcauugacucaguagauuaucuuugguaguauggucauuuucacaacauucuucuaguccaugagcgugggaugucuucauuuuuuugugaccucuuugauuucuuucaucaguguuuuguaguuuucuuacauagaucuuccaccucccugguuagauuuauuccuagguuuuuuaaaaaaauaguuuaauuuuuaaaaaaucuauuccuguguguguguauguguguguuuaaagaaaacagucaucuucuuuaaaauuggaauaacucugucuauuuccaggcuuguuauaaggauuaaacaacauuguuuaaguaaaguaguuggcccagagccuccuauaucaugguuguuauauuuguugacuaauaauaacagguaauauuuauuuauuuauuuauuuauuuauuauuauuauuauuuuuuugacauggagucucgcuguguugcccaggcuggagugcgguggcaccaucuuggcucacugcaagcuccgucuccuggguucacaccauucuccugccucagccucccgaguagcugggacuacaggcgccugccaccacgccuggcuaauuuuuuguauuuuuaguagagacgggguuucagugcguuagccgggauggucuugaucuccugaccucgugaucugccugccucagucucccaaagugcugggauuacaggcgugagaaaccgugcugggccaauaacagguaauauuuauugaacacuucaugugugccacacaaugucugaaaguacuuuauauacauuucaucaucacaaaaagccuauuaaauauauauuacugcuauuauccugauuuuauaacugaggcaacuacgguuuagagaagucuaguaguuuucuuaaggucacacagugccugugugccugagcuagaauucaaaucuaguuggucugggccauaguaucugcacucuuuacuuaacagugauuccacuccccacuuuacaaccaaaucuagccuauuucuuuuacuuuuuucuuaccuggcuuuggguucuuaggugguugagagaaauggcauuaaauuugucaucugugucucauucccugccuggacugccaucaaggaccagcaaaugcuuaauaaaugguagcagcaguuacugauuauuaauacaacuaucacuuuuuaaguguuuuuagucuauuagaagucuuguacauuuacugacuaggucgauuuuggucaguguuauuuaacugaguaaauucaauuuuuauaaaugcgucuguggccaaaagaauuaugaccaguguugauuaaugucuuagauuaggugggaagaugaaguucaugucuuuugaaguuuuuuucucuuuuaaguuugauauauaaaauaugagcaacacuuuuauuagugguaaaaugaagauaauguuuauaucccaucuuucacuguguuucuuugauuuagaagcuaaagaagucagcugggcuugguggcuuacaucuguaaucgcagcacuuugggagggcaaagaggaaggaucacuugcgcccaggaguucaagaccagccugggcaacaaagugagauccugucucuacaaaauaaauaaaauaaaauaaaauaaauuauccaggcauggugguacacaccugcaguugcagcuacgcaggaggcugagaugggaggaucacugugauugcaccacugcauaauuuaagaguguguuuuaaauaauuuucaaugauuuccacucuauaauaauucagauaacacuuaucaaaaauuccaaauaauuuugaauugaguaauguuaaauuguguggguuuggcucuaaaagcuuuaacacuugggaauuauagguuuguuaaauagaacuuggguauuuacccuuaaaguauuuucacccucuguuugauuuaaauaagauauauuugaauuauuuucccaugauuaauggaagucaguaaugaucuuuucucucucuuuuuuuuuuuuuuuuuugagacagaguuucgcucugucacccaggcuggagugcaguggcacaaucuuggcucacugcaaccuccaccuccuggguucaagcgauucuccugcuucagccuccugaguugcugcacgugccaccaugccuggcuaauuuuuguauuuucaguagagacaggguuucacugugucggucaggcuggucucgaacuccugaccucaugauccccgcucucggccucccaaaguccugggauuacaggcgugagccaccacgccuggccaauaaugaucuuuucuuuccucacuagcagggucuucacaguucaucauccaagguuagguuaaguagaaaagcagaaguuaaauuaucuuugcuaaaaugacuuuuuggaaaagguuauuaaucacauaguagcuugauaaauaaauccacucagaacauacugccauguaccagcaaguuggaaaaugaacagucuucauaaauuaugcagaaugguauugguuugcaugcauuaacagcaauguucucauuaaacuugggccaggaaaaaccaccaugguguucugcuucuacuuuucaccacaugcguaaacugugccaacaucagccagcuaagacaugggaaggaaaggaaaccaaggcuguguagggccccuuagcaucaggauuucuggaaacuucucucuuaggaucuguaguuaauguuaauuuuauuccucugucucagccgucugucucuguuucuccuauucaugugaugucuagaauggaaagucuggcuccacuugaguugugugucuggcuuugaaucacuguugggggaaggggaugugcaggaucaaauaacacagauguggagguugguagucccucucagaguauagcaagacuucaguacuuuaugcuuagugauguaguugcccaauuaauucaucuugccuacugcccggaaaaaccaaugcacugagaacagcagguuuuugcagcagagaguugaaaaaucgcagggccaggcaaacagaacaagagagguuauuauuauucaaauuggucuaugaaauuuuggagacuggguuuuguuuuguuuuaggauaauuuggcaagcagugggcuagggaauaggaaaugcugauugguuggaucagggaugaaaucauaggguguuaaagcugucuucuugcacugucagucccugggugggauuacaagaccaguugagccauuuuaugggucuggguggcgccagcuuguccauuagaaugcaggguccgaaaaauaccucaaacaccaauuuuaguuuuacaauagugauguuaucuguaggagcaacuggggaguaggagcaacuggggagguuaugaaucuugugaccucuggcuacaugacuccugagccauaauuucuagucucauggcuaauuuguuaguuuuacaaaggugguuucaaaggaggcuguaguuuugggaagggcuguuaucauccuuccuuuaaacuauaaacuaaauuccuuccaaaguuagcuuggcuacucccaggaaugaacaagcacagcuuggagguuagaagcaagauggagucagcuaugucagauuucuccuacugucauaauuuugcaaagcaguuucagugauugauuuacugauuuuacguaaguauaaaugagagauggguauugaaucaacuagauguguauuuuuaaucucuaaauuaaagauuuauuucuuuaaguauuaaaaaggguggcuuggcauuugaggguuauugagggaccccugaagugacacuguaucuagauagaucuaucuagaucuagcuagguagguggauguuaucuaguucaccuggccgaauggccuuuuuucaaaccugcuuuuauucugugaugccgugguuaguaguagcagugcagucccagguacuuaagccagaaacugucaucuuuauuucuuaugcaaccauauccagugaguuuccuauuccuguacauuuuaucuuacagacauugguccuuucagaccaucucuuagugguaugcaauaguacuuaacuugauucggcuuugaauuugacuuuuugaauauuuuuucuuuguauuuauaacuucuuagaggcagauucuaccguaaucauaguguuacuagcauugagggcuaaucuuuuuaauauuuuuugaggacugaaggaccauagcuggggaggagucagaugagaugguccauggcugcugcugcuucucauauggccaaccccucauggcugcagaggccuaaagaacucgugauggccuucucuccuuggcuucuuccagaaguuggaauucucccagcucuaccacaaagcuguuugccgggcucccuuucuuccauucccucccuuuccuguaugaaccaguugaauuauuuccacaaccaccuaaugcaauuuaaguuacucuucugucacaaagauggaauguuuuuguuuuccuggguaauuggcauauuuuagcauuuuggcucuuuaacucauuuuuuuuccugauguccaagaauggauggauaauugacauagucaauuaucuaucaucuaucugccuuuuuauacuacuaaaauuucuuaugguuuuguuguuaaaauaucucuuuagcugaaaguuucucuuauguaucuuauaggaaaagccaaauuuauuuucauaaauugauuuugagcaguggcaguugcuuucuuaauaacuugcccucuucuacucacaguacuuuuccaugagaaauguauacaaaagcaucuagccuaacaccuaacacuugauuguuaguugaggguauuagcucccuuuuccucuugauuuguaaaauauugguuuuuauuauaaauguuaaagugauacauauuuaucauaggaaaaguggaaaaugcagguuaaguauaaugaaaguuagaaucacacaguugcucuacuguugacauuaugacuuuuucccaacaauauuagcaucguauuuuuuauuuuccuguuuucauguaacauaaccaaaaguauguucucacauuacuaaauuuuaaaaacauaauuuuaugaccauaacauuuuauucucugaguaugccauaauguauuuauuaagccauuccccuguuuacaaauagcauucguuaaguugucaaacuaaucuuuuauuuguuuaugagcuuucuagagguagagauuucucaguaacucaguaaauaggaacauuuucaggcuuuuaagacaucaguccccacauauaaaaucauucucccaucuuagcugccaucccauccuguauguagauacccuguucaucucucucaagaucuuuauucuagaccuucuuugucuuucuugggcuccaacaccucacaccaagaugucuuacaaguggaugcccuccuuacccugcuugaguuucuguacccugugcuuggucauccccacauguggucauccuucucgcccugcucaggcucugacucuccucacccccacaacguccuccuucacaucccgcuuggauugauaccccaugccuggcuacacacgugcaucaggcucucuccacuguagcucuggcaccgugcuuuaggcccccaugguucugccccaucuaauggcuucagugcugaauuguucaggagaagcagagggaaaagagaaaggaaacuauaaagauuaaaugaggaaacuugcaagugcauauuaucaugccuggcauacuuguagguguuuggugguagaguauguguggauauuuaaauuccgcuccugauccuggacuuuugaaccuuggugguaaaaggaaaaauacaaacauaaccuacuugacugcuucuaauaccaacucagcugcuuaugcucuaucugguaucccuccaaucacucucucuaguggacaauauauucugucucuccaagugguuguuuuuuuaccuuuuuuauuguccccauuccccaaacuccccagcuuccaaaucucaucuaaugacugccuccuguuuaaacgagauuaaggucauugacauuaauguauuuaacugccauaaccacuucaaaauauuucaguauuuuuagcucuucuugcuuuaccuuuucuugaaacucuuuccuuguuuagccuuaauuaguauauugucccagucgucuuccuaccuauccaauuuuuguaagucucauuaccugcuuuugauucuucuccccuccauauauauguuuauccuucuuaauauuuuguucuuggucuccuuaauguauucaauuuccuuaggugaucaaauugaccacauaacauccaaacacccaguuuaugcugcugagguccagauuuuguaccuucccaacucuccugaucucuagccauaauucuuggcugucuuauggcuccaauggcugguuuuguuuuuuuuuuuuacuucuuuuuucuuuuuuuguagagauaggcuuucgccauguugcccacguuggucuugaacuccuagacucaaauaaucugcucaccucggccucccaaagugcugggauuauagaugugagccacugcacccagccaaauggccuuuuuucaaaccugcuuuuauuccaggaugucaugguuaauaguagcagugcaaucccagguacuuaagccagaaacugucaucuuuauuucuuucucaugcauccauauccagugaguuuccuacucuuguacauuuuaucuuacaaacauugguccuuucagaccaucuuucagcgguaugcaacaguacuuacuugauucugcuuugaauuaugacucuuugaauauuuuuuucuuuggauuuauaacuucugagaggcagauucuaccauaaucacuucucuucauugaaauaaaaaauaccuucaagacuuuuuucuaaacuugagucaguguuuuacuaugucauuaacuggcuuuccuuggcaauaggagcuugaucaggauucgugauuugaugauagguauguggucuguaguauccuuuuuuggggauucaugcagagaaucgugucauuuuagaugauguugggaauauuuuaauuagcuuuagcuuuuauuacucauaaugaauggaaucuuugauaacuagcuagcuuuuaguaucugcagaugagaauguguuugguguuuugauccaaauggcuagcuagauauauaaauugaccgaauucuagaaaucuguuuucuuccuugaaaagucacauugucccccaaccaaaagauuucaaaucuuaaaaaaaaaaaaauuuauuucuuuuaaaauuugccuucuacucaaguagcuuuacuuuuuuuaguaacacuuuuuaauuauauuccgauaaugauuuauagaaaaauaaauaaaugauugguuaaagcaaagagauuugcaagugguugcagagcaaacucuuugcuuauagucaauaauauuuauuccaugguuuagacuucuuuucccaauuaggauaucuuaaauuugaauacuuacccauuuaaggucuucccgaaauaacacuagaauuguagggcaguauuuuuaaugauuggguuaaaggucuucuaugguuuggccuuucauuauguuuuuagaguuuuaaaaaaagauugauucagaaaaguuagagauuugguaaaauaauuugguaguuguuaugcauuugaaagaguugcuagcuuuggacauuuucucagaccacagcuuucugugugacauuaucaucauaguuuauauuguguaauuaaaugauucaucuuccucauuugauccucaucauuaaagucaccugaguaucugacuuauacaaacuucuuuagaggugugugugcauguguguguaauuguccauugcacauguguguaauggacaacuagaaacauugaacaauauguagauuaaaauagaauguuguaaaaacaaaaaaagaaugggguagcacauaaauugaguaguagguuagaaauaaguccuauuaggagcaauuucaggauucagagauauuucuaggugguucaagagacaaauuuguucgagaaguaguaguuaugagcaaaaucagugaaaaccuauuugauauccaaaggauugagaacuuuacuuuugaauuagaagucuuaaagaaugucaaaauaauuaguuuccacuauuucuggaugagauuugucugaagguuauucaucauucuaaugauuugaaguggcccagaugucucuuauuuuuugcaauaugaacagaaguacugagaauaauugucaaauguucaucaugaccacauaauuuuggggauuauagauauaauuuucuuucauuggugauuaguguuuuauucucacauucacuauuuuguucaguaacuuaacuuuguuauaucacuuagcccucucgguuuucucuuuuuuaccaaauuuauagguagauaauuauggcaaugcaaaccauauauuuuuagcuuuuauuaguauauuguaucuuggcaaaugugauccugucaacaaaaugauuuuauuagcagcuccauuuuaucuauaaacuguaagcaguuaacaaaaauauuacacugucaauuaauuaggaaaaagacuuuuaucugcacacccguuuuggcuuucuucuuuguaccuucuccccacaccuuucuaacuacucuuauugcuucuaucugauguuauagcauugaaucuuuugucucucuguagccauccaaaucauuagugagcauaaauauugucauaauuaaauauuguucagcuuuagcaauuuaaaagugaaauaauugaagccuagagagauuaagauuugccaagaaagaaaagaacuaauauuuuuacagugcaccaacuauauacaagacuaucuuuuuacauuucaguucugugaaauguguuuuauuguccccauuauacggagguugagaggucaaguaccuuguccauguccaugaggcucuaguuaugguggagguaggauaaaaauccagguaucuuaaacaguccagggucuuuuccauuuguaucagcaaauauuaaaagcuggggaaaacaaaguguuaaaauccagcacuccaaauaugacaaaguguauuuucuuuuccuuguuuucucugagaauuugucuuuuuaaaauuaaaaaagaaaauuuucaguagcuuuuggggcacaagugguuuuugguuacaugaugaauuauauagugaugaagucugagauuucauuguaccuguuaccugaguaguguaccuuguacccaguauguaguuuuuuaucccucaucuccccuucccacccuaccccuucugagucuccauaguccauuauaucacucucuaugccuuuguguacuacccauagcuuagcucccacuuauaagugagaacuuaugguauuugauuuuccauuccugaguugacaaaguguauuuucugacugauaacauuuauuuuuuuaaaaagacucaaaaaauuaucuuugguuguacagcuauuaaaucacuauuaaaauauggaauguugggcugggcgcaguggcuuaccccuguaauuucagcacucugguaggccgaggcagguggaucacuugaggucaggaguucgagaccagccugaccaauauggucaaaccccgucuuuaccaaaaauguuaaaaaauuagccggaugugguggugggcaccuguagucccaguuacucgggaggcugaggcaggagaaucgcuugaaccugggaggcagagauugcagugagccaagaucgugccacugcacuccagccugggugacaaagcgagacuucgucucaaaauaaauaaauaaauaaauaaauaaaaauaugggauguuugcauuagguauaaaagcaacauaaacuuugccuauuaacaucuuaugauugaugaugcauacaccaaaaaaaguaauguuuuuagaauaucaauuuagagauggaaagagucaccaagggcuugugcaucuacuuuuuuuaaaauuuuuuuuuguuuuaaagagguuaucucgagauuuuguuguuguuguuaccuaggcuggagugcaauggugcaaucauagcuuaccguagccucgaacuccugggcucaauaaauccuugccccucagccucccaaguagcuaggacuacagacacaugcugcuguaccuggcugauuuuuaauuuuuuuaaauagagaugagggucucacuguguuguccaggccagucuugaacuccuggucucaagugauccuccugccuuggccuugccuugcaaggugcucauauuauaggcaugagccaccaagcccagcccuaucucaagacauucuguaaucucuugccuugaggguauuauuguuauacuuuuuuuuuugacauggagucuugcucugucacccaggcuagagugcgguggugggaucuuggcucacugcaaccuccgccucccagguucaagugauucuccugccucagccuccugaguagcuggaacuacaggcgcccaccaccacacccagcuauuuuuuguauucuuaguagagauaggguuucaccauguuggccaggcuagucuggagcuccugaccucaggugaucugccugccucggccucccaaagugcuaggauuacagaugugagccacugugccuagccuuauuguuauacuuuuaacagauacucuugcugacaaaauuagacagcauuuauccuggcacaugauuggccucugauguuuguugcaugggguucaucuaggaauaaauuugggcucuguguuuucuuuuuuguauggcauuuaguguuugugagaauuaauagcuugcuuuucagaguuucuuaaaugagauucagagaaaagaaacuaaacauggugguaggaaaaauuagggcuuugacauacaguauuaugauguaucuguucauuaguuaaggaaacuaggugcuuuaaauauguuugcaaaucugggucucuuuuugccuugcuuauuuuuauuugagaauucuuaaucuuuuaucuaagcacucagucuaauuaaacuauugauaacuaccuuuuugaagcaagacaccuugucuuuggccucuugauaccugagccacugcuguucugaaugugauaaccuagggguaauuagauagccgaagaguagcuuuucaaauuguuuuucaaagauacuucuuuucuaaaauuccuaagugauacguuucucauuucaccaucuaauuaucuagguuuuaacauuuguauuuuugauaccaucauauucauaagaaaguuguuucauaggagccagagcugaccuuggcagauaccuagacaaaggcagucuuuuucucuaccuaccaauccucccguuucuuuacgcuuuucuuuccuucccaguuuucccuuccuccauuucccccuuucccuuuucuuccuguuucccauuuuguuugucucaguguauagaaacauauaaaauuagaguaaugguaggaggagguacaugauucucuauaaaguuccuauucagugauaguaacuuuacuaguuacuauggaauauauuaguuucuaagauagcuaguucaaauuacuuuggaauccaauagaccuggguucgaauccugguuuauaaaaguaguacaucuccauuguggugaggggcaggggaggaagugauacaguggcugggcgcaguggcucacacccguaaucccagcacuuugggaggcugagguggguggauugcuugagcccaagaguucaaggccacauagggagcaacauaaggagcugucaccucuacaagacauaaaaauuuagcugagcaaggugggggugcaccuguggucccaggugcucaggaggcugaggugggaggauugauugagccugggagaucaagguugcagugagccaagaucaugcuacuacacuccagucugggugacagagugagacccugucuuuaaaaaaaaaaaaaaaagugauacaguaacaaugaauauaaggcagaaaggaaaagugcuguugucuuugguacuucucagagguaaucauuauuaaugauuuucauguauccuucuaaauaucugguguauauauuuacauauauuuaauauagcauauuagcuauguuaauuucaguuuuuacagcauguauaaaguguucauuuuccuguuagaacagucuucaguaggucagaaagcaucuaaagaauauucauuuaguugaauuuucaucuguuugauauuacuaaauuccaguaucucaauuucuuuuuuuuuuuccuuuugacucuuacccuucuuacugcuuucagguugcuguuccauaauuauuguuguuguuuuuuuuuaaaucaguuuugaccucuguaauggcucaaacuuuagaugagaaaacauacuagaaguggagaugacagaaaaugauguuuguaucuuaagacuucagucuucucagggaaguaguaacuggcuagacauucuuccaggaauggugauggucacaguaauuaggaauuaaagcuugugggaagaaaaucuuuaauugaccuuguugucauuaagaagaaggaguuauucuaaggcauugguauaggauugccagacauguuaccaaagauacaggaugaguuuguagaugacaaagugcuuggucaucuggaaccaggaauggaaaagcugacuguaggucagcucugggaaugagugcaccagaggcuuaagcuauucagggcgucucugggaguaauaacaagaaccuugauaaaguugcuuaccauagccaagcaccagagaaaggacuucacauucucacaauauacaaaacuauuggcuacagaauauaaaucaggauuucagagucuccucuuacaugauggaacaauguuuuucccuccuugaaacagaucauuacuuaugaagaauaugguuggauaucuauaccauuacuuguacguuaauuaccuugguauaucucucucuguguaucuaucaacaaaacauuauuugaguauauauccuuucaaaauguuagguacuuuuuuuuuugagacggaguuucacucuuguagcccaggcuggagugcaauggugcaucuuggcuuaccgcaacuuccuccucccggguucaagugauucuccugccucagccucccaaguagcugggauuacaggcgugcgccaccacgcccagcuaauuuuuuguauuuuuaguagagacgggguuucaccauguuggccaggcuggucugaauggucugaccucaagugaucuacccaccucugcaucccaaagugcugggauuacgggcaugagccgcugcgcccggccuagaauguuagguacuuuuaaagaaaccucuuuucugugaaccuauggauuauguugaauaggcccuuuucuaaacacacaaacacuggaggcauugggggagggaggagaaaaagaacaguuaggagguaucaaaaauuucgaagucgucaaaauauuacauaguauuuauuucucaauugaagacauaccaucuuauuaaaaucacuguaccauuagacaaauguuaccacugaucuucuuuuaaucuuuuguaugccauuuuuaaaaaaguaguuauuuucuuccugaguuuucuuucacagagaacuauaauugaacuuggccuugcgauuuaauuuuauguagaagaaauuuguuaaaaaccaccugucaaacuuaugugacucaaucaagucugccaagucucucugagcaacagacugagacccugucucaacaaauuaaaaaaaaaaauaagagggauacaguaacaauaauauaaagcagaaggggaaagugcauuauucguguuuagagguaaaauggaaaauguguguuaauggaaauaucuguuagggguaaaauauaaauguuggaaaugguuuggguauauuuguguguuagagguaaaauaguuggaaaaccugucccguuauuuuuuaacuuugguagcacagcucugcaaauuauucuuuauccaugacccuaagucuugagaagaugguuauucucuuuccuaguccuaagugucacuucuuuucuugcccuauaaugauugacaguagaauuauguuucauucagggaagagcuugacuccagccacagggggucugaucuacuauccugccagcugggaauaaagugagacuaaaggcuggaagagaucuuuagaaucccuucacucucacuucuaggaucuggcuaccacucugauuucaugaugccacugguguacuacacacauaucccaagaaacaaacaauuucagagauaauucagucugaauucauauguaaggguaauuuguuaaaggcauacacguuauuaagcaaaacccugaacaucuccuucugagacaccugcauuuagguuaaccagcguccucacaaaaaaacuaccucuccaaaaaaguagucuguuugcuuaaguaacuaaaauguucauucugguaguauuuucuuuuuuuuuuuuuuuccuuuuuuuuuuuuuuugagacggagucuugcucugucacuaggcuggagugcaguggugugaucucggcucacugcaaccuccaccuucuagguucaagcaauuccccugccucagccuccugaguaguggggacuacaggucugcacgacuacgccuggcuaauuuuuuuuguguguguguguuuuaguagagacaggguuucacuguguuggccaggauggucuccaucuccugacuucaugauccgccugccucggccucccaaagugcugggauuacaggcgugagccaccaugccuggccuaucugguaguauuuccaaaacagaagaagucugcugcaaaggagaacugauuccugcacuuacagacauuuaauugcuguaauugagaaugaaauuuaucuaguuuaaaaaaauuaagacgcgcccccccccaccaccaugagacauucuauuaacaguaaaaguugcccuuccucucaccuaucaaaucuuugaauaaaugugucuuuccaguaaaacaaaucauuuuauccuguggcuuuuuuaauaggaaugucuauccacccaccuuuaggauugcauucugcuauuuacagugaaauaugucagcuuucaagaagcauuuccacuuuuaccuacugcuucacuguggaguuucuuaggcuuucuguaccuuucuaaccucgggccuauuaaguaccaugcuggaguugcacugaaccuaguuaugccaaggauugacauccauuucugauuuggucuaucgaauaggauuauuuuauuuuuccugauuuuaggauuauaggacauguaucuacacauucacuuucuugagucgccuagaaauaaaaauaguuacuuuguagacaaguuaggcacccuuuuguguaugaaaacaaaauacugccaaaauaguuauuaaaacauauuggugccuauucuuuauuaguuuuaauuauuauuuuacuaaaaaguauguggugcauugaaauaguuacacuuuuuuuuuuuuuuuuuuuuuuuugagauggagucuugcucugucgcccaggcuggagugcaguggcgcaaucucggcucaccgcaagcuccgccucccggguucacgccauucuccugccucagccucccaaguaacugggacuacagaugcccgccaccacacccagcuaauuuuuuguauuuuuaguagagacgggguuucacuguguuagcuaggauggucucgaucuccugaccuugugaucugccugccucggccucccaaagugcugggauuacaggcgugagccaccgcacccggccuuuuuuuuuuuuuuuuuuuuuugagacagcaucucacucugucacccaggcagaguacaguggcaugaucauggcccacugcaaccuugaccuccugggcuccagugauccucccaccucagccuccugaguagcugggacuacaagggcacacuaccaugcccagcuaauuuauuguguuuuuugaagagacaggguuuugccauguuguucaggcuugucucaaacuccugggcucaagcaauuugccugccuuggccucccaaagugcuaggauuacaggcaugagccaccauacccagccuaaaaaaauaaauuacugcaccuggccuaaaaaauaaauuuuuauuugcauuuaagcccaguuauucugaauuauucuauuagagcagaauuauucauguggaaucuauguucccauacuuaccuuuucugauuuuaaggaagaugacugauugauugaauuuauaauuuaagaggaugaggggcaacuagucaccgcaggucaccucuaccauuaggacuaaccaguugguuguuguuuaccuagaguuucuuaauccugcuucauagagacucauggcaguuuuaguuacauauaaguauguuguuuggucuagguagcuuggucuagguguuacaauauuuuaauuuuggggguauaauaugguuuuuuuuuguuguuguuguuuguuuuuuguuugaggcagaauacucugcugcccuggcuggagugcaguggcaugaucauggcucacugcagccucaaccucccaggcucaugcaauccucccaccucaguccccugaguagcuaggacuacaagcaugugccaccacaccuagcuaauuuuuuaauuuuuuguagagacaggucucacuacauugccaagauugguaccaaacuccugggcucaagcgauucucccaccucaaccucccaaaguacugagauugcaggcaagagccacucugcacucagccauaauaugauuuuuaaaauaaaagagucacaggaaaguggugaaaaagagaauaggauuuacaggaccagaagaauuaauacgagcaagauaacguauaagagagaauagccgggugcguuggcucacgccuguaaucccagcacuaugggaggcugagguggguggaucacgaggucaggagaucgagaccauccuggcuaaugcggugaaacaccgucuguacuaaaaauacaaaaaauuagccaggcguguuaaccaggcgugguggcacgcgccuguagccccagcugcucaggaggcugaggcagaagaaucacuugaacccaggaggcggagguugcagugagccgagauugcaccacuguacuccagccugggcaacagagcgagacucuaucucaaaaaaaagaauaacagacauuaaagguucuuaucaagucacuuaaguuauuuuauucuaccuccuuugugucuacuuuuaacccauuuugguauucucaguuucucaguucuugaaauugagauauaaaaaauaauguguagauuaaaggacuuuaggguaaauuauguugugagucagaaaauacucuuuccuccuguauuuucuuauaauaucauugccuaucucuggucauuuucugucucuagucucuuaaguguaguuaucugaaauauuuuuaauuucuuaggcuucuaauuuuaaauuaaugcaaauaaugaaaauuccuagucacaguuauaugguguugacccauuucaguguccuuuuggauauggggaauuaaguggaaacuggagacagcaggagcuaauagcaaauaacuugggugggaacaauaaagaaugauuuguucauccugcccuggugaagguauaguucagagaacuuuccagcaucuaagaauaauaaaaauagaagcuguaagaaauucugcuucauaauuauuuuccugugucuucaaucauuucacaacuuuguuuuccaauuuaaacuuuaagugguaauugcagucugcauguuuauaaauuuuuaauuguauagcauauuaguacuugucuucuuuaaaaauaaugccauaaagaauuugucacuuggaaguuuuuccccaaauauaacagagcuguagcaauuguguuuauuuacaauuaaggauucccuagggcagugguuuucaacaucagaaucaucaagagggauuuuaaaaaguuuuuuaauuuuuauuuuagguucagggauacauguccagguuuguuauauagguaaacucaugacuuggggguuugguguauagguuauuucaucaccuggguacuaagcauaguaccugauaguuuuuuguuuuuuuucugaaccucucccuccuuugaaccuccucccucaaguaggcccuagugucuguuguucuccucucuguucaagagggauuuuuaaaacauagguuuuggggccucacucuuguauuucugauucuguaacucuggaguggggccugagaguuugcauuucuaacaaauuccaaggugacgcuaguacuacugguccugaaaucauacuuugagaaccacugcaauaauaugauacugaucugagaagucugagauagggcuaaaucuaaucugugcugaaugaauacugaguugcuuguauuucaagcagaguuauaccuauuugauggguaccagcaaugaccauuuaauguagugucuucuuuucauagauuggagcauaugaucaacaaauaugggaaaaaucuguugaacagagagaaaucaagguaaggaguuuauuucauuuuguuuauuuugaaacauaguucuaugaauuauuaauuacauuuucuguaguguuuuuuaauauacuuuuaagauauaaauuacuauucuauugaagcuuuuaaagaaagaaguaaacuuuauuuaccauagucacguuuacuccugauguugguuuuuucuuuuuaucaucuuucuguucuuuuaaaauugaauuucuaaugacuauuuuuuugucagcuuuuuuccccuuucacuugucaccuuauacuucuaguuugcuuuuucucccuuuugaugcugucauugcucuguacaguuuauuaaacugguaaguguuucaggauuuuucccgccugagugauccugugcaaaugcuggucugcuuaauugagaucugcuuuuuggugcuacuaacagauugacuuggacucgaaaagagucacugaaaaguuggucauuuuaaaaaagaaguuaggacaguaaagcacuaauuaaaauguuuuuguaguaggcauuuucuuccugaacauguaaucauaucucuuaugcugauaaaauauucucauagauuaccuugcuagcaugaaaacuguuuuucaacugaauuuauuguuucccagcacucuuuauugguaauaagauuuauauuuuuucauuugcauagauacuaaucaguguguuuuugcacgagcuaaauuuaaucugggcacagacaguauuaccuuaguuacuugacauuuucuauuuuguauagaaaaguuuucauuagauugaaaaccagugucuauaguuacuaaagaucaguccaaaaauuuguuaauguuuagacuacuuagucacuuguaauaaagagcaagauucuuucccauuuggcaauuauaaucucuaaacuuuugaggaaggauuaauacauuuaacaaaguugugguaugcguuaaauauaggauuaaguccugggacagaaagauaaaauagauuauaguuuuguaggggagaugcauaauuacacaugagauaaauuccuuuaagagaggcaugucuaaaacucuauagaagagcgagaggggagacaagccuggggagguugggaaagauuucauagaggaagugguucauuaacucaaggaagacauuucagacagaugaagagcagauggaaauauauguaaaggauggaagaaacaugauugaggcaggacuccccaaggaguuugauuugauaauagguuggauagaggaaggagacuagugucauuaggaguaaaacuagaaaggaaaauggaagucagauuaugaaggggcuugaaugccuugccaaagaauuuagacauaaucuggaaaacaacaggggagauauuggaagauuuuaagcagaagauuauauuuugacaaauguacacaggcagcacuaaggaugauaggaaauacuggaagaagagcacauuuagaauucuguuauagaaauaucuauuugguacuugggagggacauuugagaguucucaguuuauaaagugugaauauguauagguauguguuuguaugugauacauacauacauauauaaaacauuauauagauauagcuauaggaaugaguagauuucuguugaaugaugaaauaaaaggacugagaacagagcauugggaaauaacuaacauuuaauggguagguaaauaaagagaugcaaguaaagaaggaaagagaaguaggagauccaugagaaaauaguauggagagaguaugaagaagaguugggauagucaagcaaauaaagagcagcagagaggucuaguaagaugccauaauaccuuuuauccucuuugacaguuagaaagccuuuaacucauuagacaggagauauaaguaccuugagagguuauguuaucagguugacacauuuggaauuuaaaagccucagaaaaaauauauauaaauaauuuuuuuaguuuuuggaagcuauucacaaauuacuauuuguauucacaaauuacuacauuacuuauguaaccuccucuuuuuuaaaagaacucuuuuaaauccuaaauguauguuagggugaggaaggauuauauuaguuacuacuuggugcuacuaacaggaugaucuuagggaaaguuaggaccuacaacuucuuucugaagugugucucccuuuaaagaugauaccuuguaauaguaauugaagaauuaaaaacauaaaaacuugcucuuuugguaggucugaagguagcaaguuaucucgaucguucacagacaguuauagaucagaugaaguccuuguuucacucuuuccuucuuucccacuauugcacuugacuagucuuuaaaaauaaagauaaaaaugagacaaaauuaaagaaaaguuguucucauuauuuuuuuuuccuuuuggggugauaaaaaaauuucuaaaacuagauagugguaaugauugcacaauauuguggauguacuuagaaccacugaauuauagauuuuuauuguuuccuuuuuguuuguacaaagucaugggguacaugugcaauuuuguugcaugcauagcuugcguagcagucaagucagagcuuuugggguauccaucacaugaauaauguacacacuacccauuaaucaauuuaucuggcucacaccugaaaucccaacacuuuaggaggcccaggugggaggauugcuuuaguccaggaguuaagaccagcuugggcaacaaagugagacacuaucucuaaaaaaaaaauuauuuuucuuaauuagcugggacauaccugcagucccaccuacuugagaggcugaaccaggaggaucacuugagcccaggaguucgaggcuguagugagccaugaucacaccacugcacuccagccugggcaacagagugagacuuugucucuaaaaaauacauacauacauaaauaauaaacuuaucauccucccuacucuuguuauuuuuaauuaaaaggaucaauuuguuaacaagccuaaaagcacauuucauuuuuacuaaacauucuaguggaggcaaauuaugguguaaaauaauuccguauuuauucuaaggaaguuagagagguacguaacugugguguauuaauguuaauauuugauuaagaaaaaaacacucuaccuguuguuuagagaacaguguaccaaauguauugaguuuguccaauguaauugauucuuucauuaguugucaaagcagugagcagcuacuagagaaaucaaagacaugaaaauauauuuuuuggaaauguuuauuuuucaauuaaagacccagaguugauauugcuaaagcguaaaaccuuuuguaaguugcgaauuauuuuuccauaaccauuuuagaaauuauaacuaaaaacuuugauuuuuucugauuaccgugaccaaaauuuaaaaguaaauuuggaaguuuuuccuguuuuacugucuccuagacuuuuaaagcuucuuaaaagacuagacuuaaaaagcuuauaaagucauuacagagaaaaagggggugggggaacuaaacaagauuucuagaaaaugaaacuguuuauguacuuugauggagucuagauauuaacaauacacagaagucuagauaacugaacagaagcacuuucuaaacuuaaacagcccauuucauuuuuuuuuuuuuuuuuuggcccaacauuaucuguguacuuagagaguuuuuuuuaaauaaaaaacuuuauacuacuguguuugagucauuucacuauaggaacauacuauaagaguuuaaauuauauuuaauaaauaaaauauuuuuauuauuggauauuaauugcauuuguggugcuuguuucuacuuucuaguuugugcauaaauuaguaguuuuaaaaaucucauuuuuuaaagaaaauguuacuuuucauuuuuuauuuguucauuuaaacuguuuaacaguucuugauaguacugaaagcuaugcuacuuugugugaaugugguuuaccccaagccaauugaaaauuuuccaguguaaaauagcuacuuaauuaaaaucagauguuaugaauguuauaucuugaugcuuucuuuuauuuuugugaauaaaauaauuauagauuugaucgcaacucacugcauccucugccucccagguucaagcgauucuccugccucagccucccaaguagcugguauuacaggcgcccgcuaccacgccugacuaauuuuuguauuuuuaauagagauggaguuucaccauguuggcuaggcuggucuugaacuccugaccucaggugauccugcccaccucagccucucaaagugcugagauuacaggcgugaaccaccuuaccuggccuucuguuuuuuuuuuuuuucuuuuuaaaccuuuaaauuaucuugauaggcuaccuuagagggaaaauuuuauugaaacuggcuauuaggguguggcucuacaauauagcucaaaauaaauauauuuuaauagaauauaaaauuggaaaugaaccccaaauaaacaaggucgauuagaagaagcauguugaaaaacaguaguugcacauaucaagacaacuuacuguuucuccuguagggacuuuugauucuuaaaacaaucuugauaaaaauuuuagguauacagcaauaaauuaggauucagauuagucagaagacauuggcaauaagguuacuuucaaguuguuagggaagcaauuuauaaaaaacaaguaaauuaaaauguguuacuguuuucaaauauuuuuacaguaauaaagguaaaaucuuacuguaauaaacaauacuaaauccaaauagugcuuuauuaaugaaguuuuguuuaaauauauguauuauuacaguugcuucuccaauuugcaaaaucuugggaaugauuucuaauccaucagccgcuuuauagugacauuaaaaucagaaauaauguacagauacagcccauacucauuauuugggguagcuauguucuauaaagucacccaugaacacugaauuagugcauacugaaccauugcugccuggggaaguaccuuguuuuauguguguuucuguuuaaagacaccuuauuuaauauauauuuuugauucauuaacaauucauggccaacagcacuguaaaucauaucugaacagagguuaucuuuauuuauuuauuuauuuauuuuauuuuauauuguuugggacagagucuuacuuugucgccaggcuggagugcaauggugugaccuugguuuauggcaaccuccaaccccuggguucaaacaguucuccuugcuucagccuccccaaguugcugggauuacaggcgagugccaccaugcccagcuaauuuuuuguauuuuuaguagagacgggguuucaccauguuggccaggcuguucucaaacuccuggccucaagugauccgcccaccuuggcccccgcaaagugcugggauuaaaggcgugagccacugugccugggugaacagagguuaucuaacacauuuucucuguaagacacaucacagcauucuugcacuuaggaacacgagacacuguuuuaagcacuauacuugagggccaucuugaacaacaggauugccaacaaaaagcacaaaaaugugaaaaacauaacaaauaaaggacacuguuuacaguaaucagagcugaaacaggaagguuaaagcaucaccuuguucgaccucagcugagaacaugcacguugggugacucaauuuuuuuuuuuucacuccaugcgugucugcaaauuagggcaaaagcaccgugaacguugauuuggggguacaaagaaauuuuaccaaguagguguguuugcaauuauggaaucugagaauaugaggaucgacuauauauaaaauuaucauugcuauuucuuuaacuuuuacccugucuccuucauuuuuguuuuugcaucucugggugguuugcaacuucagccagaacuauuugaagggauucaaagauuaauugcauauugguuucagggcgcauuuuugguuuagacaccucaguuaauucugaccucaaauaugguucucuucuuuguuuuagauucaaacagaauacuuaaucagauuuuuacuuugauggggggugucauuguuacuuggauuaggaccaaagacaggauuuacugcacaguuacuugcuuaauugaaugaauaaaaaccaaaucaucuaaacacuugugucaucucgcaguaauuggcuccugaagaguuuagcuuaagcucuugcaguucuuuuuguuuguuuucucuuuuuuauuuuuauuuuuguuagcucuuccaauucuuaacauucuagucuuaaguaauaauuuacuuuguuauagguuuuuuuuucacuaguuuugaucuacaccccccacuccacucuguauacugauagcagaaacuuaauuuuacucaguguucaauaauuucaaguuuaaaugaauucaguuuaugacaacugccucucccuccuccccuuccugguuauggugucuaaguuuugaggugaugagguggcauuuauggucugaugagggguugacaugugaacauaauggcaaccaucauccuugaguagugcauuguccucccugggucucagcugauuggcgucugcugagaagucugcauccuuucugguccucagcugugugauuuacugcuuucugaaauaaugccuccagcaccacaccuugagguuccuucagggcugcugcuccccuagcuagccucaacgcucuccaaaugccaauauggggccaauauaguucccucuacaccuaaagcuguacaccuaaauuugcuugguaguaauaguauuuguaguagaauuuuacuguugguaauaaaccggccuggcauguuacacacaucucuaaauauaucuuuuugaacaauaauaaaauuuauuacaauacuguaauuguguucuguuuguaacaaaugcauaauguguuacauuuuguugguacuauuaacaauuuuauuuuaaauugaaagcuuuagaaauugauuuucuccuguucuagauuuaaguauauauacaauuccaaugcuucuuuugauauauuauaggggcuaaggaauaaaccaaagaaaacagcacaugugaaaccagaccucauagauguugaucuuguaagaggugagucugauaaauaaaugcuuaauacaaguagacauuguucuggaagaaacagaauucaaaauagguuuaaauauuguauuaggcuguuuugcauugcuauaaagaaauacuugagauuggguaauuuauaagaaaagaggcuuaauugguucaugguucugcaggcuguacagaaaucacagcaccagcaccugcuucugggguaggaagcuuuacccauggcagaaggcaagcgggaccaggcacaucacauggccagagcaggagccagagagugguaguggggaggugccacacacuuuuaaaucaccagaucuccugagaacucacucacuaucucaaggacagccucaagccaugagggcuucacccuuauggcccguauaccucccaugaggcccugccuccagcauuggagauuacaauucaauaucagauuugaauggggacugauauuccaaacuauaucagauaucuaucugucugucuaucuuuuuagaaauaaaaacauugugaaccuugaugaagacaagaauaguauuaaaaagagagaaugggaccagguacaauggcucacaccuauaaucccagcacuuugggaagcugaaggcagaaggaucucuugaacccaggaguuugacaccacccugggcagcagagugagauccuaucucaacaaacaaacaaacaaacaaacaaaaccaaaaaacaauuaaaguggugauuuguaauuccuaacuagaacugacauuugaauauuguucuauauuuauaaaauaugugggagaaauucuguuauuucaaaaaauguuuuuuucaaaauauuuaaaguaucuauaaauuggacauuucucacucauaguauaauacagaauaaaauuauguggugauguuuuucaaacauugaaauuuuuuucuuuaaagaaauuaaagaauaauauauaaauauacucuguuguccuauuuuacuuuuuucagggucugcauuugcaaaggcaaagccugaaaguccuuggacuucucugaccagaaagggaauuguucgaguuguauuuuuccccuuuuucuuccgguggugguuacaaguaacaucaaaggucaucuuuuucuggcuucuuguccuuuaucuucuucaagguauaauuaagugauuuuugcuuuuacuuuucagaauguuacauuguuagguuuaauaagucuuuguuuuaaacauaugcuaacuacuacugaguaugauguauaaguauguuaauaaaggcacauaauugauuugguauuaaaaauauuugagaaaacaaagcaguuauuuuucaguauaauuuuaugaauauuugaaucuauagauggcuaaagaaaaauagaaaucgagaagauuuuuuaaaauuagaaaaaaaaccucaucaaaaugcaucuuccacacauacauacauaccagucuuuuaaaaauacaaccuauacaaguuuauuauuccugccauagguauaguuucuuuuuucugugccuuuuaccaccgugaugugagcuguccuuauacuuuaucaaaauucuguauaccgugcacucugcuaggugcuuucuagauucucauuucauucucacaucaaccugaugaaguacagggacuguuacuaugcuucgcuuauagacgugggaccugaaagaccugagugcccaacgccacauagucaucaaguaugguagagcccagauucaauucuaagcauucugaucccagaaccacacacuuaaccgcucuuauggugccuccuaaaacaacauucuagugcauagucuuagcagcaguauauaacacaacauguauaacauuguagagcauuuagaaacuaaagaagaaacuauucauauuccaucacgugaacaaagccguuauuuucauuugguucauguccuuucagucuuuuuaauaugugauuaaaaaaaaaaaccaugauuacaauccugaaugauuauuuaaauuuguuuuaucaacagauucuaagagauacuuuuuaaauaaaugaaaauauaauaaaaacugcagacuguuauuuagauaaaguuguuucuucuaagccagguuacaucuuauauacauaaaaggguguggacuaugauaauuuugugguuuguuguuauuagaauguguguauguguuuucugauuaaagauauaauaauauuuucauggcaggaaauuuggaaaauguagaaaaagcuaaagaaaaaaagaacuacccaucaucuugccuuuaaauuuauaauacuuuuuaaauaguugagauuauuuuauaugaacagcuacauuuuuuuuuaccuaaugucauaauaucaaagucuuuguaaauauaacuucuaaguuacuagaaaauaucuuguccuacuucaauauugggcaguuaagcugauugcuauuuuuugcuauuauaauuacugcugaagugaucauauuugcuuaucaguauuuucuaguuauagugaucauaauuuuuaucauuuucuuguuuucuucucaaaaggacuuaagagagcuuaauuuaaguauaguuaucuucaaagguuuucuggcuuaccuagaugagaaaacuuuauuugaauguggucagaaauugcaauaguuuauuagaguaauucaguaccauugauuguacaucacagugcauugugcuuuuuaagauauugcugcuuucuaguauuccacgacaaacaaguuuccaauguaacuaaaaguucacugacauuguauaauuauauugugucugaaauuuacuuacugguuccucuaaguuaaauagggaacacggguuagauugggcauuaaaugagauauuuuuaaguucagaauccaaguuuaaucauaaggcccuuaugaugaacacuaaacauucuccuaguaaagcuuaguuagagaaaugacuuaaccuucuuaaagucacacagcuagugccaaagucaugaugugacucugaugacccucggcaggcugccauuaccuuugaaaaccacuguaugucugucuccauugcagcacccuguggaaaagcagggugcugcagugcucugaguuauguccucauucuuguucgcacuucuugaaaggcagaaagaaucaaaugcagucagauuugguuuuauauaacuauguauaguuuuuuuuauuucaauuacaugcuuuuuaaguaucucagcuauguauucucagcucuauccccauuucugcaugucuugguugccuaguuucuugccaagauuacugccaggaaaccucauaucaucuucuacuuucuguccauuuaccuauuaaaugacaaauucaaaccagcugcuuaagaucuaaauuucuucacuaguuaucauugcuuucaagaugcaaucugaguuuucaaaucccuccuugaauuucuaucccaccuuaaccaggcuaaacuagcucuuugcuguuucuuaaacauuccaugcuuuuuugccuaugugucuuuggacaugcaacucccuuugcgugggguagcccuuuucccuuuuguuuagucaauccucuauguucucucaaauuuagauuagacaucagacaucacuuucuugaagaauccuuucguaacuccccaauguaguuacauaucuuucuuauguauauuauagcaguuaaucauaaguguuauauuagucaccuugggcuaccauaacaaaauaccacagauuggguggcuuauacaacaaaauuuauuuuuucaccauucugagggguggaagugcaagagugaggcaaugucagaguuggugucugaugaggcuucucugacuuguagauguccaccuucuugcugugucuucacagggccuuucuugugugugugaguggagagagagaguacucugguaucucugccucuucauauaaagacaagagucguaucaguuuaaggccuuacacuuacgaaucuguuuaaccuuuacuaccuccuuauaggcccugucuccaaacguagucacauuguggguuagggcuucauucagcauaugcauuuguguggggaggaugaaaggagcacaguuuaguucauaacagguauuuucauuguuucuuuauaugucucuucuuuccuguaaaccaagcuuguccaacccauggcccauaggccacaugcagcccaggauggcuuugaauguggcccaacccagguucauaaacuuucuuaaaaccuuaugagauuuuuuuuaauuuuuuuaaagcuuaucagcuaucguuaguguuaguguauuuuauguguggccccagacauuucuucuugcagugaggcccagggaagccaaaagauuggauaccccuggucuaaaccaagggauagggagcggagacugugucuugucuuuuuuucugcauugccuaauugccacugaaucuuaaagauuaacaguccuaaaaauggaagauaauauuccauucuauucuauucuguuuuuuagacauaggguuuugcuuuguugcucaggcuggagugcaguggugcgaucauaguucacugcagccuugaacucccgggcacaaacaauccuccagccucagccucccaacuagcuaggacuauaggagcacgccaccaugcccagcuaauuauuuuuauuuuuauuuuuguagagauggggucuuaauauguugcccaggcuggucuugaacucuugaccucaaguaauccucccacuucacccucuuaaagugcugggauuacaguugucagccaccacaguuucucucuguugcucaggcuggagugcgguggugcagucauggcucgcugcagccucaaccuccaaggcucaaucauuccuccuaccucuaccuccauagcuggaacuacaggcaugcacugccauucccagcuaauuuuugaaauuuuuuuguagaggcaggguuucgccuuguugcccaggcuggugucaaacuccugggcuaaagcaguccacccgccucagccugucagagugcugggauuacaggugugagccauugcauccagccuacuccuagaguuccccuugcccaguacgugaaguccugccuuugaaauauuugugcccaacaacauucugucuuaguugaucuccagcagaaaucucuagcagcacugucuaguucguaggacuucauuaaaugcucaaaaaguauaacucagcauuauauaaaauaagugaauguuuucucuauauaucuucuuuuuuuuugagacggagucucgcucuguugcccaggcuggagugcaugaucucagcaugaucucgguucacugcaaccuccaccucccagguucaagcaguucuucugccucagccucccgaguagcugggacuacaggcgugugccacuaagcccagcuaauuuuuguauuuuuagcagagaugggguuucuccauauuggccaggcuggucucaaacuccugaccucguguucugccggccucagccuuccaaagugcugagauuacaggcaggagcuaccacgcccggcucuccauauaucuucuaaaccuuaacuugagaggaaaacaaaaaggggaagugauaccagaguuacggaggaaaagcuacugucucaggaacugagaccaugggagggacaugaucacuuuuagaaagauacagucagaagaaagaaggaaaaagagaggaagaaaguggcuccuccuccuuuuucuaaugccuugucgucagaauuucacaguauguaauaacuuccuguuaagauauacagaaaauauaauuuguaugcucccagcccuaggauuacagagaauggugaucacagggcugaaagaguucagauaaauaaccagcaacagguuauauaaaaccuaaaguuuuaaaagauguucuccuuugugucugaaacucugaacuucuuaaguaagcauuuguacuugccccuuuuaaaauuagaguuaauggcacggugaaaccccaucucuacuaaaaauacaaaaaauuagccaagcgugguggcgggcaccuguagucccagccacucgggagccugaggcaggagaauggcgugaaccugggaggcggagcuugcagugagccgagaucgcaccacugcacuccagccugggcagcagagcgagacuccgucucaagaaaaauuaagaguuaaugguagcuaaaaaaaaaaaaaaaaaagcuacuauucaccaauguuaaguauacauuuacgguguauaagcagcuuuucaaaauguuuuacaugcacuaccucaccuaaaaccuauuauagugccuauguacuguauguaugcuguguacuauguagauacacagaagauuaaaccaaggcucaaaaacauuaaagaacuugauaaaagucacauuagaauucauauuaaaaacaaaaaagacucucugcuuuucaaaauuccagacuguuauggaauaacuagagaauuuggguuaaauuccaggguaauucauaacgaugauuggcauuuuaaauuuuuuuuucuuauuacuuacaguuacauacagcugaaauuuguuuucaugauacucuuuaaguauauuaaaguguauuagcagauuaagugauguuuuaagcguuugguauauuggaccaggauucuuugaguugcagguggcagaaacuaaaugcaaacuagcuuuuacaagaaguugguuuuuuuggucguuaauuuuacuguuuaucauaaaagcuaaacaaaaaaaacccaggaaacuagauagaauaguacaacagcugggguggccauaugucccaguuugccugggauuguccaacccaaguuuacucauguuguccuggugccuuucacucucaaaagugucuugguuuagaugguaaauuacauggucacccuaaacaccuaaauacccaucucuuuaacaaugauuaacguuuugggauguuuacuuaaucuguuuuguuaaguaaauuauauacauugagacauuuuaccccugaauacaucaauauaugucucuucaaaauaagcacauauaaccacauuacagugauaacacuuaacaaaaugaccaaaaaucuuauaauauuuacauuuuauuuuagguacuccuuggcccuggauucaggcauggcuggauugagaggcucggauaauaucuucacuucuuuuugcuguagacuuuggucuugcuggucacauucuuagguuggcucuuucuaggugguggcuaagguggccccuagcaauuucauuuuuucauagucuuuaguguuugugaucuaggagaaaggucuugaagcaccuauauuagucccugaaaaagacugauuggcccugcuuaggucacuugcccaucuuuuuauaagcuuuuguauucagacuuacuaagacugugacaagccuagguuacaugucuaucccugaggugggagaaauaagaauguaugauugauggauaaaggagggagacgaagguaaagagaguuuauguccagaaagucuaagggaugcuguguaggcaaaacaagauuucccuucauguaguaauaguuagcauugauggauguuuagugguuucucuggaaacuaugccuaaguaaauuuguuauuaauucuaaggagauagaccucuauuaauaagaagcucuuuguaucuguaugauacacuuaucauaagauuucuuuauuuguaaaacaaagaaauaauguacuugagguuaggguaguucuuugauugucugugauguuacuuagaaauguccuuugauucauaugcaucuaauuuacguugcagcguugagguguaguuuagagacuauguuggguguugucuuguuccgagaguuuauuacuaaauaccaugguuaggcugcggcagacaauaaaacagucugagagagcuugucucuauaguaauauuuuaaacucauuuaaauuuagaaaaauauuuuggcaaaaaauaauguaaaaacaauuuuaaaaguuuugaagaggugacuaucagaucuauaauuaagcauauuuucuuucccuuuuuauaguugcugcaauaguauuauucugcuccacuucuagcccacacagcauaccucugacagaggugauugggccgauauggcugaugcugcuccugggaacugugcauugccagauuguuuccacaagaacacccaaaccuccucuaaguacaggggguaaaagaagaagguacuguuuuuuaaaaaguaaucuuuuuguacauuuauguaauuugaaucuacgauuguucuugacuccucuuaccuucauagacuaaaaucuuaucuuguaagguugcuguuucaaaaaaacacugagcuucagaaucaauuaccagaugauuuaguuuccauauuugcuucaaggccauuuuaagaccacaugccuguguuuuuguuucuuuuuuuuuuuuuuccuugaagcucauuuauagucaccuaauaucaauguagacaauauauguuagcuagauuguuaauaauuccuacuacuuauaaaaaucuuguauuucuaauagaagaugcuuuggcaaaaacaaaaaccuagaaaaaauuucagcuaaacuguauuuacuaaaugcuauuugguuuuguuuuguuuuuuuuuuuguauuuuuuuugagacagggucucacugucuccgucacccaggcuggaguccagcucacuguggccuggaccuccugggcucaagugauccucucaccucauccuccugaguagcugggaauacagguguaugccaccccaccugacuaguuuuuuuauuuuuuauuuuuuguagagauggggucucacuuuauuguccaggcuagucuugaauuccugggcucaagcgauccucccaccucggccucccaaagugcugggauuacaggcaugagccaccacaccuggccacuaaauucuguuugaaucuguuuaauauuacccuugauucaguaaauauagcauaucucacuggccaaucagcacacuggaguuuguuuuaagguucuuuuggagcagguccucuuuugaauaucauugcuaagagauugugacauuuguaguuuuuuggugcugagauuuaagcccaucucauuuuuaaaagauaauacauuagauaaauagcaauguccauaaauuagauuauaauucucuccaaucuaaauuuucuucuuucuucaucugcagauaaguggcauucaaauagggaagaaaugcuuuuguaaauauccauccaaugcaauccuuucaaucuucuguccacugaccugccacuauaagcaaggaccaauaccuuaacauuucuagaaauuggucuugaauaugcaucaugauauuuggauuaaauuuuaucuaguaaaucuaaauuuuauuauguguuaaguaaaguuccuguguuuauguuuuccaaaauuuugauuguacuacugagaaagugguuauuaaaauauuaaagcugccuuccauucuuaaucucuucugaugaaggaaauuaagaaaagcagcccauuuggaaguacauagggaaggagaugguucuaguaccacagauaacacacaagagggagcaguucagaaccacgguacaagcaccucucacagcguuggcacugucuucagagaucucuggcaugcugcuuucuuuuuaucaggguuuguauuuauuuaagguuuuauauggcauagagauggcacuauccuuuuucuggcacuucagucucagguaaugaauauuaauuacuuuaaaugugacagccucauuauggauuuuguuuugauaaauuauaauaguauagauaauggaaaaauagacacuguaaacuuuauuuggcucauguguacauacaucuauacgagaaugaauauaucaaagcauauuuagcuaggauuuccuuuuuuuuuugggacagagucuggcucuguugcccaggcuggagugcaguggcacgaucucggcucacugcauccucuaccuucuggguucaagugauucuccugccucagccacccgaguagcugggcuuacaggcacgugccaccacaccuggcuaauuuuuuguauuuuuaguagagaugggguuuuaccauauuggccagaccucggccuccuaaagugcugugauuacaggugugagccaccgaacccggccaggauuucuugauuuugguuucuuuuauauuucugaaguacuauuuuacuuguguuaauugguuaauuuauuuuuaucaccguuuugggucaaaauuggcuguauuaaaaugucaugugaauuguauaauuuuuuucuucuaaguucuugccucaauuauccaaaauuaucugaaauaaaacauauaggcauuguuacuuaagugaauaaaauguauauuauaguaugugauucuacuuuuguacaauguaccaugagcauuuguguacuauacaaaaauggcuuuuugcauacaacuauacaaaaauggcuuuuugcauacaacuauacaaaaauggcuuuuugcauacaacuauacaaaaauggcuuuuugcauacaacuauacaaaaauggcuucuuguauaguuuguauaguuguaccaucaaugaagacuuaccaaauaggaaaauauaauuacagcaaacauuaaaaaaaaccuaacucaagcuuguauuauuauuauuauuauuuugaauauucagaacacuuaaggguuguauuacuaguuuauauauaccuauaauaaaugugaaaaaaguuaaaaggcuaugaucaaaauauugaguguaacugaugaaagguacuuaaucaagaaaagggauauugcaaauaacuauucugucacuuuguuaacuccacuaauaccauauuucaucaauuugugauugugcucuuaggauaaaguuuaucaugcauuacagaacuaagcaguuauauccagggcauauuuucguugauuguaauuuuggggaaaguuuuccagauuuuaauaguuuacaguaacauggcauuaagugaaaauccuuucuauuccaaucaccuauucuuccuccagggacaauauguuuuguuuucguuuuuaaacuuggguugaauucugucuauaucucucucuucuuuagucuuuuaaaaaaaauguuuugcacauaacuaacuuggauguaauauagcucuccuuucuaacuuuggcaugcaacaauuuagucacugcaaagucaguuucuugagcauuuccagauaagcaguuauaaauagcguaauggauauauuucacuuuuugggaaucauucuuuuguuuugguugucuacaacugauauuauguguaguauucagagucccccuaaaacuagcaggguugauaccuuuggaaguuuacuauguuucucuuaucaaaugagauagagacuuaaauauuccuccuguugggcagcagcaugaccaugaucaugacugccauugcaguggcuguccauuauaguggcgaacucacucuggauuuauucucuuuaaucaugacagcuguacaucuaaauauuuuaaaagauguacuguguuuaucucauuuuggggcugguuugcuagcauaugaaugagacuuuuauuagguacaaguagaucuuaagagaaguguuaauuuuagaaguccuaagcugaguucagagaucuugaugauauuuucuucuuucaggcuuuguuaagacaggaagugcuuaaacuaagcacuuaucaacuaagcacuuaucaacuuaucaacuaagacuuaacaaaauuguuucuggugauaaauugaaaagcuggauacuuccguuaaguuaucucuguuaacauaacugauaggaaaauaaauuaauaaccacacagauaccuaagcuuuguguaugguauguugaugguuuucuagauguuagguugagaaccacuauucuauuuuuguauauauauauauuuuuaaccuaucucacugcacacugagagaaccaccuuuuuuuuuuuuuuuuuuuuuuuuuuuuuuuuuuuuuuugagacagggucucacugcuguaguccuugguggagcgcaguggcgugaucauggcucccugaagccucaaccucccaggcucaggugauucucccacuucagacucucaaguagcugggacuauaggcauuugccaccaugcccagcuaagagaaccacuauuuuaaaacccuguauuuauaaguuggaaagguacuguuugucaucucuaaguacauuuuauucucaagauaaaacuauuauuuuugaaacaagacauaguauuuuucauuugaaaaauugggaauuacuuuaauaaaccuuuaugaaccugagaaaacaaagucuaagaaaaugucaauuuaaaaagagauagaggcugggcacgguggcucaugccuguaaucccagcacuuuaugaggccaaggcggguggaucaccugaggucaggaguucaagaccagucuggccaacauggugaaaccccaccuguacuaaaaauacaaaaauuagcugggcgugauagugggugccuauaaucccagcuauuugagaggcuagggcaggagaauugcuugaacccaggcaauggagguuguagugagucaagauugugccacugcauuccagccugggugacagagcgagacucugucugaaaaaaaaaaaaaaaaagauagaaaucaauuauauuuccuaaggauuuaguacuuuaauuucaauuaauuuuuaauuaauguaauuauaguuucuauuaaagagauugaauaggaugaauuacaucuugauugugugucguucagcauaguacuuacuucagaagucacauggauccuaaguuuucuuucauguccucuaagauucauuucaccgugacaauaucacugaaaaacagcaaacaggaauuacagcucucacuauguugccaaggcuggucucaaacucgugggcucaagcaauucucccaccuuaaccucccaaaguguugagauuacaggugugagccacuacacccagcuuuauuaaaucuuuaacuuucacuuuaguguuaaaaacaguaaauacuaaggcuaaaagugacaggaaucuuaaagguagaucagucaggcauauuaguuaacaugugaucugguuuuauucugauuaucugucucuaaaucaccaggucaaauuaaaauacaaaaaaauuagccaggcauaguggcacgugccuguaaucccagcuacuugagaggcugaggcaggagaaucacuugaaccuggguggcagagguugcagugagcugagauggcaccacugcacuccagccugggcgacagagcuggacucugucucaaaaaaaaaaaaaaaaggaaaaaaaaaagaaauaucuaauaaguaccauccuaagccaggcauugagucacaugcugggaguacaaugcugaagcucauaagcuagugggggaaaaucacauauaaacccacugaaauacaguguuagaaaugcaaacaaaauauccuaggagaacaaaggaggguacaaugaucucugccaaggagagucaggaaggcuucacauuucgauugggucuugaagugaauuuaaacaaggaguuggauaugcaauauuuuuacaagaagaguaguucucagaaaucugauaaggucauagaaacuaagcuaaacucaagaagcuaagaauaggagagugagcagcuaaggcacaguggaggaggagagcggcaaccuuaugaugguucacugacuggcugaaugacuaagucuggauugcugggccuucuucgagguccuucccccucagcuuggaaagauauuccuaggaaaagccccuaguugucccuacaagcuucuuuaacacccagaccagaauuaaaucugagauuuuuuuucucagagaaucauggaaugauagagucagaaaagauacugaaaaucacaguuuuguugucucuaacaucccucagaaucuuagggauucucaaaaugggaaaugaaagucuguaaucaauuuucaauauucugaaaaaccuaccagaaauuugacauuuucugguaguauuaaaucacagcuuuccuugguuugugcuagaguuauaucggauccacauuaaacugagauucugacugagcugucuucuaaauauaagcuguuuccucauuauuauuguuauuauuauuauuaguuuuuuugggguggaggauggagucucgcucuguugccaggcuggagugcaguggcacgaucucggcucacugcaaccuccgccucccggguucaagugauucuucucccucagccucccgaguagcugggacuacaggcacgcaccaccaugcccagcucauuuuuguguuuuuaguagaggugggguuucaccguguuggcugggauggucuugauccuugacuucgugauccuccugcuuuggccucccaaagugcugggauuacaggcgugagucaccgcuccuggccauuauuauuuuuuauuuuuuauuguuuuugagauggcgucucacucuguugccaggcuggagugcaguggugcaaucucggcucacugcaaccuccgccucccggguucaagugauucuucugccucagccucccaaguagcugggacuacaggucccacgcccagcuaauuuuuguauuuuuuaguagagaagggguuucaccauguuggccaggauggucucaaucucuugaccucacgauccgcccaccucguccucccagagugcuaggauuacaggcaugagccaccaugcccggcuuguuuucucauuauuuuuaugcucaauuugguaaaaagcuuuucaaaaucuaggaguaagguaauaaauuacuacaauauuugcaauuuacaaaaaaacauuuucacugauuucaucuuaauuuauucuucauaacacugcagucacuaauaacagcagagccgggaggccaccacucucgggccagaguucuuuucaaccgcuccaagcuucuaggguuuuuuccuugccaaggguguugcuaagggugcacugugcauguccaggaaauacugcuucuaucauggaauaaauaaaagcguguauagagauauaugucuccuguuuucaagaaacuacuagccuugcuguccaggugccugugauucaugguguuuggguugaucuaagaaaauagcauuaacucugguuuuaugaaaugaauauuacaugcaugaauuguaaauaucagaagguagauuugugugucuguguguguguguguguguguguguguguguaauacuaaaaaguauaauuucuuccuauacgguaauacuuuaauuccuaauaucagcuucuuucugcuuuccauuuuugcugaggaauggugauuucaguauauauguuuauuuuaaaaucaaaaugcuuuuuaucuugcauucuguuuauuuuugugcauguuuugaaguugacaaaauagaauuaacuucccuuuuaaaaauguaaguagaauuuuacaauauuuguuuuuuaaauaagucucucauccccacugccuuuacuguauuuuuauucccuaaaacaaggcaacaggaggaauuauuuaaacaucuaagucucaguaaccuguguuccuuuuaauaaauuaauuuuaccaauacugucccuuugagguaguuacuuuuguuuauuaaugccaacaugagucauauagcaaucagugguaaaacuaaaccugccuggagcaaccacguuuuugacccucuuuaccugcaauaauuggaauuuagcucuccuaccauuuacacuccagcuugggagacagagugagacccugucucucuuaaaaacaaaacaaaacaaaaccacaguuguuucuugguauccaugggagauugguucugggauaccuccacccaccaccacucccaaccacccccccacccaggauaccaaccucugaggaugcucaagucucguguauaaaugguauaauauuugcauauaacacaugcauauccucucauuuacuuuaaauccucuuuuaauaccuaauaaugguauaaauguuauguaaaucauuauuauacuguauugcuuagggaauaaugacaagaaaaauacgucuguacauguucaguacaggugcaagcauaguaagccuaacugcauuuucaauuugagguugguugaauccacaaauauggaaccuguggauauggaggccuggucgugacccacuuauuauccugcuuucaccuucuagcuuuagcaucuauagauuauucuugcccuaauuauuguuaugauucccaagugguuauuuuucuaacuccaucauuccuucuacauuuauuagucggcauucugcuuuaaggagaaguuuuccuuuauuuauuuacucauauauuucuauuuuauucaauuuuuuauugucauuuauuuugaugaucagaucaaccuaauuuuggccauggaaccccuuugagcaauuaaccuugcuauccgacauaucuguaucagucuuugagcauuuccuuacuuucuggcacaacaaaauguuuuggguucaacuuguauuuccucugucccagccuagaaucaacuauuguuucaagaagaguaguauauagaaaccaaaaucugaguucaagauacacuuguugcgauugggguguuguuaaccccaguccuuuucagugagcacagcuagaaaauguguauuugguccuuuacaauuacauuuauuucuauagcuauccagguauauuauacaccaucaauuugcauugauagcuccaauucaaauacaauccugcgggguucauucuaucucuucuuuuuauauuuauaucuucuuucugugucagugagaaaaaucugauucccauuauccucaauauguuuacuuauuccauuagucaccuuuauauagaucaacuucuaacccugccaggcugcaccugguacuuuucucuaauauugucccuaaaugggcuuccauuauugacuaucacugggcugcuuuugcugucccacuccacugauauucuugcaagugcuuucauuaccagcuacuggcaggcugccuuuguuuguaaacucugagaguaauacuuacauuuagcauuuuucuuuugccacugcaguuuaguuugcaacuuaccuucauaggguucaugagaagcaucaaauaccuacuacagcuuaguaaauuacuguucuugucugcugagaguguagcaugaacuuugaggagauaguggggagagaaacaacccagagaagauuggagggaagcagagguaaggacaggaggaagugagagauagcugaaagguaucauaugggaugaaugcuaccaguacucuuuccccugcuuucacguaguauuuacccugcccuguuaaggaaagaauacauucuccuuagaaaaaugguuaaagcagcaguuauuacagacucaaagacccuuuuacuggccuacccucaccccccuaccaccacccuuuuuuuuaacccuauagagucugguucauucuacacauucccaaauuuucagccacuauuucuacuuugacugcuggccuccaggcucauguuuucaguugccuacuaacauuucucagaguguuccaucuuucuuccuaaauaaauuucucuucuugcauauacugucugauuaaugguucuaccaacuuuuccaucuucuuucaccuaauuuaucccccuuuuccucucccuucucagcccagucugauuuucaugaaccuuuauaaauaccuuuccaguacauucucucuuccuuaucuuugaguuucugacauuuucaggauaucaaguaacaacuucacuuggucuuuuuccacaucugcagguugcacaguguucaagggagagguaaaggagacaauuaauaacuaauguuucuaucacuuucuuucccagacagaggaaguaacaaguuuccucugcgucuuuuauuuucuauuuuuugcccauuuuccucuauccuauaauucauguuccucccucucuccauccucuuuauccuauggcuuauuguucccuuggucucuccaugcuucugaggaucauacagaaaguaaaggaucuggagauuuggcuuuucagucuugcaacucuguggagaugugcucugaaugacuaaaaagcacuggagcucuguagagcauaugggaaauaauggucuuucugccccuuuaggaaccuuggagaagaaggacaaggaaggaaaggggccuguuugcauaagacagaaacuuucuagguugaugaguguguuaaaaaauccuaacaggcaguuucccagagaguaggcaguuugagguaguauggagaauauaauuaacuuaauagucagaaggucuguacucuagugcgagcuuugcuucuaacugacugcaugaccuuaaauaagucacuuagacugguucuucguccuuguuuccaaaaugagcauguagaauaggugaguuuuaagguccugcucaguucuaaaauacagauuccaauagaacugaguaacuuaguguuaaaacuaaugugggguuuuuugguaugugugcauuuuuaaaaaacuuuugguuuuugaccuaacugaaggcaauauacuauuuuuauuuuuccuuacuugcaaaauugauaccucuaacaaaaauucaagggaauuuauuuaaauauaauugcuuuaaaaauguuuuaugauagauaaucugcauugagcacauuuuaauuuugugugggacuaacuuuauauuucuacuaaccguuuccuuuggauaacuguucuuucauccacuguagucuuugaagaggacuccucaaguguuugccuguuaguaaaaaacaucuuauuucccauguuguauuuuauguguugaaaaaaaaauuuauucuuauaaauuccucaauucuagcccuuuagauauuuauaagcugcaugauugcuaauaucuuuuccagagauuauuucagugggugaaagagguuacuucuuuauuuucuuuguguuguucuuuuucacuucuuccauuauuuagaaacuuauuuaaaauuuucguuuuuuuauaucuuuuuauguugcaaaagaccugugucuucacuguauauuaaaaugaguuguauacuaaaaggaauuuaucaaacuaaguuaaaccaugaauugcaacuuaaccugacaauuagaucauuucuuaaauaaaacuucaaaauauauuuuuaaccauaauaaaaugggcaaaauuuuguuucuagauuuuguucaaagaccagaugauuuacuaagaauuuuuugauaaguuagggcaugucuccuagaauuguuaucuguaagaccucaaaaccuuuaagcugaaauaggacauuaauuuacauguuuauuuuagcuguuagauauauuucuaaauuauuauacaaauaggguggucauuaaaauuuagagaaauagcuaucugauguaauuauuaacagauuauaauuucuaucaguaaccuauccaaaauaagcuaaguccaaacauucuucugcauauuuuaauuuuuagaucaaagaaagcaaagaauucaauugauaaaucaacugaaacugacaauggcuauguaucccuugaugggaagaagacuguuaaaagcggugaagauggaauacaaaaccaugaaccucagugugaaacuauucgaccagaagagacagccuggaacacaggaacacugaggaaugguccuagcaaaguacgugugauuuuuaaaauaguuugccuaugugauuuuauauuagccaauguaaagugacuuagauauaguaguugcccuugaacuaaguauuuucuccagaauuaauucugugagcguuuauaacacugaugaaacuguaaaugagauaaaguguugugauuaaacuugauugacaauauaaucugacaccuucugaauugauggcuucaguuuuuccaaaaugcuuuuuuugagacggggucuuacucuguuauccaggcuggagugagguggugcgaucuuggcucacagcauccucagccucccaggcacaaacgaucuucccaccucagccuccugaguagcuagaacuacaggcaugcgccaccaugcccggcuaauuuuuuuuuuguuuuuuguagagacagggcuuagccauguugcccacgcuggucucgaacuucuggacucaagcaguccacccaccucagccuucuaaaguucuaggauuacaggcaugagccacuguggcuagccccaaaauguuaaaagcacuuuauaauuuacaguuguuguuuguuaagccuuacuuuuucuuucccuauuucuguguguguaagaauuugcacuaaguggaacaugcgaauaauucaggaagcugaacagggaaaccaguuuuccauucauguucucuauaagaagauaucuuguuuuuccugcauucauuaccuguggugucaacauaccuguuuuguuuucuuuuguuuuguuuuuaaucuggaaaaaaucuuacuggggacauauuuguuaaagagaacaauuauuucuuuacuuuuccaaaauagagagacucugguuuuauuguaacaaagcuuaaugugaugucuucuauuucuuugcuucacugaauuuuuuuugguugaacaguuuauucuuuagaagcuguuacaguaaaaaaauagagagagagucaaauuaaaagauguuaccucucuuacauuugggaaugugagcaugaacauauuguguuaaggaaaauaaagaaaagaggauucucuaauuuuggguaaaguauauguuacuacuugaacguucauguauuuucaguaccaguagccauagaagagcaugggccugcaaugaauguagucccuuacucugauuuuagauuuuuuucagcauuuagcucugauaaugugagccucucaucacuguuauucagcagauaaauuuucagucauaugcuuucaaacacguuuucaggcuuguauuaauauuaccuaguaaaguuguaugaggaacaugaaaauaucaauaaaacguaugcucuagagucauuuaauuucguaauuucuaaacucuggauaucuuuuacaaauugauguguguagaauguugucugacgugcgcacaugcaguugcuauuuacuuccucuuauccuguaaaccauuauuaaauuaguggugggucuuacaauugauggcuuuuucaguuugaaaaaauaguauaauauguucuuucaccuucuuuuaaguggucucuguucugcuuuucuccuguuuauauuccuuuuuuuuuuuuuuuuuuuuuuugagacauggucucacuauguugcccaggccagaguucaguggugcgauuauagcucacugcagccuaaaacuccugugcucaagugauccucucaccucacucuccugaauagcuaggaguacaggugugcacugcuaugccuggcugauuuuuuauuuuuauuuuuuaagagacugaguuuugcuauguugcccaggcuggucucgaaccccuggccucaaacagucuucccacuucagccucccaaagugcugagauuacaggcuugagccacugugccuggcauauuucuuauuuuuggaugcuguuucaaauccuuuucugaacagaaauauuacaggauaauauuugacaaauggcuguugaaguacuuuuaaaaguaaaaaugccuuaaaaguauagucacugauuuaagauauuuuuucagaaaaucagguaauacuaauuaguuacuuugugguaguugaggauauuuugaaguuguguguauauauguauguguaauuucaaauuucauaguuuaaaagcuaaaagguugguuagaaauuaccuauaauccucuuuguguacucccaacuuaggauacccaaaggacaauaacaaaugucucugaugaagucuccagugaggaagguccugaaacaggauacucauuacgucgucauguggacaggacuucugaagguguucuucggaauagaaagucacaccauuauaagaaacauuacccuaaugagguauauacuuuguccuuaaguguauacauacguaucuauuuuauauguuacuaauuuauaacuucuuucaacaauuaaaaauuguugaaauaaauauuucacauuauuaucaauauuuauuauuguuguaugaucuggauuuauaaaauagcaguuuuagguuuacguauugcacauguauugauagauagccacacauuugagcucauuuuaugcauuaucuuugaagacucauacauuguuuguuguuugcuuuuaaagaagaacauucuggagagagaaucugcaaacuccuguguucacuuuuuccacaauuugaaaggcuuuauacauuugaucauagcaaaguuauuuuaaguaacuuccuucauauugcugucaccaguuauuaaguccccauacuucaaaauucaguucuuuuuucuuuguuucuauuuuuccuuauuaaucuuuauuuucucuaaacccuuuucaacuauaucauaucucuugagcuucaaauuguuuaaauaaagaauuucauucaauuguauuuucaguuucuaaucuaaggguagaacauuuggcuuuaaggcaaauaaauuacacuguuuaucacuuuuuuauaaacauuaccuucuacucuuuuugagcuauguuaguaauuuuuuccuugaugguuuuggguuaaacuuguaaaacaaacacauguuacgcugugcuggaauaugauugccuucagaguauuaagauuagaagaguuacuauucuuugcacacucuucuuugugguugugucucugguuaaucuuucuggugauugugguuuuguuucuuuucccagugguugccauacagacacuaaugccagugugucugcucuauugccucuucacccaugucauuugauguaguguuucuuguuccuaagccagauaaccaagcuuguaaaauuuugucuuacuguauguacuguuagaagucaguuggugcuggaagggagacggagggcuguuugaccccucucccagaauaaauuauuuagcaguagcaguauuuuucucacuccaugaucuuggcuuuuguugguuugcaacuguauuuuaaacgauugaguuucuugaagcgcagaacauuauucuaccuauuaacuuuuaaauuaaaagguuguuuaaaaucuugauuuccagcuaaguaaggcugauaguaagcauugauuuacaucuuuuuuaaugauauaagaaauuacauaaauauaaaauauggcuauaaaauucuucgucuauaaagugaagaauguagacuaggugauauuuuaaaagcugcauucaguucucaaaaauuuuuacucuuaaaccagcuuuaaagggcguuucuaaaaaaaagcaaaauaaagccuccuuugaauaaauaaaauggaaacagaagauuuguagugcucuuuugcguuuuuauuuauaaauuuaaauuuauuuuauaaauuacuguacucucuccaauugcuaguaauguuuuuucuuuaagagugaggcaugaaaaaaucauuuggacccacucaaacacaaugagcaagcaucucuaguaccuagauugugccauuuaucacuaaauaaccaaaaccaaaaaaaacaaaaacaaaacaacuucuugaagaaguggcugauuccugauugucguuuguugcaggaaauauacaaaaugacuguggaaccucuuauaauaugauagagggcaaggaagcuaucaaagacuaccaaggucuuuucagaaagacuugggagccaaagauagaauaguuugaacuuuaauuuuucuugauaaaaguauuccaaugauaaaugaaaaggaaaauucuuuggggaaguauuuugugcauggaugggauugguggguuuuauuguaagauaaugggucaggaaccuagccauuuguuguaagcuucccagauggcaauaucuguagauaaacuuuuuaggggcaucuauuuuuuagggaagacuuauccagucuucuggugggauggggguaguagauaauaaaacaggcugcucugguguuuggcaccaagggaacuggggaugagauggggauuuugucauuuaauguguagacuuucauuuaauccccgguuuuugccuuuuucuacuaucuacuguaucugguugacuucuuccaguguucuguugggaggaauuacuugguuaucugggaugcaggaggcguccuagggaacugacagcuucuuuuaaguguuucuucuguuaccuacucuguccugcuuuguucagcucuacaaauauuguucaauuuuuacucccaauuguagguuagcuuuucaucccagaaagguaacauuugaugagaagcguaaugaagaaaccaugggcuuggaguuagauuauuaaaaugaccuugggaaaauuauuuaacuucugaguuuuuuaaaacaauuuuccuuccaccccccaagaaagcauuuauaaguccauauucccuucaaauaaauacuauguguucucuaaaucucauuauauguucaguuuuaggcgucuaaagauuugacaugacuagcaguagaaaccaaaacaaauguguuuuaacuugaacuguucaauucuaaaauuuucuuuuuuuagacuuuauuugguaauuuuuagugauauucacuauuaaucacacaaauauuguagguaaaauucuauuugaaauuuaggcaauuauaggcaauaguuuuuaggguuuuuuuuuuuuuuuuuuuuuuuuuuuuuuugagacagaguuucacucuccuugcccaggcuggagugcaguggcgccaucucggcucacugcaaccuccgccucccggguucaagugauucuccugccucagcuaauuuuuguauuuuaauagagaugggguuucgcccuguuggcuaggcuggucuugaugcacccaccuggaccucccaaagugcugggauuauaggcgugagccaccacucccagccagaguuuuaaauguauaaaaugacccacuuggccgggugcggugcucaugcuuguaaucgcagcacuuugggaggcugaggcgggcagaucacgaggucaagagaucaagaccauccuggccaacauggugaaaccccgucucuacgaaaaauacaaaaauuagcuggcuguuguggcacgugccuguagucccagccacuugggaggcuguggcaggagaaucacuugaacccaagaagcagagguugcagugagccgagaucacgccacugcauccagcguggugacagagugagacuccaucucaaaaaaaaaacaaaaacaaaaacccacuuacuaaucugcauuuggcaaaaaacacuucuaaagaauuauagauauuuucuuaauccugaaaucauuaauuaguuuccguuaaagucaucaggccuuuaauccugauuaacaagucugcaacagacguuauauauaauaaacuaucuuuaucacaaguuuuaaauuagcaauuauuaaaagcuuaauguguucugugccuugcuaaugaaaacuggugacauuagagaaccugaaauauuuuuggagugcuguucauaaaacagagcagagugauuuuuguccucuuuuucuuuguauauuuguuuuuacuuauuaaucauuuucuucucuuuugaaaguuuuucuuuuuacuucuuucuaaauaaacagcccuccucccacaaacacucuauuaacacacuguagauucacaguccccauucuaauaucaguagauuaauuauuaauaauguaccucauucacucaagguauuuuguuaccugugguaaggagauggccaaaaaaaaaaaaucugucuuuuguggacucguaguauauuuagauuuacaaucuauuugagaauauuaaacacaugaauauuuaauugagacagacaauauuggccgcacauucaguggcucacgccuguaaucccagcacuuugggaggcugaggugggcggaucccuugagcucagaaguuagagacccgccugugcaacauggcgaaacuccaucucucaaaaaaaaaacaaaguacaaaauuuagccaggcauggugguacacgcauguaguccugcuucaaaaaaaagaggccagggccauggcucaccccuguaaucccugcacuuugggaggcugaggugggcugaucacuugagguugcgaauuccagaccaaucuggccaauaugauaaaaccccaucucuacugaaaauauaaaaauuagcccggugugguggcgggcuccuguaguccuagcuacucaggaggcugaggcaggagaauugcuugaacccaggagguggagguugcagugagcugagauagugcugcugcacuccagccugggugacagagugagacuccaucucaaaaaaaaaaaaaaaaaaaaauauauauauauauauauacauacacacacacacacacacacacacaaacacacacauacacauaaagagagagauugauuguggaaagcaguacaaaauuuauuaucaaaugaauauaaauaauaacucacuucaggccgggcuugguggcucacgccuguaaucccuguacuuucagaggccaagguggguggaucaccugaggucaggaguucaagaccagccuggccaacauggugaaaccccaucucuacuaaaaauacaaaaauuagccagucgcaguggcaugugucuguaaccccagcuacucgggaggcugaggcaggagaaucacuugaaccugggagguggaaguuguggugagugaagaucacgugccacugcacuccagccugggcgacagagugagccuccaucucaaaaaauaguaauaacucacuucaggaacaaagugaucacucuagguagguggcuuuaagguagcauuuguugagccccugcuuugugccagguuuguauucaaaguucccaugcucauuuaauuuuuaacagcuuuuuaaaggagugcaggauuaaugauaagagguaggagcauaauuaaggccuaggguggaacauaaucaaagcaaagaacaagccaugcuuaggggcucagaaguagccuacugucacuggaguaaaagguuacgguauguaguggaagacaaggucaaaaaguagcacauaugaagaugagcaugcuaggugaaggaaucggaacuuuauccaggagagcagugagaagccaaggaaagauuuugacuagaggagucaaagaacagcugugcuuuaggaagguuaaucuggaaagaagaggaaggccuuuuaggcaaagaucaauuaggaggugcuuauagcaaugaagguauaaaugauaaagucugaagucggugauagcaaaggaaagacaaaaggauaaauauaaugcauuuuaaagguacaugacaaaucuagucacagaggacagccaaaaaaaaaaaaauugaagauaccuggccauaaggaugacuaugaccaugauuuauucaguaaaaguuuuuuaauuaauuuaaaucaaaauuuuacucaucuuuauuuuguacauugcaaacucccaggauaaaguaaacugauuagaaauuacuuaacuuguuuuaauuuuuuacuuuuauaccacagauuaucucaagaacaugaguuggcaguuaccuucuugguuuaaauaucaauuuuauguugauuucacuuccauuugugaaacaaaaacaguagauaaauccacucuugcuuaaaaaaaaaaagacuagaauaagaaaauacagucauuccuggguauccacgugagauugguagauauccggcccuucuauaaauaccaaaauccaaggauucucaaaucucacagucagcccuguggaaccugaugacacauaagucagcccucgcccuccauuucuccaaaacuguggguucugcaucucaggaauauuguauuuucuaucugcagauguggaaugcauggauaugggaggccaaugguauugccauuaauaacaucaauuaaagucaguuaauguucaccgugcagaccguaugaacuuagacuacuuagacuacucucucugccuaccugaguugugaacuucauauaaaauuuaagagaaaauagauacaaccuuuguaugcaaaguaauaucugagcugaaauaugaaaucaaauaaauuuugaugugaagguauuuuguuacugaauaaaagcuaauauauuuuguaauguuuugcugucucacuaucuuuugaggguguauuuguuguuuuagcaaaaaguaucaauauauggguucugauaguauccuuugaguuggaaagaguacauaaauuguauuaaugucaaagaauaucuugauuucaggacgccccuaaaucggguacuaguugcagcucucgcuguucaaguuccagacaggauucugagagugcaaggccagaaucugaaacagaagauguguuaugggaagacuuguuacauugugcagaaugccauucaucuuguaccagugagacagauguggaaaaucaucagauuaauccaugugugaaaaaagaauauagagaugacccuuuucaucagguugguuuaugguuuuggcuuauguggagcuaugagucaagcuccuuugaauuuauguucaaauguuacagaggugaagaaaaagcuuacauucaagcuuauauuucuauaauuuuuuuucuuuuuaugugagcuguggucuggcuucaucaaaacauagaaucucaguacuuauauugugguuauguauguuccugaaaaguuauugguaacuggaguuucguaagucaaaucguguguuaggugcaauaguacuuucuuacugaacauacuuuguggccagaugcauguacaccuuggucuaaacuccaccuauaagauuauauucacaaaucuacaucucaugaauaucaaauuuguagcuccaagugcccauaguaaugcuauccaauggaaauauuaugagagucagauguauaauuuuuaauuuucugguagccucauuaaauauuuuuuaaaggggaaauucaaauauguuuuauuuagaccauuauauucauaauaucacuuuaacauauaacuaauaugaaaaaauuaaugaaauauuuuacauuuuuaauacuaaaucuucaaaaucugguguaaacacuuagagcacaucucauuuuggacuagccacauuuuuuuuuuuuuuuuuuuuugagauggagucugucccucuugucacccaggcuggaguacaauggcacgaucuugacucacugcaaccuucgccucccagguuccagcgauucuccugccucagccuucugaguaguagggauuacaggcgcccgccaccacacccggcuaauuuuuauguuauuaguagagacaggcuuucaccauguuggccaggcuggucucgaacuccugaccucaagugauucucccaccucagccucccaaagugcugggauuacaggcauaagccacccugcccagucggacuagccacauuucaaaugcugaauagccacaugugaggaggguacuauauuggacagcacgauuuuauaggauaucuuuauuugaaugucccaccaauaccucaaauuuaaccaguccucccucauaaaucuguuuuucuuauuccauucaaaauuuuggugaaugacaucuccauucaucuacucacuaguccagaaacuugguggucauuuaaaauuccccucuucuucaccuucucucucuuauccaacuccuuaucuaauccugucaaaccaaguaaagucagaaaacucgagaaaaaaaagagaacuuucaaucugauaaaagggugaugcauagcuaucaaagaaccuucugcuauaacaaucccagaggcuggguggcuuaaacaacaaacauuuauuucucacaguucugaggccuggaaguccaagaucagggugccagcaugauugguucuugguaaagguucucuuccugguuuacaacagcuaucuuauccuuguauccuuacacgguggaaauaagggagcucuggucucuuuaccucugucugguuuugguuggaguuaggcugauuuaaaguccauauuaaagagcaaaauaucaagaauagcaaaaacaauuuugaagaacaacagggaucuuucccuacuggauauaaaaauuuacuuucaauuuaauacucaagauaguauaguauagacauauaaacauauauaccgauggaacagaauagaaaacucagaaauagacauuuguuuauaauggaucacuaauacaugacaauaaguggcauuacaagucaguagaaaaagaacggacuauaugguugugagucaaaugauuauacacuugaaaauuuauuccaaauaguuucuaaaggugaaaagcgaaacuuuaaagcauuuagaagaaaauacaggagaaaaaucuuuauuacuucagguuagagaagaauuuuuaaaaacaagauauaaaaagcacaaacaaaaauggagagauaaauuugaauaucuuaagauuuaaaacuuugggcguguuaaaagaugagccacaggcugggagaagauauuuccaauacauuaacuaucacaguguuacuacauacaggacauaaagaacuccuacagaugaauaaguaaaagacaaaugacucaauagaaaaauaaaaggaugugaacagguccccugauggcuaauaaaauauaagugaagauggucagccuugcuauuaguuagggaaauguaaauuagaacaauuagauacuacuuaauauugaucaaauugucaaaauuuaaaaccugauaaauuucaauguuggcaagaaugugaagagagaacucuuuaauacugauguuuguuuguacagcuacuuugaagagcaguuugucauuauauaguaaaguugaaguucuauauauucuaggacccuuucauuccaauuuagaaugaaacuuuagaagauaggcacuaucauugcauugugcaugauagugaaaguugaaaauauaauagccaauaauaguggaauuaauaaauaauguuguaugauaaaacaguauacagcagugaaauugaaugaacucggcugcauguaucaacaugaauaaguuuuugaauauaauuuugaaugaaaaaggcaagcugccuuuacuuuaaauaacccugucucuacugaaaauacaaaaauuagccaggcguggugacaggcaccuguaaucccagcuacucuggaagcugaggcauaagaaucacuugaaccugggaggcagggcuuagcagugagcugagauggcgcuauugcacuccagccugagcgacagagcggacucugucucaaaaauaaaauaaaaaauaaaaaggauggcuaugaauguuuagaaaaaacaaagugguaauuagggaaauugagcuggaguguuuugguguugacucccuaauauaugagauauuugaaaacauugauauauacaggagaaaacagguagggaagaaucaaagagauacggaagaaaauguugacugguggaaugauuucuuaggauucuggaggggaaucauaaucaggaagcuuagcauuugacaggaagaggaaaacauccucugcugagauaggaggauaaggaugagugcaugcagcaagcaagaugguaagagaguuauugccugaugaucuuuuuuccgugaagugcaagaguccaagggaucuacuggcaauaagcgagaugauacaagaggaggcuuuuggaugguggugaaggcuuuaaguuaccauuuguggagaauggagaaaggggacagagagagggagagagagaaagaggaagagagagagagagaaagagagagagagagagagaguguguguguguguguguguguguguguguguguguucaagccaaugaacacaucaaaacaaucauacugccuugccacauuguugaggguccagcuggaaucugaaaccaugaauuuguaguugccuauucuacacagcuaugugauguuuucuggaauguaguuguuacuauaucugacauuuaauaagcauuuacuuaugccacacacugugcaaaguaaucuaguugcauuaucucauguauuuaaccuuuacaaccugugguaauguaguuuauuuucauuuuacauugcucagaguugaguaaugugcccaaagucacacagaguaaguguucaauaaauaguugccacgccuguaaucccagcacuuugggaggccgaggcggguggaucacaagguuaggagaucgagaucauccuggcuaacacggugaaaccccaucucuacuaaaaauacaaaaaauuagccgggcgugguggcgggugccuguaaucccaguuacucaggaggcugaggcaggagaauggcgugaacccaggagguagagcuugcagugagccgagauggcaccacugcacuccagccugggcaacagagcgagacuccgucucaaaaaaauaauaauaauaaaauaaauaaauaaauaguugcucuucaagggacaggagaggggaugauugaaaugguggaucugguggcagucuagucauuaaauuguuagauugagaaggaaaugaaaucaggaagggacugauaaauuuaaggauagguguguucaagggaacaaguguuucagaauugaagcuuugagagaccagguaagaugggaaguuguaguagauuccuuucagaaguagagcaguuccguauggugacaaggucuaggguguggcugugggaguagcguccuugggauugaagaaaugaaaaagugaacaauccaugaaagcauaggguguugaaugagucaucugcauauucaucuaagucacugagacuaacaacuggaguuaagauugagggaaaugccugugagcuauuuucccagagauaacuauaagcagcauaaaagcagggaccauguguuuuuuuuuuuuuuuuuugcucaguguuguaucacacagcgugagguacacaguagguauuuaauaaauauugaaugccugaaacaaaauuaaauuuuuucaaaacaugccaauuaggccuuucuuaaaugauuuaaaaaauuguuuuaugaugucugugcagaguaaauugcuccuaagucugucacaccagucggcuaccuuuuugguaagauaaaauuuguuaaugcucuacucuguauaucuaauuaugguauccuaggcuuauauugguuuugcuuuuagauuaaagacuugaucuuaaacagauuuuuaauucucagguuucaaaaaauaagcucaugcuuuuaguuuuacuaguagcuaaguaauggaaauuagcucccuuuuacuaaaaagcuacuaguuuuuuuucuuguuuaaccagucuguuagguuuggaagaccuuuuucugucugcuauacagauggaaaaaucccuucucaugaaaaaacacugagcauuugaauuaguauguucuaaucagaauauucccaaauguguaucuuuauuucauuguuuuauuuuguuuguaaauaguaauugaaacauuuccacagaagaaaauuuuucuccuauagcccuccucuauagcugaauauauacuaaaauauaaagcuauauucagcugaaauucaguuuuuaguaaguguaaagcuuuaaauggcugcauucccacaguuggaaacacgaguaugugguuggcauggugaauuuauuugaaauaaaacaugccaccauuuaagcaauaagguuuucagguaguuuugaaugaauaaggagcaaagcaguugagauuuuaagugaggauaaaguauaaucauuuuagaaguucuaaauuuuuggaucugugaugcugucuucaaagguaaaaaaaaauuuuaaguucuaaauuuuaguuugaaaacauauauagcggccgggcaugguggcucacgccucuaaucccagcuugggaggccaaggcggguggauuacuugaggucaggaguucgagaccagccuggcaacauggugaaacuccaucucuauuaaaaauacaaaaauuagucgggcaugguggugggcacgguggcaggcaccuguaaucccagcugcucaggaggcugaggcaugagcauugcuugaacccgggaggcgaagguuucaguuagccaagaaccacacuccagccugggcaguggagcccaacacagucucaaaaaaaaaaagaaaaaagaaaauguauuuagaguaaccuaugugauaaaauuauaaaaugaaauuauuugcucugauguuuucccugaaccuuuuaaaaaaaauuucaugugaugcuguucuccacacugcagacaugauucaacaagacuguuuuucaguguacauuccccccccccacacacacacacagaggaauauagcagucuuuuuuauuuauuuuuucaaguuucuacacacaacauugaacauguaauuuacccuuuuuuuuuuuuuuuuuuuuuuuuuucagacggagucccacucugucgcccaggcuggagugcaguggcgcgaucucggcucacuucaagcucugccucccggguucacgccauucucuugccucagccuccccaguaccugggacuacaggcaccagccaccaugccuggcugauuucuuuuuguauuuuuaguagagacgggguuucaccguguuagccaggauggcuacuaucuccugaccucgugauccgcccaccucagccucccaaagugcugggauuacaggcgugagccaccgcgcccggcguaauuaacucuuuuaaaauucaccaguuucuaguugcugucuucucuuuugccuuuuggcauucuagaaauaauguaauaucagaugcuggauagaguaauuggcaagguagcuagauguaaaaggagugcuuuugggaggacaaugagaauguccugauuuccuauuucugucucuagaugggcuuucuugguauugauauuccuuucuucauguaauuaggaagaccuuaauucacuauuccagacugagaguuuaaaaaugucuguaaaucagugguugaaaucuguuggcucucaagcuuaaacuucuuuccuuuuagcuucuugcacuuccuguuucuggcuuuuugguuuccuuacgcuuaacaauuguaaaauuucuagugaaaguuugauacauauuuugguacagauuauuucuuucccaaaacagaauauuuuguuuggagauaaaugaggaaauaacauuugagaaauuaaguugguaguuaauaacuaguaucuuagcacucuucaggaccucaaguagugaaauguauaccaugaaaguuaaaguauauuaaaauccuucaucucuagaaaagauaaaaauuucccaccucuuuuuuuuuacauuauugaauuauuauuauucaacuuuaguugaaauuaaucaaugcaacuuuacucccccuagaggaaaguguuaaaaguuuacaagaaacauuuuuuuuaccauauuuuaaucacauuuuuguccucuaaagaauaaauguaccuagaguagauucuucuguucauuguuagaaguuauauuuaaugaaauauuuuauaaaauuugagguugcuacgaaugccaaaacuauuguuuuuagaaaaugugggaaguggccagacaccguggcucacgccuguaaucccagcacuuugggaggcuuaggugggcagaucacaaguucaggaguucgagaccaaccuggucaacauggugaaaccccgucucuacaaaaauuuaaagauuagcugggcgugguggugggcgccuauagucccagcuacuugggaggcugaggcaggagaaucacuugaaccugggaggcggagguugcagugagcugagaucgcaccauugcacuccagccugaguaacagagcaagacuccgucucaaaaaacaaaaugugggaaguauaugaguccuuaaaaauacacuagaaauacugcaauauaaacaagcaaacugaucucuaucuggguuuaaucuuuuaguguuacuucuccucuugaagucugauuauauaaagguuuaguguuucauuaauuuuguugccaucauuaacucaacuguucuguuuuggggcugggcgcagugguucacaccuguaaucccagcacuuugggagguagaggccgguggaucaccugaggucaggaguuagagaccagccuggccaacauggugaaaccccgucucuacuaaaaauaaaaaaauuagccaggcaugguggcaggugccuguaguccgagcuacucaggaggcugagugcuucaguuuuguaauauuugcuuuaucuggaaaaaaaaaaaaaguuaaauggguccuuuggagaaaugcuggauuaaaauaucagaaaaguaacuaaaucagauauuaaacguuaaauauguaaggaagagucuuuuuugggauaagacuagcacuauauggucuuucaaagagauucaaaucucagcugucauauucuuuuuuaaugaucauaaguuggacaaugauuacuaugaacaaguugauauccauuugucuuuuagcauuaguauauugcagcuguguagacugacaacuaaguacuuuugcugacauguuuuaguauauuuuugaacauagguugacuaauacuuguuacagaaaguucucaacuuguacaguuucauaaccauguaacuucuuaugauaucuguucaguguauaugcuaacuaauuuuaagauagaauuuuagugucuuagaguuguguguauaaauauauuagcugugcacagaucuauauauuccauuuauaaaacaugauaaauauauucaccaauuuuuauuuuuagugucauuaaaauuguguguguauauagagauauauauacaacuuuauauacacacauuuuauuuauuaaaugugaucuauauauuuacuaauuuuuuuuuuuuuuauagagucauuugcccuggcuccauaguucccacccaggauuagaaaaaauaagugcuauaguaugggaagguaaugauuguaagaaagcagacaugucuguacuugaaaucaguggaaugauaaugaacagagugaguuuuuaaauuuuauucuuguaguucaaggguaagacuuaguaauuauauauaagauaauuacuggaauauuauauuaguaaccuucugaccucauuucuucacccugaaaaaaaaguuacauguguguauuuguuucugucuguaauuuaaacagugauuugucaccaaaccacucucaucuucuaguguuuucacuuaucugaccaagaauagaugauacggucuauaauuuuucucuuuuaucuuuuucuuucuuuugaaauucaggagcuuguuagauauauacagguguuaauaaagacuuuucuuuggacuagagauuguuguuacaagaacuuuaaaaauaaaaaaauaauuaaaaagacuuauuuuucuguaucauucuuacugguucauuuguuuaauaggacuuaagacaugaaaaaaucaaacuaguaaauuugcauucauacuugcuuaccuacuuaaauauauagaaguaaugcagauagugguaaaagucuugaguaguucaaagaagucuaauugaaauacuguggauuaaaauuuuauuuucuauuauuucuuuuuucagauaauuacugauuuuuaaaauguguugauuggccgggcgcgguggcucacgccuguaaucccagcacuuugggaggcugaggcgggcggaucacaaggucaggagaucgagaccauccuggcuaacauggugaaaccccgucucuacuaaaaauacaaaaaaauuagccaggcguggugaaacccugucucuacuaaaaauacaaaaaauuagccgggcgugguggcgggcgccuguagucccagcuacucgggaggcugaggcaggagaauggcauuaaccugggaggcggagcuugcagugagccaagaucacgccacugcacuccagccugggcgacagagcgagacuccgucucaaaaaauaaauaaauaaaaauaaaauaaaauaaaauguguugauuucucuggacuuguuuuuaacuugcaauuucuaaauuucuuuggugcauuauugugcuugaacucuucuccacacuuuguguaagacaggaauuauaauaacugggucuagaaauugauaauacucccuauaacauaucucagugugagcaauuaaaagcaguugacggggaagucucuggaaucuuggaucuaguuugugcucuguaacuuaauuaccugugaauuggcagaucacuuaacuuacaauggucucauuuaucuaauauauauuauaaaaaguuggcuacaugauaguuaagaucucuuuuaguucugccagucuagcauacuggaagcuuuuauauugucccauuaucuaauuuccuuuuuuaaaauaauucccucaccuuuuucccuuucuguuuaauuucuucuuccuucuaucaucucucuucuaaaaugcuuuuagaguuuaaggagacacuuauuuauauauuggacuauucaaagagaaauguaagcggcuggguguguuggcuuaugccuguaaucucaacacuuugggagcuagaggagggaugaucgcuugagcccaggaguuaaagaccagccugagcaacauagugaaacccugucuuuacaucucuacaaaacccaaaaaauuagcugggggcggugguguauaccuguagucccagcuacuaggaaugcugaguugggagggaucacuugagcccauuauugugccacuguacuccagccugggcaauagagugagacccugucucaaaaaaaaaaaaaaaaaaagaaaacagaaagaaaaccucaaguuacaaauguacaaacguaugaaauaaguguaaugcugaguuuuuucuucaaugaacugaauuucaguggauaugagaucucauucucuuuaauauugcaguauuuaugaauauuucuaacuugaaauaaugaaauacauaaauuuuuuucaagaucuggaugacaguccuuuugccaucuacuuaguaaauuagcgaucugauaauuguuuuuaagaucugaagaauuaaugacauuuuauauguaguaggcucucaaacuugaaugggauucaaauuacucagaaugaguauauuuuaacaaaugauuucauauugcuauaaauaauucuacuguagauaaaauuuaugguauaauuuuauuuuucuuuucucucucuuccccuggcucccucaaggugaacagccauauaccaggaauaggauaccagauuuuuggaaaugcagucucucucauacuggguuuaacuccauuuguuuuccgacuuucucaagcuacagacuuggaacaacucacagcacauucugcuucagaacuuuaugugauugcauuugguucuaaugaagaugucauaguucuuucuaugguuauaauaaguuuugugguucgcgugucucuuguguggauuuucuuuuuuuugcucuguguagcagaaagaacuuauaaacagguggguauaauguagacuuccgaauaagaauauuuuaucguuuucauaauauuaaaaguauuccugaaguacuuuauuauuucauuauaucauuuuuaccuaauuauuuuuuauuuugcuuuuauaguaccuaaccaaauaaaaucuuaacaauucauauuuuguuaauuuuguuuuucugugguaaucuacuugaaaauuaauccucaucuuaaucuuuuuuagcgauuacuuuuugcaaaacucuuuggacauuuaacaucugcaaggagggcucgaaaaucugagguuccucauuuccgguugaagaaaguacagaauauaaaaauguggcuaucucuccguuccuaucuuaagguagaaugggagugauaaaaguagcuuuaacaugcuggcccuuucugauaguuccaguuucuuuaucaauauauauuugucucuagauguauaguaaccagcuuuuacucauucaaaaacuggauuagggauuuuguuucuacuagccugguugucacaagccagcagagggagcccacuacuuaaaaaagaauuuaaaaaaaauaaccaaugaguuuccucacagaagugaccuauuacuauuuuaaaauauuaguuugcaauucagugucauucuuuucaugucauuauuuuccuuuaaucuuuugaguaauuuuccuaauuauggaaguaugauauaaaaacucuggagggaagagggaaacaucuaaauugguuuuaggaaaacacuuuuuuucugaggauuacuucuuguuauugcauuaaguagcaguagaaugucauuauauauggaguaaucaugcaaauuccaaugauauuuauucacagcacugucuguaucuuaguaaaguugaccugaagaccaaucauccucugacauaccuagaucuuuaaugcuuuauauuuugaaauaauaaucaaagaagcccuaauaauaauaaugcccuauuucucuacucuuauauuuaaaaaauucauuguucuguuuauuaauuuaacuuguuaaauuuagcuuacuuagugucacugcugcaaauuggcauggauauuuuuuuccuaugacauaucuguuguauggagggaugaaucugaucgcuugaauucguccaaaauuuccuccauugucaacccuaagcagguguuacauucuuuuguacauugauuauuuuauuccguaaacacuuauuuauguuaaccaugugccauucauuguugaugagaugaaagccccuacccucauacguaagcuuauacuucagugagggaauguaagcccagaccuaggaauuauccuaguuuaaucucuagucuccaauuuaucaccaauuccuaucuuuucugcucccaaaauauaucuugaauccauuugcuucucuuuguuccauuucugccacccucauugaaaccaucaaucaucuucuaccucaugcuacuucaguuaccucuuaccuggcauuccagcauucacauuucuucuuuucauuccuuucuucagucugccaccagugaucauuuaaaaauguauauuuggcccuauauucuuaaaacuuuuuggagguucuucauuucucuuaagauaaagcacaaaaucuuaacaagguuuauaaugcccuuuaugaucuaaguucucccuuauucaccugucuuuuguuucauuuugaaacacucuccuuccuaguccacuacauuccaaccauuuuagacugcuuccguucuuuacaugagcugugaucuguccugcuuuauguucuugcacaugcccuuccuucuaccuagaacacugcugugugccaucaugccccugccccucccccuuaguuugguguaaauaucacuuccuuagggagaucuucacaggcccgcacuccuaacccucaaaucuaaaugaagucucccugccaaguaucucaaagcauccuaugucuuucccuuuuagcacucaucacaauuuaucacauauaucugugauuauuaacuugaugucucacuccccuccuaguuccugugaagguagagggaccauguguuguucucuguuguauuuguagcacccagcacaguaucuagugcuaagcaggugcuuaagaaauauuugucgaauaaaugacuuguguuugacaaaaugaaguauuugaaaguuauaccaauaauuuuaugcuauauaaauauagauacccuuuuaacucuguugcaauuccucaggaaaucauaacacuaucauuaaaauuugccuaacaaauuagguauauucaacauugugggcugugaucaacugauggugaugagucaacaccuuuauugaaaccauggaaauuaucugcugauuaguaaauauauuuuaaaauguuuccuuuucucccuuccacccacacccugcagcgucgagguccucagcgaucaguugauguaauaguuucaucugcuuucuuauugacuaucucaguuguauuuaucuguugugcccaggugaguuaacucgcuccauguagaaauuaaccagauauauaaauauuaacuuucagauuaauaaauaaucaaauaauaauauaaguaagccuaguuagaaaguaaguuuugaaguuaccuuuuugcaguuuuuuugguagaauaaauaagugcaucuuaucucugugccaugaacagugagcauguaugcucaaaugucuguugaaugaacacagauuaauuaauuuuugccuagaauccuucucauuaucuuuacuucccaaaagaaacguaugaguuaugaaauugucccaugaauauccaauuuauucauguuuacuauucuuuucuuucuuucuuucuuucuuuuuuuugagauggagucucgcucugucgcgcaggcggagugcaguggcgcgaucucggcucacugcaaccuccgccucccggguucacgccauucuccugccucagccuccugaguagcugggacuacaggugcccaccaccacacccggcuaauuuauuuuuuguauuuuuuuuaguagagacgggguuucaccguguuagccaggauggucucaaucuccugaccucgugaucugcccgccucggccucccaaagugcugggauuacaggcgugagccacagcgcccgaccuauucuuucauuuuuuauaccugaauuguuacugugacuuaacugcugcauacucugaaaaagaauuuuuagugacccagcuuaguuagggaguacaaaaguaucucaggauaugcacugcuauaaugcaggggaacauguucucagggucuccugaggguugugucaugggccguguaauauuaaaaaauaaguuuaaacguauuaaaauuuuaaaaacaaaaauaauaaaauauaugcaaaccuccauuccaaguaguaugauguacuagauuaucugaaaauucuucuacuuuaaaacaucaaacaggccgggcacaguggcucacaccuguaaucccagcccuuugggaggccaaggagugcggaucaccugaggucaggaguucgagaccagcccgaccaacaugguaaaaccucgucucuauuaaaaauacaaaaauuagccgggcauggugguaggcgccuguaaucccagcuauucaggaggcugaggcaugagaauugcuugaacccagaaggcggagauugcaccacugcacuccagccugggggauacagcaagacucugucuccaaaaacaaacaaauaaaaaaaaaaaucaaacaaugcucgggggaacccucagcuuuugaauguacauauuguguacauaucugaguucauaagauaauaaagggccaaaaaugaagacaaaacugaaaaccagagcauuuaagaauaagcauuaaugcuauggcagcaugagaauaagagagugaaguacauugccaguauuaguauuguaucccagagacuugaaauuuuaugcccacguaggacaggagaugaggccuugaccuguguaccucccuacucacaccaugaagucaaacccucaaagaucuacagccucagugaaaaguuggauaagaaaaacagucugcucaccagcacuggacgacaagaaggaagcuuaucugacucuggaugacaaggacgggggaaaagucucuucuaagaauauauaauuauaacucuucccuuacuacagguuuaggguucauauugacauuauacaucuuguccuguaacccucaugucaaaaaguuaauauaaaaagugguccuaggccccuggauaccugacagaagcaaaaccaaggcuguuuggaggcaugcgacuucagccuagaccucacgggaaccacagauaaagcuccuuccgguaucaaaacauaggaagaaacagucuaacaugaaggagucaacagauaaacccauagcaggauuagaucuccagcuauuucaguuugaucagguggaaacuaaguuuguuuacagugaugaaagacauagauaacacugugaaaaaagaacagauaaguuugaaaaagaacuucagacaaaugaaaaauacaguuauugacuuuugacuuguuuuuugcuuuucacugcuggaacaaagucacugacuuuuaaaacacaaugaacagaauaaauagcaaauuaaagaaagcuaaagacauagugaacugggaggugaaagaaaugacuaaaauacaggacagagauaaagagacagaaaaugcaaaauggauauuuagacaucgugggagauccaacauaggucuaauaagaauuacaggaggaggcugggugugguggcccacgccuguaaucccagcauuuugggaggcugaggcagucagagcacuugaggucaggaguucgcaagcagccuggccaauauggugaaaccucucucuacugaaaauacaaaauuaacugggcaugguggcucgcgccuguaaucgcagcugcucgggaggaugaggcaggagaaucgcuugaaccugggaggcagaaguugcagugagccaaggucacgccacuguacuucagccugggcaacagaaagagacugucuccaaaaggaaaaagaauuccaggaagaaagaaugcugaaaaacaacauuuggagaaauaauggcuaagaauuuuucugaauugaugacuuuuuuuuucagauacaaggaaguuuauaaaacuuucccauguauuaggcaauaaaguaaaaacuaauaccaaaugucugauacuauacagaccacaauaucuggcugucguauagucaaaguagaaaagaaugauagcaacaaaaaaaucuuauauauuuggagauuuaaaaccauacaaauaauacauucuuuaaaagaaagagcacacuauuaaacuguaaacaguuuaauacuggcacaauugagaauuuuuuuuaagauacuaguaugaagugcuuuaugucauuaaaguugaaggcaucaguggccaauuuuauagaaaugcauaaucuauuaaaacggacucaaaaaguaauugaaaaccugaagagaucuguaacuguaaguaguuuaaaauuuuaguaguuuaaaauaugccaccaacaaaaauccuccauacccguaugguuuuacagaugaauuuugucaaauauuuaaauagauaauccuaaacuuacacaaaagaucuagucaauaggaaaaggggauauucuucaacucauuuugugaggcuaauauaaccuugaugccaguaccauagagcuaguaugaaaaugggaaacugagcugguuucauuuauuagauacaaaauuccucaacaaaauacuaagaagaugaagccagaaagugaauuacaguaaauaggccaugacuaugauaguuugugccuggaaugcagauuucaacuuuagaaaauccauuaaugcaauuuaagcugauuaaaggcagaaaacaugcaaucauaucaauagaugcagaaaacaauuuguaaauuuucagugggcauucaugauacaaggacuaggaaguauuguccuuaaucugauaaaguauaucuuuuaaaauuuggagcaagcauuauacauaaugauaucaccuuaagaguuauuuacuuuaaaauugggaauaagacaguuaucugcuuuaccacuucuagucagcauuugauggaggguauuaaucagcaaagauggaaaaaaaaguggucuaaaguuuggggaaaaacaaucguaaacuauaugauuguuuauauagaauauccaagcgacuuuacagacacauuauuuaaaauagauuuguuauaugaagauuaacaaaaauagauacaacaacauuuuaaaaauuaauuuuguuucuauaaaccagagaucagcaaacuuccucuguaaagggccagauaaauauuuuagacuuuugccugacacauacaaucucugaaauacauucuuuuucuucuuccuuugaaguaauauaaaaauuuccuuuagcuauggggcgagacagacagaggccuaaagcuagauuuggccaguggaccauaauuuguugacaucuguuauauacagaaauagauaauugaaaacuguaaauacuggccagggacagugacucaugguuauaaucuuagcacuuuggaaggccaagguggauggaucccuugagcccaggaguucaagaccagccugggcaacauggugagaccuggucucuacaaaaaaaaaaaaaaagccagacauggugacacaugccugugaucccagcuacuugggaagcugaggugagaagaucacccgagccuugggaggucaaggcugcaguaagccaugauugugccacugcacuccagccuggaguaacagagugagacccugucuuuaaaaacaacaacaacaaacgcauauguuauuuucaauagcaacaacaacaacaacaacaaaagauucccgagaauaauucuaacaaaagauauguaggaccuuauggagaaacaggauaaaacuuuauugaaaauuuuaaaagaagguacacaaugaggcugagcgcgguggcucacgccuauaaucccagcacuuugggaggccuacgugggcggaucaccugaggucaggaguucaagaccagccuggccaccauggcaaaacccuaucucuacugaaaaauacaaaaauuagcccgucgcggugguccaugccuguaaucccagcuacuugggaggcugaggcaggagaaccacuugaacucgggaggcagagguugcggugagccaagauaacgccacugcacuccagccugggcgacagagugagacucagucucaaaaaaaauuaaaaaaagaagguauacaauguuagucacaauguuaauaggugggaaggcucaauuucaauuucauauugauucuccugggggaauuguuggaaucccuuguaauuaaacagaaugcuuuguuuauuuaaaaaaauaaguaacucaucaagcucccuaaaacucaucuggaagcacagaaagacaagaguaguccagauaauuuugaagaacaaguugcuguaccagaaauaugaagauuuauuuucuuuuuucuuuuuucuuucuuuuuuuuuuuuuuuuuugagacagagucuuugcucugucggccaggcuggagugcaguggcacgaucucagcucacuguagccucugccuccccggcucaagcaauucuccugccucagccuccugaguagcugggauuacaggagugugccaccacgcccggcuaauuuuuguauuuuuaguagagacggggguuucaccauguuggccaggcuggucuugaacuccugaccucagguagugcaccugccuuggccucccaaauugcugggauuacaggcgugagccacuaugccuggccuaauuuuucuuuuuguuuuucuuuuuuaaauuucucuuagaaccuucagaugagagacuuauuuuaaaauuacagaaagacuuuaugauuuuugcccagguauagaaugaccaaugggaugaaauagaguuguaaauagccauauauauguagaaaccuaauauaugaucagauggcauuauauaucaaugugggaaggcuuuacauaauggaaauaugagguaaaaauggagcaaaaccaaaugacuucaugcuauacauaaaaauaaauucuagguggauuaaagaucuaaauaugaaaaaauuuuuaauaugaucacaaaugaaaauuaaaauuuuguguccugcaaagacaccauaaacaacaaaccagaaucugggaaagauaguggcaaaaugacuuaaauaggauuguuagucacauuauagaacuaaguucuacaaaucaauaggaaaaacgaacaacauacuagaaaaaaaguggauguagaauauaaaaagauaacucacaggaggaaauucaauuaccaauaagcauaugaaacauacugauccucccuaaauaucaggaaaaguaaaauuaaggcaaugagagaacacgucacgcccauuagauuagcagguauuaggaaguuagauaauaacaaguaugaaugaaaaugauggcaaagggaacucugauacacugcugagaguauaaauuggugcaacuauuucagagacuaacuuacaauaucuaauauaguugaagauguaauauccaagaacccagugauuuggcucccagauauuaacuucuggagaaaguuuugcaugugcguacaaggaaacacauacaagaauguguauugcagcauugcuuguaauaauggaaauuggcaacaaaauauuaaugauaggguugaccaauaaguugugguugauuguuuuacuggccaauaaauuguggcugauuuuuuuacuuuaacauaggaguuagaaugaauaaauuuagagcuaaaucuaucaucaugaaucaaccuugaaaacaacauucaguggaauaaaaagaaauuaaagaaugauguagauaauguaacauuuauauaaacuuuuuccuuuuuuuuuccaacucccaagugcuuagaaaauaaauuuuaaaauauacaaaaaauuauauaguucaaggauguauauguagcuaaacuauaaaaaccauuauggaaaagauaaacauaaaauucauuacuucuggggugggaaggggaagaaaaaugagauggcaaaguuuaaagugauuucaacugaaucuguaauauuauuuuuuaaucugaaagagauguugcaaaauauuaagauuugacaaaacuggguagaggccccauggauauuaauuaccuuauacucuauacuuuugauaugcuuaaaauauuucauaauuaauguagaauguuucuaaaauguaauacuaaauuuaugaacaaucuauguuuauuucuuuugaaaagaaauuguuugaaucacauugcugcuuuauguuaccuuuuucauacuuuuagcuacuucauguacacgagaucuuccuugauugucacuacaauugggaauugguaaucuggugcaucucguuaacacuuuuucuccuaagauuuguuacccuuggaucagaaacaaguaaaaaauauaguaauaccucaauauuacuuacugaacaggugagugugccuacuuauuaugcuacaaauuaaugucuauaaguuaaaauguuuucauuuccuuuauguuuuucaagaauguguucuauuugauuaaggucauuugugcuauaaagcaaaauguaaaauuuaauaggacacaagccuuucuucaguguuccugccuugacucauauuucaaauccaaucugcuuuuuuaaugucccauuuuuauuugacaagaaggaaguaccauuuguuaaauuaauguauuuuaaacuaugaaugggacauguuugcuuugcaguguagcagagccgcauuugaguaaguauacauuuuuacucaguagaaagaauaaaguauaauugguuaauuuuauuuuguaugaauuuguuaaauauuuuccucccgccacuuuauaggaauuuuguaaagaaacuuauucucaugaauauuuuaguuagggauaguuugauuuuaaacaaucaauaaaccugucaaaugagcucaaacaggagaguaacccacaaagauaaagaucccugagaaaguauacuugagcccgccaggcacgguggcucauaccuguaaucucagcacuuugggaggguaaggcagguggauuacuugaggucaggaguucaagaccagccuggccaacaaggugaaaccccaucccuacaaaaaauacaaaaauuagccagguaugguggugcgugccuguaaucccagcuacuuguuaggcugaggcaggagaaucguuugaaccccggagguugcagugagcugagauugugccacugcacuccagccuaggcaacagagugagacuccaacucaaaaaaaaguauacuugagccuuaugaaauuggacaaaaucaaccacuuccuccaacucgcucugaggcuaaugguuucucauuuccacccuucuaaucaccuuucuuucuguggccuuucuguagacuuguuacccuaugauuuugguuuacacacgguuuugguuuggcuuagcacgaguucuggcuuagacuuuuacuaacuuuucaguucauguuccuacaauaucugauagauauaucauguuagucucaccagucaguauauugacuagcuuugguuuggguguacauuccagccuaaucagcgauggcugccagauuggggguaaaggugagaucaaauggggauaagcacaguugccuaggcuugcuucuuccacuggcuugggguuagagcauuuuucaaagaaaggaacuguggauaccccaaaauuaucuauuauagaguggauaauaaaaauacacaaauauuuuugagugacuuucaaauaaaucauaaaacaacaaggcauugugacugccuauaaucccaacacuuugggaggcugagaugagaggaucacuugaauccaggauuucaauaccagccugggcaacauagcaagaccccaucucuaguaaaaaagaaagaaagaaaaauuauaaacuauugguuuaguuuauucuaauuauuauuuauuuuuuagguugauuuggcuccgauaauaaagugucucaccuuuuaaauaaugccauccagucuuuuuuauuuuggcuuuugauuacauuucaaaaguguuugagaaacaguuauuauuuuccuauuauaaaauaaguauaggaaauuuggaauauauaguauaaagacuauuaaaaucaccuauaaucucaauaaccagauacuugagugaauaucuuucaaguccuuuaaaaauguguauuuauuauaauuugaagcauuucuauucuuuuuauaaaagauaaaccucuacuugaaaauggagaaaaaaccuaacaaaaaggaggaacugacacuagugaauaauguuuuaaaacuggcuacuaaacugcuaaagguaagaauagaacugaaaaugguuauaaugucaaauaugcuguucugacauaauuuuauuuuuuuguuuauagauauuacuuuguaugugguuuucaugauuauccaaguuguuuccaaauuauacuugugcacauacauacaauuuauauuuuacuucucauugcaaaagugcuugaacuaauccaaauaauuucuuuggaaauuguauauuaauaauaauaugucuggaguauuguagagguuggcaucuuuggaaauguaugccuccuacaccuuaaaauagauaucaaaaaagaaaauuuguuguuuacuugggaaguuuuuuauuuuguauuucucagagaagucuucugguuggccugaguuagcuuaaaaaguaauaauacauaauuaucauaauaaauaugugucauaaauaaacauuuaauuuuugauaacaaaaaggaauacaauuuugauguauuuuaucucauaguaacucuuuggggguaauuuaauaaaacauuuuuuaucacugcuuacaauauucauuauguuuuuaguucuuaaaaggaaaauauuuuuuaaaauuucaacuucuauaaccaauugaauauaauuguuagaguuauuuauguuuucagagaaugguaugaaauuaguuguguuucaguguuauaguuaauucuucagucaacuaaacagugugaauuggguauagacuaugcaccacauaguauugaaggguucagaagaaguggguggggggauaauaaaaagcaauuacagauugcuuucuuuuucaaaucccuuuaauuauccugaggaagaugaugacauuuaaauaacaagcaagauaauagaggcaaacuccauuuuugaccaaaaugcucaaugggaaaaaaauaucuugaauuaauaguuuuguguuugcuugacacauguauauugccuaucuucagaguguaggcacuguguaggaaggggcuacaaaggugagacucaaugagcagccacaaucucagagcaaaguauaaaaaugacuagaauaacaaagcauaauaguaugauucuuuuugaucauacauagucuccuagucagaaaucugggacuuaacauagaucguaccuucuuucucucucucuuuacagccaagaaauucucaaguccgcugauucagucuuuuaaauaucuuccaauucauccucuucucuauuaguacggcccuaugugagauccuugucucucacuuaugcuuuugauacacugaacuccuuacagauauucuugcuucugaucucauugcucccuagucuuucuucuacauugcuggcccaaugaucuuucuuccuuguacuugggcccuaacaaugcugagcaaccuguagcaauucagaugugucauguucucaugugucuuuuagaauauuuacuccccaccauccacaaaguuucaggagcaccuuccucuauggccccauuauuugcuuuuuauauguaccuuugaaaugggacuuucauauuuuaauuauuuguugcaugucuacuaaacuguaagguccuucaguucagggacugaaucuuaacuucccagagccuagcacagggcuuggcauaugauagaacuuuaaauguuugaauuaaccaauuaauuaauacauguauuugaaaaugaauugacucaaagaggaguuuuuacauguuauaaucuugucagaaaauuuggccaauuucuaauuguucuaccgaaagguauuguucucuuucgguuucuagucuaguucuuauauuaaaaaauguucucuagccucuuuauaauagcuuaagggacagaaauuggaguuacauauuuagucacagaguucuuuuaaaggaaguuccuuuuuccuuuaaaaccauuaaaacuauuauugaaauuuacuucuuucaaguuuaaccaaguuuauccuuucuaaaagcauccauaauugguaacuuuuuugaaaguguuuuuuaauucucauuguauauuguucugaauuagcuuaguaauucuuuuugaaucugggacugacuuuuuuuucucuucugcuaggaguuggacaguccuuuuagauuauaugggcuuacaaugaauccgcugcuuuauaacaucacccagguuguuauccugucagcuguuucugguguuaucagugacuugcuuggauuuaauuuaaagguaagagguugcaaguacuuuuuauuucuuaguuuccuguugcauuuuuguugcgcccauuuuacccucacaugcacaguaaugcggucauuuugguaagauugcaauuauugaacauuucacauuuaauuucaaagaauuauauguauuuauguuuuauaauacugcaggaauuucuaacuuggaacaguauuuauuauaaauagaagucuuguguaggauaaguagaaguauuugguuuuuuuuauuuuuuauuuugagauggagucugcucuguugcccaggcuggugugcaguugcgcgaccuuggcucacugcaaccucugccucccggguucaaggauuucuccugccucagccucccaaguagcugggacuacaggugugcaccaccacgccuggccaauuuuuguauuuuuaguagagacaguguuucaccauguuagccaggcuggucucgaacuccugaccucaagugauacacccaccuuggccucccagagugcugggauugcaggugugagccaccgcgccuagcaagaaguauuuauuuuuacuaauaaagcuuuaauuuaggugauaaaaaagaaaaaagccuuauuucuauuuuuggccaaaaguuguauuauuuaucuguauagcaaugcauacaucuuccaauauaugcacaacuaacuguuaggaagguguaagauaaucauauuaaacaaguacuguguauauauauauauauauauauauauauauauauagccacuucucaagagaaagcaauagaaaucugauuuucacauuuuuguuuguguuuaaggugaguucuucuuaaaaggauaaaggaguuaaaauauuagaaacugcacuuguuugugaaugaaauuugaauuuaaaaaugguguuauaugauauaauuuaagcuuugauauuaaaacuggcuugucaccacuucuauuuuuuuuuuucuagcuauggaagauuaagucaugacaauucaaagaaaagaagauguagccucuuuuccagaauaagaguacugacuaagcugccugaaagcuugucacugauucuuugcuucaggagucucagcuagggaguugaaguguuuacaucagacugucuugugcaauucuuauauuuauuuuacugguucacuuuuuuuuacauuuauuuuagucuuuauauuuuuauuuuuaagcauugauguacuuaguuguugaaagggugaugaaacugauauccagauacuugagauccugguaauuggucauaaauaauuggcaaaauaacaaauugugaaaauagaagccauugcucagcaccguuucuccaucaaugccgugaacuugccuuacuugaggaaaaauucuuuaacuuuggaauauugcauugaacucagcuauacacauaaaacauuuucuuugguaaaucaagauccagucaggguuucucuugaauuauuuuggaacaaugccaggauccaaacugauuaaguuacaguuuaagcacccuucaguauuaauauauacgguauuauauaacaggucaacaagugcucuuugaugauaaaacuuguaauagagcaauaauuguaaaugguuaccauacuguaagauauuuugauaaaaauuaacuaguaauacuuguauuuauuugaaacacugggcuguuugcacagcuccaacugugcaugcucaaaaugugcacuuuuuaaaauuguuacuuuuaaugcguaucuuuauaugggaucuguuauaguauacuagggcaugauaugguauccuuuugagugagguauauacucaucucacaagugaagugccuacugauauuacuaaaguacauuauguuuacucaaguaaauaauuuucuccccaugguacacucuaguguaggcuauucauaccacacugaaaugaacaacugaagaauaaggcuaagaaccaauaaaauauuucucuaauugcuaguuguaaaacuguauccaaauuuucagaaaagacagcuucagcuugcaaauucuauccucuaaacuuaucuggugcauucuccccaccccacccccauuauauaagggcuauuuuagaugcuuuuaaccuccccaacaaauaauuugccaaguguccaaugagaacuuaucauguugguguguuagguaaaucgggcaaauaugauagugucuuacauugggccuugauuuuaaguuguuauauuuguacaaucgaguauuuuagaaauuacaugaaacaugaaacaguuuuugcaauuuuuuuuaaacugggcaucugguuucuaaaaauuuauuugaaacaaucuagaauuuucuuggugcaaaguguaucauguggaauauccucauauuuuuaccauauuuuaagaacuuuaagacgauuaauuguaaauaauuuauuugauuggugcaguucuaaucccuaaaucauaaucuuaaaaucaggaauguguggagaacagagccaugucauaucacuuugcucuuaccauuccuuuugaucagccucaauucagccucauuguguaguauguuuuuucuuucuaugaaaaacaacagaaagcauuucauuuuauuugccuauguucaaauauguuuaauaaugaccaaagugcauucugaguuuuuucaaggaauguaauacuggagcuuuaagaacauacuuaguuucucaugugaaaacuuaggcuuugucugauguuuuuccuuccucuauugucuaauguugagguuguuuuuaggaauuauguuuuauaaacuuuuucaauauaagguacaugccuauacagaacuuaacauuuugcacagaauauaucaaauauauuuugagaaaaaaaguacggcaugaguucuguuaggaauaaaagaugaaacuauuguaucucacaaaaaaucuuauuucagaauggaaauauuuuugagaaaaguagcugaguauacugguuuaagaaaaugcuuguuuuagauugagguuaacuuagaguugggaguugauuuauuaaguacaguauaccucucaacaguuuauaaauaauauguugaauuaugucagugugggcagcaguagaauacuaaaaggaaaaugucauguuaagcaauuucagaacauuaacugaacuauuuucaaagcagaaaaauugacauugcugccuuuaagaauaccaugaauguaagaaauugaaagaaauuguaaaauaucacauaauauagaaauggcaguucaaagagaauuguggcagauguugugugugaacuguuguuucuuugccacauguguuguauuugaaaguuuuacaguaaguuuaaaauaaaacauucugugacugacgguguuuuuuuuuuuaauuuucaggucauauacauuucuaugguaauuuuguguuuacuuaacauaaaauuuaguuagauuuggggggagugaaaauaaauuuuuuauaacuuuccaacauuuuagauuuuguuaugauucuuagaacaugaaagaauaauacacagguuuuucaucaccaaaaugauauuauaucauuaauguuuguuugcuucuuuguuuuugaauacagcaaacuggcuguggccugaaauauuaaagcucauugugaaaagaua

SEQ ID NO: 191448 - RNA, 83378 nt, Homo sapiens
gaggaacuuaaauauuuacuagauuugaauuacguacauuugcacuacaauaccacacuaaauagauauaccagcagagaaucauuaucaaaugacuuaaaugaauugucaguuugucuuuacagacucaacagaaaacauauuuauuaauaugaacauaugaaccuuuauuaaguggcucacauuucaguauaaaucacacuaaaaagauauuuaaaagcuauuuacacuacagugcugacacauuuaaaaugaaaaaaaaggauauaaauaagcucuauggaaaagcuuuaaauuguugaaaaagaauucuggcucauauuacaaaauauauauauauauuuauauauauauauauauguuaaugucagcucuauucuaaaaccuaaaauuccaacguaaaugauuuuuuuuuaaagacuccuuuauguuuaaaccugcaauguuuacagugcaucuggcccuaagugcuuaauacuucacaguuauggacaggcacugaggaauguuacaaagcuacauaaacuauguuuuguaacagacauaggagcaaguccuuggcuugcuuucagaauucaugaaucuuuauuacauuaaauuuuuuuaaaaaaggauuuuagaugguauaugcaaauuuagcacaaaaugucaucgucuuuuuuaucuugauuugaaugugcugaacuguguugccuuguaucaacuagacuuagauuuccagggcacaauucuuccuuuaaaucuuuguugcuauuuucaaauuuagaauccaugucaaucuuaaauucugcaaauugaacaugauccaauuuugcuuuaacauucuugccauccauauuauucagugcuguagucuuuucaggaauauuaacauucacagguucuuccuugauucuuacagaugcaauagguucauguuuaaucugcuguaauucauauuuagaaugaaguuuaucugaaaaaacagaauccaaggaggcuuugcuuacagcacaaaucauguugucagugugagguccaagaacagaugauguggaaucugaugaugugccuguuucaugaguagcuguauucugagaaguguccuccucugagugauauaauuugagccgaauaugccaugcuaaacugcauacagcugaaacugucuugaacugaugaacaacauuccuuggaauaaaauaaaugucauuaucauauagcugaauccuggcauagcgaaugccuucccuccucaguugauucaguuuugcaucaucaacccauuggacacacuaaaaaauaauaaaacaagaaauacaaauaacucucuucauaauaaaaacuaaaccaaagacaguaaguguauuaaaaauaccugggacaguggagguucauguaaaucuaacugcauucguugaacuacuucuaagaaaucuucagcaugaaaacaaauuacaucuuugguuauacgggguugaucaggccuaaaaaagaaaacgagauaacaagaaucugccauaaaugcuucacucuuuugaguccuuauuaaacucaaagcaaaaauacuuuauggucaauaccauaguacugucuuacaaauaaaguuaaacuguuaauuggaaagccauuucacauauuuaaagaaagggccaacaccaugacuuucaaccuagacacagauuaaaaacugacuucguuuuuauauaaacauuugucacaagaguuuggaaaauugaaaugaucugaauugguaaauuauacaaaccaagaaaauuaaguguucuauuugaagaauaagaucaaugcuucauaaauuuaagugcuaaaguugaaaacacuacauaaaaauuagaaguaaauaugaggaaaagggaguauuuuauuuccauagaagauacauauaacuauacugaugcauaaaacucuuaaauaacuuuauaaauuaagagacuucauuggaaaaguacuaauacaauaaacuugguauuugcugagguuacucaugccuuuaaauauaauucuaaaaaacucucaaauucuucaauuaauuaggaauauauaaauacauuuuuaaagagaugcuaaaaaauggauuuuggaauaaaauuccaaacaacauaaagaaaaucauaugaaggcaaaucauaacuaaauuucuaaaaaccagugauaaaagagaaaaucugagaaucauguaauacauuauauacagagaaagaaggauaagacugaccauagacuuaucaaagacaaugcaagccugaagagaauggacuacuuuuaaaguauuagaagaaaaagucaaucuagaauucuauauccaccaaaaaauauccuccaaaaaaugugaaauaaaaacauguucaaauaaacaaaagcugaaucugucaccgagaaaacagcauaacaaagacugcuaaaggaauuucuucaggcugaaggaaaaugauacuuaaaugaaaauguagaucuaugaaaaggaauguacagcacaccuaaugauaaauaugaaagagguuuuauucucuuuaaauuuaaagaaaucucuuuagaaaugauucuuuaaagcaaaauaacauacaucaugggguuuauggcauauguaaaguaaaauacaugacaauuagcacaaaggccagaaaugugaggggggagggaauaaauggaaguauacuauugaaagguucuuacacauuacauaaagaagucucauauuauuugaagguagauugugguaaguugacaauacugaaauaaaaaaaaaacccacagagcuacaagcuacuaaccaaaucauggagguaaaauggaaugcuuaaaaaugacaagaaaaggggaaacaaaagaauaaagaauaaagaagcaaauuggaaaaagcaaaaugguaaauuuaaaaccaaauuuacuaauauuucuauuaaauauaaauaaucuaaauacuccaauuaaaagacagagauugucacuggauuaaaaaaaagguaagacccaacuauaugauaucuaucuacauguaacaauaauauagacauacagauaaguuaaaagaaaaagaaugggaaaagauagagcauguaaauacaaauaagaagaaggcugaauuggcuauauuaacaaaguuucaggacaaggaauauuaccaaggauaaaaagggcacuuuauaaugaaaaaaggggccaauucaucaagaauaacaauucuaaauguguacuugccuaagaacacagcuucaaacuauauggaauaaccuucaaaacacuacgcuaagugaaagaagcuaaucacaaaagaccacguuauuugauuccauuuauauuagauguuaagaauagacauauaccuacagacagaaaguaaauuagugcuugccuagggcuggcaggauggaagauggagaauuggggaggugaugucuaaaagguguaguuccuuucugaggugaugaaaauguucuaucguuuugguggugguugcauaacucugugaauauacuaaaaacuauucaacuguacacuuuaaaugggugaacuguaugauacgugaucauagcuugauaaagcugucacaaaaauagagcaaaaccuagaaaaacugacaggaaaaacaggcaaauccaauauuaaaguugcaaauuaacaagcagacaaaaauaagugagaauauaaaaaaagugaaccacauucacuaucaacaaaguugacuuaauugcucuuaauuuauagagcacuauaucccuaacaacagcaaaauacacuuuuuuuuuugagacggagucucacgucaaucgcccaggcuggagugcaguggugccaucuaagcucacugcaaccuucaccuccuagguucaagcgauucuugugccucagccuagcgaggagcugggauuacaggugugugccaccacgcccagcuaauuuuuguauuuuuaguacauaugggguuucaccauguugcccaggcuggucuggaacuccugaccucaggugauccgcccgccuuggccucccaaaaugcugagauuacaguugugagccaccgcgccuagccaaaauacacauuuuuuaaaguggacauauaaaaauucaucaagaugguccauaaaacaaaccccaagaaauuuagaagcacuaaaaucauacagaauauguucucugaccacaagaaauuaaauuagaaaugaaaaacaccaaaacaaaaaucuggaaaaaaauccucaaauauuggaaacuaaacaacacuucuugauaacccauggguuaaaaaagaaaucaaacaggaauuagagauauccugaacugaaaugaaaaugcaauagaaaaauuugugaaacacagcacgaucucggcucacugcaaccuccaccucccagguucaagcaauucuugugccucagccucccaaauagcuggcguuauaggcaugcaugcccagcuaauuuuuguauuuuuaggagaggcaagguuucaccauguuggccaggcuggucuugaacuccuaacuucaagugaucuacccaccucggccuccaaaagugcugggauuacuagcaugagccacugcaccuggccuguuucuccuuuuuuuaaaaaauuaaacugcucuaauaaggccaggugcaguguuucgcaccuguaauccuagcacuuugagcucccagccugggcaacagagcaagaccgugucucuacaaaaaauuuuaaaauaggccaacucuggacauacugccuaugaguuaguccugcucugcaaggaacaguaauacaaauaaacagaauguaaaaauaaauaaauauucacuggaugugguggugugugacuguaguccuagcuacucaggaggcugaggcaggaggcuugcuugaagauggguggucaaggcugcugugagccaugacagcaccacugaacuauagccugggcaacagagugaggcccuaucucuuaaagaaaaaaaaaauuuuuaauggcucuaauaagcaaaauagcauauuccaacucacauuucauacccaaacaauacucaauuuuggaaaacaaaaaucuaagcaagcaaaauuaucuuuuuuuguuguuguugguggugggacggaguuuugcucuugucgccccaggcugaagugcaguggcacgaucuuggcucacugcaaccucugccuccuggguucaagcacuucuccugccucagccuccugaguagcugggauuacaggcacgugccaccacggccagcuaauuuuuguguauguguguauuuuuaguagagaugggguuuuaccauguuggucaggcugguguugaacuccugaccucaugaucugcccaccucagccuccgaaagugcugggauuacaguugugagccaccgcaccuggccccagcuaauuuuuguauuuuuaauagagaugagguuucaccauguuguccaggcuggucucgaacuccugaccucaggugaucccacccaccucggccucccaaagugcuggaauuacaggcgugagccaucacaccuggccgcaaaauuacaauaacuuugcuuuauauguuuuaucaauuuaauaaauggaaagguauuuaauguaugagaugacaccucaaguauauuaaaaagaauaaucuauuuuuuaaucugucaaaauauucaaagugaaacuuguaagcaaagcuggaaaaaaaagaauacagaaaagcaaauacauaacaaagagaaaccaaaccucagaaaggguacagcaaagcaggaggaagagaaaacagaagaguauggaaucagauugaaaucagucucagcucuaccauuuauuaacuauaugacuguaaaaaaaauuauuugacagcccugagccucaguuuccuuaugugauaaauacggagcaaaaagcaguugagaaaaauuaaaugacauuuguaaacaggcauacaguaugcaccagguaagccuuagcuuuccuuuuaauuuuuuuuacaucuagucacuuagaacaugaaauuaauuauuucaguuaacccaaaugaugaaaccuagauuuuagcaauuuauuuguuuuuguuuuuguucgagauggagucuugcucugucacccaggcuggagugcaguggcgcgaucucggcucacugcacccucagccucccggguucaagcaauucuccugccucaggcuccugaauagcuaggacuacaggcgugcgccaccacgcccggcuaacuuuuguauuuuuaguacagacgggguuuccccauauuggcuaggcuggucuugaucuccugaccuugugauccacccaccucggccucccaaagugcugcgauuacaggugugagccaccccacccagccagauucuagcaauuuaaaaucuuuaguacaauuauacaauuaagauauccaaauacggguaaaaaaugaaacuuuuuucccacaguaaggaggaauuacuaagauuuuccaagaaaaauuguagaagccaagaaauucuuucauuaaaauagcgguaguuauauauaccacucuccacagugcacagccuucagcacuccaacagcagcuguagucugucguucaaaaccuuguccuauaugaucugcaugagcucuuguccugucuucaaagagcaucucacggggcucacuuguucgagguagguacugaagauuuuuuauuucauugguaguucuguuuuuuaaaaaaagaaaauuacauuuauauagugacacuuaauugcuaucaaacauucaauaaucacauaauucagacaaaaauauaugaaauuugcucucaaaucaaauucuaucuuuaaaaugaacacgaacaaacaaaaacacaaauacgauacccucauuuuucuaauauaccuucacaacaggaacaguuguaaggaaacacauggauaaaaaauuaaauuacaaaugguguuguuuacccaaguuucccuauacacagaaucuuuaccugggguuuggguaccaugcccccacucagaucucuuggguaacacaagauagauauauaucugaaacaaauggguaacuuuuaaaaaugcauuaauucaauauugauaggacacauacuaugugcuagguacuaucuaagaacuggggccagugaaugagacaauagcaaauaagacagaagaggaccccacucucgugggaguuuauagucugucuagugagggaagaaucaaaaaacagauuuagcaguaaacacccagcaguaagugcuuccacaaaacaugcaugcuuuauuggagguagaaaggaaaaccuuagcucugucuuggaagacagcuauuucccacuggcccucuccuccaccacuuuccuucuagaaugcauauacacgcagaaguugcugccuacuuagccucacucauugcagaaaccucuccaguuuugcuguaggcaaggaaaaggguaagaauuucuuuggcagagagucaucauuuuaucuuccucuacgguuuuuguuucuuccagaugcaacucuguauuacccccauaauugucuccucucauccuugucuaucuucccagggaucacucuuccuuacugguucucuacuuucccacccuuaaucucuauuauuuaacuacucuuugugcaccccugcauuacagucuuauuacacauauacauaauaauuuuuuuuugguucuuugugaauaauguucuacaugugucacaaugccagaugguguugcuuccucuggaaaccuaacagguucucaaacccacaaauuuagcugcauaaauaccacauucuaaugaauuaagacuguacagcacuugacacaaugccugacacuguuuuuguuagacuauuauuaucauauauaccauggguuguauacccugaagugaauggaaguuccucaagguaguggugaacccccuuaaaguacaucuaaaaguuuguauuuaucuguauuguucugagaagagacuuucagauucucaaaaugauccauacauucuaaaaaaaagaaaaaaaaauuaagaaucacugaggaggccgggcacaguggcucacgcuuguaauccuagcacuuugggaggccaaggcagguggaucaccugaggucaggaguuugagaccagccuggccaaaacggcgaaaucccgucucucuuaaaaauacaaaaaugagcugggaauggugguucacgccuuuaaucccagcuacugaggaggcugaggcaggagaaucacuugaacccaggaggcagagguugcagugagccgagauugugccacugcacuccagccugggugacagagcuagacucuaucucaaaaaaaaaaaaaaaagagucgcugaggaacacaucaauuuuaccauuuacuacuaacuuacaaauuaaccuguaaaauuuuauucauccaauauuaagcaccagacacuguguuuaggugcuagagaaacauuaguaacaaacccaacaaagucccugccaucaugcaacccagaguuuacucaaugacuuuuucccuguuuucuuuuuaacuuaauaaucaccguaaccaguaaacuuaauaaucacuguaacagcuaaaaccgucuuuagguaaucuaaaaagcuauaaucaggacgggcacaguggcucaugccuaggcacuuuggguggccgaggcaggaggaucacgagaucaagagaucaagaccauccuggccaacauggugaaacaccaucucuacugaaaauacaaaaauuagccgggugugguggcgugcgccuguagucccagcuacucgggaggcugaggcaggagaaucgcuugaaaccgggagguggagguugcagugagccgagauugcaccacugcacuccagccuggcgacagagcaagacucagucucaaaaacaaacaaacaaaacaaaacaaaaggcuauaaucucuccuagcaucaucuccauccauuccaauccacguuaaccuaauguacauuuucuccacacuuuucucugugcucacauaaguacacaaucacacauaguaggguuuuguuauuucuuuggauaaaaacaaaaucauauuagauacauuacucuacauuuggcuguuuucaaaugucaugaauauccauccagaucaagacauuuuuuaaaacuuuaacuauuucaccauuuuuuuuuuaagagauagguucugguucugucacccaggcuggagugcagugauguacucauagcuuacugcagccucaaacuccugggcucaagcagcccuugacucagccuuccgaguagcuagggcuacgggcauguaccaccacauuggcuaaauuuuuaaauuuauuuuguagaggcggcaucucacuauguugcucaggcugcuccugaacucuugggauucaaguuauccucccaccucggccacccaaagugcuaggauuacaugaaagagccacugcaccuggcguauuucacuauacucuuuuuuuugaaacagagucucgcucuaucggccaggcuggagugcagugaagcgaucuggguucacugcaaccucuaucucccaggcucaagcaauucuccugccucagccuccugaauagcugggauuacagucaugucccaccacgcugggcuaauuuguucuauuuuuaguagagacgggguuuccucauguuggccaggcugaucuucaaacuccugacuucagguaauccacccgccucagccucccaaagugcugggauuacaggcgugagccacugcacccggccuaacuauacucuucaauaagaauguaugaaaucuauucaaccauuccccuacugacaggcauucagaccauuuuaaaauguuuuucuuaccacaaauuuauuuaccuuucguguuuuuauuccuugggauucccaaaaguaggagugcuagaucaaagaguuuuauguuaaauuuuaugaucuacugccagauuacuuucacaaaauuacagcagcucauccuccagucaacaauauauaaaaaauuguuucuucacauaccuaccagccuauaauauuaaugcuauauucauaauuuuugccaauauaaugaauaaaaauaucucauaguucuuuuaaaauaaacuuaacuaccugagguuauuuuucuacuggguuguuuacacuugagaaugcucuuuguacauuaacuuuggugugucaugaguuccaaaugucuuaguccagucuaucauaauuuugaaccucauuguugaugucgcuucccccccaaauacuauugccacugcauuguuuggucuugcuuaggaaggucuccuccaggcuuaaacaauuuuauucuaauauuuuaacuguuuuaucugugaugcuuaauucucuaauuuacuucuuguaugagguaggggcucugccuuuguuuuuaugagagccaaauaugccagcauuauucauuaaauacaucuuccucuucccaccuaucucauauauuaaguucccaauauacuuagaucuauuucuggacucuuauuccaaugaucuauuugaacuuuauaguaauuuuuaauauccuguaucauaagcugccucucacuaaucuucucuuucacugaaaaguuuacuuccuuaugaauuuuaaaauaauuuuauccaggacuggaaguguuaguccaauugaaaugcagaaaauuuuaaagaacuaucauuuuuauccaauccagaacacagcagggcuuuccauuuguucugaucuuacuuuauauccuccacaaaacauuuuagucuucuuaguauagguucugaauauuacauuuauucuaaaauaguuuauaucuuaugacauuuuuuccauccaucauuacaauuucuugucauuugccuacauuucucaugcuuuauuuacauuuuagguuuuauaacaaauuguauuagcauguaucgcuauuuuuaaauuuauauuccaauuaugcucuaaacuuugcauuccuccuuccuccaauuuucaacuaacauacacaccccaacauacaaacacucauccccuccaauaaaaauguguauacaacauaccuuuuccuuuugaaaggugacuuuggcauaucagccacagggaucauuuguucuccuggacgaacccacaugaugggaccaucaucacuaucuuuucgacucuguaauuuuagacuagauagcgucccccauggcaguguacacuggagauaaauaauuaugcagauugcaauuauuuucaaaauguaucuucaaguguauguuaauaauaauauuguuccccugacaaacacacuuucauacacagcuuuauacuuaagcaucugaaauacauaauauugaauauaucccuauauauugauauacuuugcuucaaaaaacuguuucaaacacaccaagaaaauaauuaugcuuggaugguucugucccuauacccugcuagagguaugauucacuauauucaucauuuguuauucuuccuucuaccauauagaucauaugauguuaacggacuaaauaagcaagugcucucauaagaaucuauaaaaaugaacaauuaaauuuaaguuuaaaaacuggauaccucuuugauuaaugauaauuaaaaacaaaacaaaacaaaaucaaaacauauuucuguucagcaguuucuugaagagguuguuggcuuaaaccagagacuaaaguauuuuaaaaugaaagaacaaggcugggcgcgcaguggcucacgccuguaauccgagcacuuugggaggccgaggcgggcggaucacaaggucaagauaucaagauaucgagaccguccuggccagcacggugaaaccccgucucuacaaaauacaaaaauuagcugggcaugguggcgcgcaccuguagucccagcuacucaggagguugaggcaggagaaucgcuugaaccucggaggcggagguugcagugagccgaaaucacgccacugcacuccagccuggugacagaacgagacuccaaagaaugaaaggagagggaggggggagggagaaggggggagggagaaggggggagggggcagaggaagggaagggggagggagaagggggaggggggagaggaggggaagggggagggaaaaaggggggaggggaggggaggggaggcgaggcgagagacagaggugaaggggaaggggaagagaaaagagaagacgguggccgggcacgguggcucaggccuguaaucccaacacuucaggaggcugaggcaggcagaucaccugagcucaggaguuugagaccagacugggcaacauggagaaaccucaucucuacuaaagauacaaaaaauuagccuagcaugguagugugugucuguaaucccagcuacucgaaaggcugaggcaugagaauugcuugaaccugagaggcagagguugcagugagccgagaucgcaccacugcccuccagccuggaugacacagcgagacuccaucugaaaccaaaaacaaacaaacaaaaaaagacagagagagggaagaaggaaacugagggccacuguccauggaauguugagaacaaaauuaaaaaaaaaaaaaauuucaccacacacccccuuuucaaaaaggcuugucaaauuucuuuagaaacaaugcauuuagguuggguguggguggcucacgucuguaaucacagcacuuugggaggcugaagcaggaggacugcuugagcccaggacuucaaagcuagccugggcaacauagcaggaccccaucgaaagaaaggaagggaaagggaaagggaaggggaaggggaagggaaggggaaagggaaggggaaggggaagggaaggggaaagggaaggggaaggggaaggaaaggaaaggagaaauaaugcauuuaguucaugugcuuugaaaauuaaacuugaagcaaccauuuaaguaauauuugguaauuuuuaaauauaguccaauaauaaaugcaaccuaauuccaugauguaacuacuagagagaaguagaaaaggaacaaaaaguuuaaaaggaaaagagaaaaaggaauggaacaagguuaaagagaaagggaagaaaaagauauauguacauauaggguaaaaacaccaagcaaacagaaguaauaaaagaagagauguccuauagauuaugugguaucagaaaucuugucacauuccacagcuuaccuggacccugaauuucaguguagguuugcagcauugaccuuugaguuacugauuaaauaauuaaccuaaccacacagcucagagauuccucucucagugggauagcccuagcaccucacaauaagaaauacuuuuugaaaaucaagaggcuuuaaaaaaaaaaaaaaggaaucuggcuacaaacuauuuaaaggggccugugguggugggcacaguggcucacaccuguaaucccagcacuuuggaaggccaagacaggaggaucacuugaguccaagaguucaagaccagccugagcaacauggugaaaccccauuuccacaaaaaauacaaaaguuagcugggcaugauggcaugugccuguaauccgagguacuugggaggcugacgugggaggaucauccaagcccacggaggucagggcuccacauuacaccacuacacuccagccugggcagagagugaggcugucucaaaaaaauaaauuaaauagaggggccuuuggcuacauugucuaaacauguuauuuuauggaugaugaaacugaagcccagaaaguuuaaagggcuugcccaacccagauaaguacagccauggcuaaaauauggguguguaauuucccaggcgaguuuuccuggaauuuaguuuaggaaugcuaaacugccauuccuuugucuuaaacauuuguaguagaauccuuccuguacuucuuaaguccuuuaguacuuaguuuacaaagagcugauaaacacauggaaccuaauuuccuaaaguguuaagagguguuauuucauggcccaccacuuagcuuugccauuacaauuagaaccugagaugucgcauguacacacuacacaagaauuaugucaguuucccaucucuugcucuccuucccuccaguucaaauaaaaccaaaacguuucuauuucugaaacagccauucauuuauauugcauguagcaugaaagaaacaaucacaauuuagauuacucauauugguuuuucuucccuuuuuuaaaaaaaaaacucuaaucccaugacagauugucucuuacuuuuaaaaauggugacucuuccaacaugucaaggaacucagggaaauaaucuccuacuucuucaucaacugcucccaccaagcuuauuugucucauugggccagcucuguaaguaccaugagaauacguucuuuuuaccugaagaaacauggauuuaauuaaaaguuaaauacguucuuuuuaccugaagaauauggauuuaauuaaaaguuacacauaagauaaugcuugcuaucauuuuguagcaauaaauuauuaucucagaauauuauaucauaaugaggcaagcaaaacaaaacuuuacuaacaguaacagauaaggcauuuuaaaaauaaaacuugcacuaaaucaagcuauuuuacuuucucuaacuauuccuacacacugcuuaugaaaacagaguuaagacaaauaagcauuaauucuagacaacuaacaucuccuuagaacagaggaacucauuaucugaguauucaaaaguugguguaccugcauuuuucuaaagugaaaugaaguucauaucuuuucaucaacauuuucaaaauuagacccucugaaaacauuuaaccaucaacaguggcuuauaugacuaaaaggccaccagggaugcucuucuuuuuugaucuuaccauauuaacuagaaaccaguuuauauaccuauuauuaacucucaugagaaacuacuagaaauuaagaaucacagccgggcgcaguggcucacaccuguaaucccagcacuuugggaggccaaggcaggcggaucaugaggucaggagaucaagaccauccuggccaacauggugaaaccccgucucuacuaauaauacaaaaaaaucagccgagugugguggccggcgcgcgccuguagucccagcuacuugggaggcugaggcaggagaauggcgugaaccuggguggcggagcuugcaaugagccgagauugugccacugcacuccagccugggcgacagagcgagacuaugucucaaaaaaaaaaaaagaaagaaagaaauuaagaaucaggaauccuaaaauccaaaucugccuuugcuaucuaccaguuacaugaccuucagaaaucauuugcguuccuugagcugugguuuccuuaacuggaauguuuuacagcagauugcugaagaaaauuugauaaugauauaaacucaccugccauaaugcuagcaaauggguggcauucaaagagccaaaacaaagccaugugcaccucaagauugauugguaacuacauuucuugccagcauauuuaaauccugacaaagaaaccuauguguuuucauauacuaacacuaguaaacaagcugagucugucuucaagcgaaacaacucguuuugauaaccaaauuauaagcaaaacuguaauugucucuuucucuggauuagccuuuguggacaacaaauuuaggagaccaauuugucccaguuugcccaggacuaucagucuuaaaacugaaagucuuguauuucaggcaaacauggauggucaacuuuuaucacaucacagacacagauuauaaaagauagucacaucaaaaguugaauccuuacaaucauagcugguaagaguaucacaacguaacaaaguaaaccccaacccacauguuuucauacaaaaucauuuaaggaagagaaucucauuuguuauuauaaucagcaaagcaguuuaauaaugacauuaauucuuuaauaaauucaccagauuucuaagccuaaauuuuccuaaacuguuacaaauugacuucucagaaccacaaaccauuccuacaaguuagaaaauuaagggccuguaagcccagcacuuugagaagugggaggauaucuccagccuggcagguccaggcugcagugagcugucaucaggccacugcacuccagccugggcaacagagcgagauccugucucaaaaaaacaaacaaauauaagaacagcuggggcuuaugcccccauuguaugcucauugucucaucuuuuuccugucgccuaaaaauuccuaucaucuccaauaucaagagagcuaacaguuaaagccuaacucuacaacagucuucaggcucuagaugcauuaauagcagcacaguaagaaauucagucuaugcaccucuguaaugcagucuaucaaagaagcuaaggguaucaaucucaacucuagcacauuuaccagaauagaacacaucaagucuguuaagugauucugagauucugaguuuugugucugcaaaugaccauaagggguuuugagagacgauaaccauuuagaaagugaaaucaaacaacugauauuguaaaacacaaauuuuccaagugcuuugaaauauaucuaaaaagucaaauuagaguuagggguggugacacgaaacuguaaucccagcuacccagaaggcagaggcaagaggaucacuugagcccaggaguucaagaucugccugagcaacacagcgagaccaaaaaaaaaaaaaaaaaaaagucaaauuauauauauuuccaccucauacaaauaaguacauuuucugugcauaaauuuccuuaucuuguuuaaauuagauaccuacaacauuuaguucuaacaaagccauaaucaaguccuugccacugaguugguucauucuaugacaucacaguaccaacaaugaucaccuaaauaauuugggcaguuuaucuugugcggaggggaugacuguuaggaaagaauuuucauuaagugaauucuucuaaaauacgaagcacaacuaaacuuucaauuuaucuaguaguuuuaaaaagucauauuauacaugaaauaaaaccaaaaaacuauaacauuauuaaauuauagagaguaggagauaauauaauaaucagaaaaccggaaccaauuguuaacacaguccuuguagaguaaaauuuauguauuuaaaugugaguaaaaacauguaucauugaguaacaggaaaaaauuggguaaaacuugggugguaauauuacagacacaucauauguugugucaugacucaagaacuuuauuuacuaauuuugcuuugaccagauguugcuauuucagguuagaauaauuauuucauugacugaagaaguauuacugaccuagccaucucauuucuuucaaauuauacauuuacauuaauuuccaaguuuacaaauaaugcuuuuuauuucaaaauaaaacaaaacacgucuaaauuaguauagaccuaaacauuaaaauguuuaacauaauagacugaauaaaucaaaaaccgauuuuucccccauucucugucuaguuugggcacuaccuaagaagaggcuuuaucuuuugcugauuauuuuuaaguaugguccuauuaaaauucauaacuauuucaaaggauuuuuuagagacccugaauuuuuaaaguaaaguaauacagacucuacuccgauuauauugcuaaauaucuuaauugaauuuuuaguuaguucuucccaccucaugccaaaauacauauaaaacauauagauauguaaaauucacuuucacacauaacuuauuauaacaaaaguauaagucucucccuuguaaccagaauguacagguagaugccauuugcccacuaauaaaaccaaaaauaaauccuauuaggaaauuggccuuuauaaaaacugcuuagcucucacauguuuaaaacaaaacggcaaugaucuuccaaaaccuuuauucuccaacaguaaagauaaaaugaugaucacccaccugaauaaacauauuuaaacuuagaccaaauuuaaaaaauuaaauugaagucaucaaaaucuuaaucuguaaaaguauuaaauuuuaaaauauauuguaauauaaccuuuaacuauauaucauuucauacaaauuucuaguuuaauaacacaauauuucaaauccaucaguuguaaccauuaacuuaaauguuauaaacauggcaaguuacacacaacaauguuuccaauuuaaaaaguauauacugcuugauaaaauacaugaugguacuuaaguuguuaaaauaaaauguaagaauaaaauccacacgcuuuucacaaaaauguaaauacuucuugauuuuggugacaccucuuuuguugcaaaacuauauaccaaauaugcagaauucaccuauuacaaaaaaaucaagccucauuucucuaaaaaucaccuauccagacuaugccagacugcgaagaacucaagggcggugagguggaagagguaacagauaaggauuaaaagaaucucuaaauaaucacaguaaaugucacaaagaccauggcucauaaaaguucuucuucuuaccuaucaguuccuauauuaggcacaaucguaacuacucucuaaaaucauaaaggacaagaaaccacauauuuagaaggggaaggaaggaaaaaggguaagcacagcugcagcugcccuaaggcaucaguauuguaucauaaugacaaaccaauacugaaaauaaagugacauuauguugcauauguucagcaaugaagauauuuuuauaaaaucuuaauacuuaaaacuacguuuccauuaacuaaaaaaauagccuaucuggaaaaccucacauccugaugacgcucaaugugagcuuacuauauuugcuuuuauucacuccaguaaacauuaaucaaaccaguuuucugguguaguuaaaaaauuaaccugaaaaaaagucaaaacaugucacugcuuuaaaauauacgccaggcgucacgccuguaaucccagcauuuugggaggccaaggcgggaggaucauuugagaucaagaguuugauaccagccuggccaacaugacaaaaccccgucucuacuaaaaauacaaaaauuagccaggcaugguggcaggugccuguaaucccagcuacucaggaggcugagugaggcacgagaaugcuugaacccaggaggcggagguugcagccagcgagaucgcaccacugcacuccagccugggugauaaaagugaaacucagucucaaaaaauaaguuaacuaaauaaaaaauaauaauagaauauacuugcuuucuaaaaaaagaaaugcacugaauuacaaagauuauacauauaguuccucuugauuuagguauauagaugugucagaacacaauaaaagacaggcaugauaauuauguauuuguggaaaagcuuauauuuaaauaguggccuucagaagaaauauaacauauuuaaucuaaaucuccucccccuccccacaaaaccccaugaccaucauggccacauuuucacuuuuccccuuguauauucucuauaaauauuaugaagggaaaaaagaaagcagaaguaggagaccuauuguacccauugccaguaagugucaauaccaaaaucugagaagcuuugguuaacauaaaaugaaauaauuguuuaaacuaauauucgacuuauauaauguaaucuuuaaaaaaaacacuuuaggauucugaggugggcuugcuacaaagggaaaaaaguagccuauucuuaacaggaaauauguugccaaaaacaaaucuauaagauuuuuuacuuauugcuguuuucucuuauguaauuacgaaaacugcugcaagggggaaaaggcaaauauaguaauaacaaguaauuuuuuaaaaaaccccaaagaacgacucacuugaaacaaccugcuguuucccaaaacauguucccugaagagagagcucuacaguccacuaaguuuggaaaacccuucuuguuuaggaggcucaccacgcacacuggcuauuaaaguuucugaggagucucacugcaaacaaauauuacuuauuugguccagcauuacacuauuuuggacuucaaaaccuguuuuuuuuguacuuguuuuaguauaccuaucaacauuccaagauauuaaaaguuccucagaauaccuucauagugauccaccauaaauauggagauacagauauuuuuagcuuguaucagcaccaaugugaagaaaauacaaaaacaggaucauuauuagagccaaagaauugaggggggugggagcagaagcuguugauucaauucugcugagguuuuuuuuagcggguggggaggagagucccuuauuuuuaaaaacaaggccugcucaggacauucugaggcaaucuaaacaugucauaaaugacugugccacaagggggagccauuauccaucacuucuggcagaugguuucuaaucaaaauaggcaauauuuaaccaacauuuuauuucaaaaauacccauauaacggcaacuaaaauaagaacgaaaguauuauccauuuuaaaauuaguaaaauaaagggggaaagcuuuuugauuauuauuagagcaucuggucccugacacgauauuuuguauagaucaguucuuaaguauuuggggagcauggggcaggcacaauuggucaaaaugaaaauuuaguacaaaggcaagcaauguuucaaagaugaaacaucaaauugcuuuuaguagccuaacacagugaauggccccagcacaaauucaacaaaugcuaguguucugccccaacucuacagugaagcaggucuaacagucagaucagauuuaauaaguuucauuauuaaaauaauagacuuuuaaucaucaguuaacacuuugacauaaguuaccugagaaauaacuuagaaccacaauacaauaaaaauaagauuuagaguuuggaaguggaggaagggugguuagaaaacaacuacuccaguuuucacauucucacaguucuuaguacaggguuccagaguauguacacugauuaaacauagugacaagacagaaaucuaauuuauuucuugacagagaaaauuccuauuuuauuugccuuuuucuaucccuacgguagaacacaggagcacaauaaaugucugagugaauauuugaaugaaauacagaugcuagaaaaccuaaaacgaacguggucaacugcaaauggccccaaauucuucccaggccuguaugcucacuccugugcaaugugauuuugccacuccugucaucaagaaguggagucuauuaaugcgcacacacaaaaaaagaaagaaugaauaaagccuacgauuucacugcacaacagggugacuauagucaguaauaauugcacauuuuaacuaaaagaguguuguuaacuggauuguuuguaacucaaaggauaaaugcuuguggagauggacaccucauucuccaugaugcacuuauuucauauugcaugcuuguaucaagacaucuuauguaccccauaaauauauacaucuacuauguacccacaaauauuaaaaauuuaaaggauuuuuuaaauaggccgagcacuuugggaggccaagguggcacaugccuaaucccagcuauuugggugacugaggcacaagaaucacuugaaccugggaaguugcagugagccgagaucgcaccacugcacuccauccuggacaaugaccuguuaaaauauauauaauucacaacuucuaccaucauauaagaaaauacaaaacacauauaacauuacuauauauacucuuuuaucgauuaaaaacagugcuacuuaauuaccuagaggauagcauuaucaugaauuucuuucuuuuuuuuugagauggagucucacucugucguccaggcuggaguacagugagacucugucacaagaaaaaaaauuaaaguaaaaugaauaaauaaccuaaaagaaguggagucuauuuuuccacacgaaucuggguuucaccaugugacuucccuuugucaaugggacauuagcaaacacaacacaagcagaagcuuguacacuggggcuuacccucuuucuacucaauggaacccuguaaccaccaccaugcaaaugagcccaggcuaaccugugggaugaugagaaaaauguggccaucaacccagcuaacauacaucaaccaccaaccauauaagugaggugucccaagacccaacuggucugccaaucaucagacauaagaaugaagccauauagccccagcuaaguuagcagagaccacaagaacuguccagcaagcccaaagaacugugauaaaugaaaccuuuuuucaagucacuaaguuuugaggcuuuuguuuauacauuuaauacagcaaaagcuaacagauauggacagguuacaaacuuugggaaaaguccaugcauauguuucuauccucaaacggacuuucaugauacaguuuccuaauauaucacuaaccucagggccacagcauuagagaaaugacaugaccuguuaaaauauauauaauaccacauggucuucaaaccuuucaggcaaccugcaaggauacagaugaagauggaaaacagaauuauacaaguaaaaagaauuccaaaaccgaagacaaaagaacagggauguuuuaauccuuugucaguguuguguauauguguuuaauaaaguugaacagauguaaaaaugaguauuugugaaagcuacaagauacuauuacagagauaaacacuaucacuacaaaaaucauagaaacagcuacauaauuugucaucuuuuaguuucuacagaauuuaaagcaaauuauuuugguugcccugauuguaauuuaagaacaauaacaaaaacagaaaacuaggcucaugaggauacaaauucaucaugaacuugguuuggguuccacagcuauugguggucaguaccaucagguugcacaaccuagggacugccauucacaucacugaauggcugcagugcgcagcuucuaucauuauauaagaaaauacaaaacacauauagcauuacuauauauacucuuuuaucgauuaaaaauggugcuacuuaauuaccuagaggauggcauuaccaugaauuucuuccuuuucuuuugagacggagucucacucugucguccaggcuggaaguacaguggcgcaaucucggcucacugcacccuccgccuccuggauucaagcgauucuccugccucagccucccgaguagcugggacuacaggcgcccaccaccaugcccagcuaauuuuuguauuuuuuuuauuagaaacggaguuucaccauauuggccaggcuggucuggaacuccugaccuugugauccgcccagcucagccucccaaagugcugggauuacaggcaugagccaccacacccagcuauaaaugucuuuaaugcugcuaaauguauuuuccaaacuauauuauauucuaaaaaauaaaggucaggccgggguggcucaugccuguaaacccaagacuuugggaggccgaggcagguagaucaccugaagucaggaguucaagaccagccugggcaacauggugaaaccccaucucuacugaaaacacaaaaaauuagccagguguggugguacgcgucugcagucccagcuacucaggaaguugaggcaggagaaccgcuugaacccgggagacagagguuucagugaacugagaucaugccacuacacuccagccuggaugacagagcuagacucugucucaaaaaaaaaauaaaaaaauaaaagucagauuugcaccauuuuucucuaucaucuucacucuacucugucuucccacauuuuucuagaucuuuugaauacugcuuuuggacuaguuuuaacuagaucaaagauuuuucagaauauaaaaggcagaaaagggaauugaaggauaguuacugaauuacaaagaugucagguacagaacuuuucucuacaguucugcuuuccucugcucuguagaaagcauuaucaucucauaacaagagcagguucuacugaacugaaccuagugaacuuagucaagaugguccccaacucagaagguucaacucauaauuuuuugacuuuauuacggguuuaucagguugaaacuucauaguuaggucaagcggcaucaggacuuaagaugguucagcuuacuuacaauuuuuuuuuucagugggcuuaucagagguuguuuguuuuuuguuuuuguuuuguuuuugagacaagucucacucugucacccaagcuagagugcaauggcgcgaucucgguucacugcaaccuccgccuccagggcucaagugauucuuccugccucagccucccgagaagcugggauuacaggugcccaccaccaugcccagcuaauuuuuguauuuuuaguagagacggaguuucaccauguuagccaggcuggucucuuaacuccugaccucaggugauccgacugccucggccucccacagugcugagauuacaggggugagccaccacgcccagcugcuuaucagaguuuuaaaugcauuuucaacuuaaaaauauuuuugacuuacagguuuauuaggaugcagcccuagcguaaguugaggagcagcugaaguuacugaggaaucaucaugaccaaaucaacaaguuugauuccugagcaaacacuuuaacauuaauuuggcuuuauuauccacaauuuguuuuugcugugguuuauauuaaguaaaacuacauuccaauauugguaccucugcucuuccuuccccuagaauacugacucacauuagcucaauuaaugucgucucaaccaauucuuuuggugaaagcaauuucacacagcaguauguaggcugauccacuugacaccaccaaaauauacaguuucacuauauuuugugaauauauauauagugaauagauauucacuauauucuaauaacaagcauucauuaauggaaaacuaguuuuuucuaaauuucauaaaaccuaauuacuaaacuuuuguuuuuguuuuuugggguuuucuuugagacaggaucucacucugcugcccaggcuggagugcagugcugugauuuucuucauuuucaaagagacaugggccuugcuauguugcucaggcugggcucaaacuccuggguccuagugauccucuugccucagccuccugaauagugccauggcuaauuacuaaacuucugacauuccaaauaacuagcauaugcaugacaguaccacagauaagggaaagggggauguuggaagauaaauggaguacaaaauacuguuucaguuucucaggaugaauguuaaugucauauucuaagaagugcugaaaacuuccauguucucaaaaagggugauuaacaacaugaggucuugaauauacaggaauaaaucuuaaaaaucugcaagaccucuaugcugaaaaccaaaaaauauuacugacagaaaauaaaaagacaaaugaaggggaauaccaugaucacagaucggaagacucaauguuguaaaggcaucgauucuacccuaacuuaucuauagccuuaauguaauacuaagcaauauucuagcagauaacucuuugaaacuugaaaagcugauucgaaaguuuauguggaaauguaaagagccaaggaaaucuugaagaacaaagcuggcaaaccgauucuagauuauugagauuaaugauaaagcuaggcacaguggcucacaccuguagucccagcuacccaggaagcugaggugggaggaucacuugaggccaggaaucugagacuacaaagcacuaugaucguaccauugcacucuagccuggcugauagaacaagacccuguaucuaucaaucaaucaauagaaagaguuauuauaaagcuguaacaauuagacaaacaaaacaauggaaucaaagggagcccagaaacagacccacacacauaugauuagcugguuuaaggugacacuacaauacaaugaggaagggguaucuuuuccauaaaugaugcugggucuuuuggauauauuuauauggaaaaacauaaacccugaucuuuaccucaugccauauacaaagaucaauuccagaugaacuacagauuauuuuuccaauacuuuuagcugcuguuuuauuaacuauagauuuaaccaugaaagguaaaacaauaaaaguuuccagaagaaaacuucacagaauauauuaaugacuuugugguaggcaaagauuucuaaaacagaauguaagaaacaguuaucauaaauggauuauaaauuauaaauuagauuacauuaaacuuaggaacuucuaguuaccaaaaacaucuaugagugaaaagguaagacaccaagugagaggaaauauuugcaauacaguuagcugacaaaagauucuuaucuacauauauaauaguccaacaaaucaacuagaaaaaaagcaaauaagaaauugacagaguggacagguacuuuacaaaagaggauauucaacuggauaauaaucauauaaaaagguacuugacauccuuagucaucagggaaauacaaauuaaaccacagggagcuaccacuacauagucaccagaaugacuuaaaugaaaaagacacuacuaaccguggcaaaggaugugaaacacugccacugggaauguaaauaggcacauuuaacuuuggaacacuggcaguaccuagcaaaacugaauaggugcauauguuuugauccugaaauccuaaucuuagguauauacucaaaagaaacacauacauaugcucaucaagacaugugaaaaauauucauagcauccguguucuaccagccucaaacuggaaacaacucaaauguccauccauaugguaacaagaucaacaaacugugguauauuaacacugguauacuaacacaguggaauaccauacagcaguaccacuacacacaagauggaugaaucucacaaacguuauacuacagaaaagagaccagacacaacaauguacguacuaucugauuccaccuaaguucaaaaagaagcaaaauauaucagugauguucaaagucaggacagugaucaccuggguauuuguucauguggugggacugggggguuggcacaguacugauaaagaaggguucggggaugguuucuggcuauuaacaauauuuggcuuuuuaaaaucauggguguguucccugugaagauucaucaaguuauacauuuauaauauguauacuaugucauacauuacacuucaauaaaaaguuuacuaaauaaaaucaacuccuggagggacacuucaauguaggcugagagagcuuuaacugggaggacuccagggaugagaaauagaacugugcaagaagaagcaugcucauuuuucuccuacugcucucucuucuggaucccauucaguuucauaaagccagugccuaaggacaaaucaaaggcuaccuccccaaucugcacacaacaacuuccccacucacaggaauaagaucugaagaaucuugugauaaaaggaauacgggccuugcacauguacuuuccugccuuuaagucuaaagcuaaagaagcaaaaguagucccugcagcugacaugcuuaggucaccaggguagcagaucacacagauauggggccagaaccacaacugguaaaaaacaggauccaucugccuggaguuuccucuuugcaauauauauuacccaagaagcccgaagacauggugacaaccagaggagguggcucaucaaggacuugagauccacaucccaggcacacacugccaugauuaacaaguccagcaucucauuuuauuuaguaacaaaagcaguuuucaugguguacauauuagauaguuuagaugaaaauuuuuaucauuuaguauaaaauaauuccuaaacuuauuugaaaaaccaucugaaaagcauguaaugugaugcacaucaauguacugucacauuuaaaagguuacugaagcaaacuugcauaguaucaaagcaagaaaguuugugguauuguggaaauaaccgggaaugggagccaagaggcccaauagaaaaccggacauuuaggagacaugcaauaaacgacaaaugaaugauaaggugauaaggcacuuugaacauguuaucucuucucucacuggaucuguuucuucacugcuaaaguaagauuauaaugaggauuaaaugaguuacuacauauaaaauacucagaacaacuaguccuuggcacagucaguacucaauaaauaguaaacacuauuauuagaugccaguccugauucugccauuauauucagguguaaccucagacaaguaacucaccauuuuggguuucuauaaaaugacagggcuaguaauggaugcucuauagcucccuaucuaguuuagaaaauauuuaauuuucaauucucaaacauguuagagaauaauucccacauacgcacauuaaaaauuauuuuccaggccgggcgagguggcucacgccuguaauccccacacuuugggaggccaaggcaggcaggucacuugaggucaggaguucgagaccacccuggccaacauagcgaaacccugucucuaccaaaaauacaaaaauuagccaggcaugguggugcaugucuguaauuccagcuacuugggaggcugaaucaggagaaucgcuugaacccggaaggcagagguugcagugagccaaggucgcaccacugcacuccagucugacuccaucucaaaaaacaaaaaacaaaaaaacaccacauuauuuuccagacuacaaucuacuacagaauauacaccaaacauacucauacuauugggggcgggguacauguggaugugacugaacauccagacuaccauuuaaaguggaaacuauaacuugagcacccauccaaaaaggaacauauucagaauaaggaaaggagcccuggaugaagauuaagauuuuguucuaauccugacacugcugacaauguuaaacaauaccuuacuccucucucucuacgucuguuuacuuauuuguaaauugagagguguugggauaaauaaucacuaagauccauuugagacuuccuuuacuuuuucccuccuuccaaacuagaauguuguccuagaaaccaaaaaccguuccuagaaaaccaaaaacuacagcaucaauaaaugugagaacuggccaaucuccagacuaaacagucccaaucugaggaugggugauaauggcaccagccuuucagaugggcccacacugauguucaagacccagcagacucuauucugucugcuuuccagaauaauauauauucuccaccauagagaaggguaggaaaugaaaauuagcucaauauacugauugcuacuuuuaacacaucauuacacaguaacugaugauuccuucauaccacaauauuuuuaauggccaacauuucuucaguaccuaccaugugaugggccuggugcuaaguaccuuaaagcauccuaaagcuagaagacaauuuuaggugauuuccagguaagaaaacuauuuaaggacuggaaaauacauggcuaaauucauuuccuuagguucaagaccacuccuugcaaaaaaaaaaaaaaaaaaaaaaaaacacagaaucuuaauuauuucauuaauugucuuuaaaaaaaaacauacauaagugaaaauugaauuuuaaauucugaugcucacaucaagaaaguaauuuacucuuaauacucccaaaugguuucauuauauucuuaccuuuuuauuucagcccuauaauuaggaacaaaaaacagaaacucaucuaaaaauauauaauuaaaaguuauuuuauaaaacuaaaaaccucuuaccugagcaugaaaauuggacauagucguugucucuauaucuuucuuucccaauaucuccauuuucacuggugaauugggaaaauuaaaugaaaaauagucuaaaaagucagguaaauaaguagcugccccaugaacaauacccaucacguagaaagcugcagaguuuucauuuucacugaacacuagacccacaaacucuucugcaaaccucuccaucuccauaggagacaggugggagaguucguuacuguaggcauggauaaccgaugcaccuccauuaggcuggugcucuauaugaaugaguuguuuaaauuccaaaguguccaaccuuuugagguuauucugaacucguggcuccuuuaaugagacaaauggaaacucacuguucucuggaauuuuggaaucauaguucuugguauccaaauucuucccaacguaaucuuuuauguuaucauuuaggaugccuuuggcugcuugaucuucaacaucaguuagcaauccugagcagauggucugaauagauuugcuauacauuuucggacgcuuccguuuuucauucucuuuguguuucuuuuucuuuuucuucuuuaccuuuuuaauuuguaagucuucuauauuuguuuuugguuucuccuucccaccuguuggaaaaaauguuuuuugaaacuccauauuuuaauuacuuuaaaaaccaugcuuuaggaacaguuuugucuaaguaagaaguuuacuucugaaaauuuacucagaauuauauauuuaggacucauuuuuuacagaauugauaaucaauauuuagucagccuuuuuugagacagagucuugcucugucgcccaggcuggaauccagugccacaauccugucucacugcaaacuccaccuccuggguucaagcaauucuccugccucagucucccaaguagcugggauuacaggagcgcgucaccaugcccagcuaauucuuguguuuuuagaagagacaagguuucaccauguuggccaggcuggucucaaacuccugaccucgugaucugcccgcuucggccucccgaagugcugggauuacaggcgugagccaccacacccagccagccagucucuucauguacacagcgagagagagacagagagagagagagaaagagagagacagacagacagacagacgggcauagagcaaaguuacaucuacagugugugcuaccauucugacauauagcaaaugcucacaguuuacagaaauaaggagaugaaugaauauuuuagaaaacaaucuucaggccaggcgcaguggcucaugccuguaaucccagcacuuugggaggccgaggugaguggauugcuugaggucaggaguucgagaccaccccgcccaagagagcaaaaccccaucucuacuaaaaacacaaaaauuagcugggcaugguggugagcaccuguaaucccagcuacccgggaggcugaggcaggagaauugcuugaacugagaggcagauugcagugagccaagaucgugccacugcacuccagccugggugacacagcgaaacccuaucccaaaaagaaaaaaauaaagaaaaaaagaaucaucuaugccuagugucuuuccuuuaccaccuuaucauucuuacugcuuaaauucugguucuguuuucaaucuguuuaaauuugcuuucccagaauguugaaauaucaaauccagucauauuuacucaagucauuuuuucuggugucuccgugauuugacagaauuauccagcucauccuugauuacuucugaauuccuugaugccacugucuuaauuuuuggucuaacagcugcauaacugucucucauccugaaugcuacagccauauuaaccuuucuauaauuuuuauguauucuuuugaucauauucauuccuuagcuaaacugcuuucaagagcucucaaugucuaccuauaaucucuucagucuggaauccaaagacagugcccucaaguaccucauacucuggucaaacugaacuauuuauuuacaauuucuuauaaaacauaacucuacuggcaaagguauuuccucuccuuaaaauacacuucacuugcucauuauuuacaaaugaacucuuuucuauccauuugaugugacugaaaguuuccugagcucccccccgagaagcugagcagaugccagcaucaugcuuccuguacagccuguagaaccaugagccaauuaaaccucuuuucuuuauaaauuacccagucugaaguauuucuuuauagcaguauaagaauggacuaauacagaaaacugguacugaggaauggggcauugcuauaaagacaucugacaauguggaagugacugcccuaguagagagguucuccaugagagcuccauuccuuuagcaggcuucugccugaacauccagguguuuccauacagccucugaaaacuagguggaagcucccaagccucgaaucuugcauucuguguacuggcaggcuuaauaccacauagagccaccaagacuuauggcuggcacccuugaaguaguggcucaagcuauaccugggcaccuuugagccacagcuggagcugggauggcuggggagcagggagcaguauccugaggcugugcagagcagcagggcccugggccuggcccaggaaaccacucaguccuacuaggccuccaggccugugaugggaggagcugccacaacguucucugaaaugccuucuaggacuuucccccauugucuagucuauuagcaguuggcucuuucguuuuauuuacacaaauuucugcaguuauuuacacaaauuucugcagccugcuugaacucuucccugacaauaggcuuuucuuuucuaccacauggccagacugcaaauuuuccaaaccuuuaugguuuggaaaagguaauguggggaaaugugggguuggagcccccacacugagucuccaccaggguacugcagaguggggcuaugagaagagggccacuguccuccagaccccagaaugguagauccaccaaaagcuugcaccacgcacuugaaaaagccucaagcccucaauaccagcccuugagagcagccacaggggcugaacccuacacagccacagggguggggcuacccaaggcacugggagcccaccucuugcaugagaguguccuggaugugggucauggagucaaaggggauuauuuuggagcuuuaagguuuaaugacugcccugcuggguuucggacuugcaugaggucuguagcuccuuuuuuuggccaauuucucccuuuuggaacagaaguauuuacucaaugccuauacccaccccccucuauguuggaaguaacuaacuuguuuuauauuuuauacgcucauaggugaaagagacuuggccuugucucaaaugagacuuuggacuuugaacuuuuggguuaaugcuggaaugaguuaagauuuggggggacuguuggcaaggcaugacugaauuuugcaaugugagaaggacaugauauuugggaggggccaggggugaaaugauaugguuuggaucuguguccccucccaaaucucaugucgaacuguaauccccaauuacaauugaagguggggccugguaggagguaacugaaaucaugggggugaauuucccccuugguucugcaucaccauugugagugacaucugguuguuuacaagugugcagcaccucccccaucaccaccucucuccugcucuggccauguacggcgugccugcuuucccuucaccuuccaccauaauugaaaguuuccugaggccucccgaaagcugagcagaugccagcaccaugcuuccuguacagccugcagaaccaugagccaauuaaaccucuuuucuuuauaaauuacccagucucggguacuucuuuauagaagugcgaaaauggacuaauacacuauccuuuaaugcaggcauccccaaucccagggcaacagaccgguacugguccauagccugucacaacuaggccacacagcaggaggugagcagugggcgagccagcgaagcuucaucuguauuacagccauuccccauugcucacauuacugccugagcuccacuuccugucaguauuagauucucauaggagggugaacccuauuaugaaccaugcaugugaggaaucuagguugccugcuccuuauggagacucuaaugccuaacgaucugagaugauacuagugcugggagcugcuccaaauacagauuaacaagcucaggguucccacugauucuacauuauggugaguuauauaauuauuucauuacauauuauaauguauaauaauagaaauaaagugcacaauaaauguaguguccuugaaucaucccgaaaccaucccaucuguccauggaaucacugucuuccgugaaaucagucccugguaccaauaagguuggggaccacugcauuaaagacaacucuuauauccuuuccuucauguugcuuucccucauuucucaaauuagaacugaaaucacuucacuccuaagucauauguuacaaaaguuacauguuucucucauaggauaccuguauacuauaugucaaucaacacuaugagugaaacaaauaaccuuuauauuaauuuagagugaaaugauaccuccuuuuccaucauuauaucccucauaguaucuggcauauugcuacauaagaauauuuaaugaaaguaugaaugaaaaaaucugucucacuaacagacuaccugaggcuuauaguuuuuucccuuaucuuccuuucagucaacuuuuuuuuuuuuuuuugagacggaguuuugcuuuuuguuucccaggcuggagugcaauggcauaaucucggcucacugcaaccuccgccucccggguucaagugauucuccugccucagcaucccaaguagcugggauuacaggcaugcgccaacaugaccagcuaauuuuguauuuuuaguagagacaggguuucaccauguuguucaggcuggucuugaacucuugaccuccagugauccacccgccucagccucccaaagugcuggcauuacaggcgugagccacugugcccagccucagucaagcuuuugcacauaugaauaccacuaaauucuagcccugaaaacaacaaaaacuauuuuaaguugauagcaauccauaaaagugaaguuuaauguuaagaaauucucuguaaaaauucacagacgugauaauucauaaguauccaaugaagaacuaguaugagaagcaaaaacaguaaucugucaacauuauucauuacacagguguauaaagucauaaaaggcaaaguguuaauucucuaaagagucuaucuguggccaggcgcaguggcucacaccuguaaucccagcacuuugggaggccgaggcaggugaaucaccugaggucaggaguucgagaccagccuggccaacauggugaaaccccgucucuacuaaaaauaugaaaaauuagccgggcgugguggcaggcaccuguaaucccagccgaaauugcaccaccgcacuccaaacugggugacgagagugagacgucucccccucaaaaaaaaagucuaucucuaagcagcuaagacacacacuugaauaacguuaucaaauucagacuugccaccuagguaugaacuaucaaaauaucauauuuagguuaauuaguaucuuaaggacaaaauuaauuuuuaaaaaaaagucaaacaguaggccaggcaugguggcucacaccuguaaucccagcauguugggagggcaaggcaggaggaucacuugcacacagcaguuccagaccaguguaggcaacauggugagacccugucucuacaaaaucuuuuuuuuuuaauuagcugggcauguugguacaugcccguagucccagcuacucaggaggcugaggcaggaggauggcuugagcacaguagguugaggaugcugugagccaugaucaugccacugcaccccagccaaggcaacagagaaaaaaauaaaauaaaaauaaauguaaaaaguaaaacaguccagacaugguggcugaugccuguaaucccaacacuuugggaggccaaggcaggaggaucacuugaggccaggaguucgagaucagcuuggggaacauagagagaccucaucucuacaaaaaaaaugaaauaaaaauaagugaaacaggggacuaaccaaaaugaaagaugaaacaaucaaaaaaaaucagggaaagaaggcaguaaugcaauaaaaaauagaauuuaacaaagcuuaaagggcaaaggugugauuaaugacauuccuaaauacaacugaaaauauauguagaacugcauaaauuacgcaauuguugccaaaaugaauaaaacuucauuugagugaaaguauauuuaauauccuacacuuaugccuaacaccaaaaaagguuaaaucagaaaauauuaccaggagaacacauuaguuugaaauagaacagagacaacacuuagucuauuucauaggcaugaagauaaaccaaaagguacuauaacaggaacugaaaaaugcaaaccaauaagaaaucaguuaagagauuccuuuagaaaaaaaaaaaaacaaaaccaacuuauuuauuuauuuuuuuaauagagacaaggucucacuauguugcgcaggcuggucucaaacuccugaccucagauuauccacccgucucggccucccaaagugcugggauuacaggcaugagccacugcaccuggccaagagauucuuagacugagcaucaaggaguuaaauucucacagcagagcagccugggaaacaaagcaagacacugucucuacaaaaaauacaaaaauuagcugagugugguggcaaauaccuguauucccagcuacucaggaggcugaggcagaaggaucaccugagccuggggagguaaaggcugcaguggccugugaucacaccacuguacuccauacuggcaacagaguaagaccuugucucgaaaaaaaaaaauucccauggaaaacuauucuguaauuaaauacugaaaugagcacuguaugcagaagagauaauaugccugagacuguuauucucaguccuguuugcaaggcugacucucggcuagcaucuaggaacucuuauuuuuggaggguuccccccauuccauaaguaagagucuucacugugccaaaacugugcaaacaauauaguucguuguuguuguuguuguuuaagacagggucucacucugucgcccagggugcagugcaaucgugcaaucggcucacagcaacuuccgccgccuccuggguucaagcgauucuccugccucggccaacugaguagcuggaauuacaggcaugcaccaccacgccuggcuaauuuuguauuuuuaguggaaucgggguuucaccacguuggccaggcuggucucaaacuccugaccucaagugaucugcgugccucggccucccaaagugcugggauuacaggugugagccaccacaccaggccuaaacaacaugguuuugcugaacacuuguuuuccuucugggagucuggaauuuuaguuugugguaggcaaauggugccuauaugaccaauguccaagaaaaacccugggcacugaguuuuuaaugagcuucucuggcagacaagauuucacauguguugucacaauucaccacugcaagaauuaagcacaucacaugugacaacauugggaaaggacucucagaaacuugugccuaguuucuuucagaaauugcaccaagugcuauuuuucuuguugauuuuacuuuguauccuuucacugugugucuguauauuuuuuuaaagauggauucuugccguguguguguguguguguguguguguguguguguguauuuuuuuuuuuuuuuuuaaagauggguucuugccacguugcccaggcuggucucguacucccaggcucaagcaauccuccggccccagcuccccaaaaugcugggauaagagcugugagccaccaugccuguccuccuucacuauaacaaaucauagccauaaguacaaccauaugcugaguccugugaauccuuucagcaaaucacaggcccugggaguagccuuaggaaucccaguggacacaggcaaaaugcauucuuuacaugaaaccaaacugggguacuagcauucaccagauagauuaagagcuuuauguaaucucucgcucauuuccuaucucuacauaugaaaugcaguagauauguaugcagaaaauuuuaaaauaaggaaaaaggccauuuuaaauaccaauuugcuucuccuacacuaaagaguauuuaaaguccacauuaaaucuauaauucuuuucuuuucuuuuuuuuuuuuuuugagaccgagucuugcucugucacucagguuggagugcaguggcacgaucuuggcucacugcaagcuccaccucccggguucacaccauucuccugccucagccucccgaguagcugggacuacaggugccugccaccacgcccagcuaauuuuuuuguauuuuuaguagagacaggguuucaccacauuaaccaggauggucuugaucuccugaccucaugauccacccaucucagccucccaaaaugcugggauuacaggcgugagccaccacaucuggccuaaaucuauaauucuguaacagaacccaauaaaggauccugacagguaccuauaacagaaagaauagaacugcuauccaacuaaucugccccuucaaaaguguaagaugagaaguaaaaugguggccaggugcaguggcucaugccuguaaucccagcacuuugggaggcugaggcggguggacugcuugaggucaggaguucgagaccagccuggccaacaugguaaaaccccaucucuacuacaaacacaaaaauuagccaggcgugguggcgcacgccuguaguuccagcuacucgguaggcugaggcaggagaaucgcuugaacccgggaaacagagguuacagugagcccagacugugccaucgcacuccagacuggguaucacagugaaacuccgucucaaaaaaaaaaaaaaaaaaagaaaagaaaagaaaaauguugaugggagacccuccccaaagccacauacaaaugcacaaagcagaccacacacacaaaguaccacagauacacacguguauagagucagagccagagagagugugccagacugggagugagggaaucagaaacagagaugcagguauacuuagagccagagagagacacucacagaggcagaaagaagcgcacacagaaacaaagacagcauguguuguuaauggcuaauuaugaaaagaaaaauaaaaaaaaacuuuuaagaucacaaauucauugaguuaauucuaccacuaauuuucguauacuuucuguauuaauaaagugaaaaacaaaauucagaaaaauuuauaaaauuuauaucuaucuuucucucucccccaucccauuauuacauauaggaaaaaaguacuaauuagcuuaguuauucucaacuuuuggccucugggauucgaaucugcuuuuuuugcacugcaauguugucacucuuccagccaugauuuaccuaccugugaccuuuaguacacuaccagucaccuuggacacuggcuucuuucaacccucauucuaacugcucaccagcaaacuuauuuaaaaugcuauaaugacaaacauuuacucuaaaaaauacuauaaucauaacacauguucucacacuuuaucauuaauaaacaacauaaaaaugccuggaacauaaugcauacaaucagaaaaagcaguuggugaacuuuaguauaaaauaagacccacuaaauaagcuuuguuucaaacuuauuuguuccuuuaaacuauuuugaaaagagcaaauaauccaacuuucuuaccaaauaaacuuuuauaagguuuucgcauuaauaaaacacuuuuuaucauauauauaauuuuguguguauuuccagucagaaaaaacuugacaggccggacgcaguggcucaugccuauaaucccagcacuuugggaggccgggucaggcaggcugccugaccucaggaguucgccaucagccugggcaacauggugaaacccugucucuacuaaaauacaaaaaauuagcccuaggcauggcggcgugcggcuguaaucccagcuacucaggaggcuggggcaggaaaacugcuugaacccaggaggcagaguuugcagugagccgagaucgcgccacugcacuccagccuggaugacagagcaagacuccucucaaaaaaaaaaaaaaaaaaaaaaaaaaaaagacacauuuuuuuuuuuuuuuuuuuuuuccugagaccaagucuugcucugucacccaggcuggagugcaguggcacaaucucggcugcagccuuugccuccuggguucaagcaauucuccugccucagccucacgaguagcugggauuacagacgagcgccaccacgcccggcuaauuuuucuauuuuuaguagagaugggguuucaccagguuggccaagcuggucucaaacuccuagcuucaaguggcccacccgccuuggccucccaaagugcugggauuacaggcgugagacacugcgcccagccuaccugacacaauuuuuaagaaaaaccuggagaaaaugaauuggugugacauacuugacaucuauuuuagauuuucaaaugccaucauccaucaacaccuguguauaccacagcuugcaacauuaucauuaacagaagaaaaaaauuacaaggauagaauaaaaguuggaggccacaaggaaaaaaguggcacacaguaguaaaugaaaguauauuuucccucagcaaaguaaaugauuuguuguuccaagucaccaacaacaaaagaugccuuucccuaccaccaccacaggcucacuugggaaauggccccacauacuaagcaaauucuuucucguagauaguaacaacagauaacacucagugcuuucaaugcgacaagcacuguuuucccaaugaaucauguguuuauucacuuaauuaucuauguacuacacacugaggagaggagauaguuugguuuuauugguguuuuuuguuuuuuguuuuuuugagauggagucucucucuguugcccaggcuggagugcaguggcaccaucuuggcucaccgcaaccuccgccuccuggguucaagcgauucacaugccucagccucccgaguugcugggauuacaggcacccaccguaauuuuuuguauuuuuuaguagagaugggguuucaccaacuuggccaggcuggucuugaacucuugaccucaggugauccaccugccucggccucccaaaaugcugggauuacaggcuucagccacugugccuggccaauuuuguugcuuuuuaaucacaaaguuaaucucucauacauacuuacaagaaagauuucauaacuauuuacuacucaguaguaaguaccugugagccagauucuauacuuggcacuuuccucauacuuucccucauuuaaucuugguaacacuguaaggcaguaauuaaauuauuacuuaccuccacugugaauacauuuucccuaaauuuuuccauggacaucccagaagucacaaauuaauuuccacaucuaucucauucuuuuaccuuaaucaucacuaguuucaguuuaacucgguucaaaauaucaccuaaauuuuugucuacuucaaaguuaauaucguauauuucauuuuuuaaaaaucucaauuuuuaggcuguuuuaaauuuuauuuucauguguaaucucuggauucacauaauucacauuauguuaggaauccaguauucaaucaagaacauaugaggcuuuuauaaaguauuucuaaaacagauuccuucucaaguaauagaauuuacagcaugauauuuucaaaugaauaagaaaacuauuugauuaaaucagaaaaaaaaauggcuauugggcuaaaccaaggguaaaguuaaguagacuugacuuuuucuuuucuuuuuuuuuuuuugagacugaaucucacucuauugcccaggcuggaguacaguggggugaucucagcucacugcaaccucuugucucccggguucaggcaauucucaugccucagccuccccaguagcugggauuacagauguccaccaucaugccccacuaauuuuucauuuuuaguagagacgagguuucaccacaucggccaggcuggucucaaacuccugaccucaagugauccacccgccucggccucccaaauugcugggauuacaggcaugagcgaccgaaccuggccuuaagcagacuuuucaagcauucaucacuagcugcuauaaauaacuagugugguuauauucaauuccugccucaaaggcuuacaaucuaauuagacaacacagauagaauaugcaggcaaaagaaacagaacaaaaggaucaugagcauuaacuaauaagcagccaucaacuuaagcucugacguauuucuucaagguugaaagaauaucguagaaaaugaaguucugacauguagauaauagaaaacgaauaucugaaaacaugacaaagaaugcaaugaaaauacagaaucuaauacucuuuaucuuagauaauauaaacuaccaguuauuuugcuacauaugcagugucguggucuuucccccucaagcaaauauaaagccuuaucaacaauuaaauucaauaugaaguuaaucaaggucaacauauucucaucaucaacuaucaacaugauagcacuaguaaauuugcuagcuagugaauucgcuaguugucuagcaaccgaaugccacggauucuucuuaccuugacaucugagugaauuuaagacuauccuuacgucuauucuaccacaaauucucucuuuacaaguucagacuuauugacaggauuugcaguauacuuauuacccaaccaccuaccccccaaauucuucucuccaccccacccucauauauaaacagcaaaugaaugcaacuguaacagagaaaaaaaagaauaaaacaaggauauucuuaaacauacaagaaacauaccgcuucugauuuagcucagaguaaaauguucccucuaaaugcuagacuaugguauggugaugacagucaaauauuuuuaagaagaucacuuacuucaccaucccuaucauacuaaaacuugcuuuggcaauuuuucuuaauuucuuccuuuuagauuaucuaaauaugaguaagacuaguaaugcaaacauagaauuaacuuauuuuaaaauaauuuaagaaauuaaguuuaacgaagcuuaaccuuuuaacuuuuuaauggcucacuaaauauacuauaagacauguuaccauacagauuagaacucuccguuguuacauuuacuuuucauuuccucaucauuguucauucuccgcaaaauucagcaccaaauaacauuucuuauuuuauucacuuagccaauaaagauacugaacaguauaauaaaguagaacuaaaaucacugaauaaaacuuacuuuucagcaaaaucuuuacuucuccauucucuuucuugaucucauucauuacuuuauguuucuuuuuuucucuuucuuuuucuuugucucucucuuuaauuuugucuuugauuuuaucuggaagacaaaacaaaggaaauauuuaaaaugaaaaaauuacaacuucauuuaucugcacaaacuauagguaaauuucuggaauuacaauacacaaagaaaaucagaaugaggaacaaauaaugccuuuucuuuuuccucucagguuuuggggaauauuucuaaauuucccuuuuuauugaauaugaaauacauauugucaaaauguaucauuauacauuuuauucuaaguauucuucacuucgugucaaccaaaauauuaaauuuauuucaaaucacuuaaaauaacuaacuuuaggugaagcaaaagcuacgauggaaaagugccaguguugaaauugagcaucuauggauuagcagcauaacagaaaaauuacuugaucucaguuuccuaaucuguaaaugguaauugauaccuuccucauuaugguuacuauaaggacuaaaugaaaaaauauauaaaaugacuacauagagccuggcauacauaagacuagauguugguucccuuacccuuggcuccuuuuaaaaauaguaugacucaaucugacuacuuggugauacugugauauuuaaauaaagggcauaauaacucuagggaucauucauuugcauucuaaaacuucaaacaaaauauuugauagccuauuaaauucuucuuuguucaaaugacuuccuaugcacccagcaaaagacaaaauacagagaaggauauacaaauagugacauaaaccuuugcccucaaaaagcuuacgacugauuacaaaaccaugauggaaguauacaagaacugugaaauguccuggaauauaguagagauuauauaguauacaugcauacugcauaaucucuuaaaaaucacuccuuacuuuccuuucuauaaacacuaccauaacccagguccuaaucauguagugauuagauuacugucuauauaagcacuguccagaucuagacaguaaucuaaaucugaauugguaaacaauuuuauuaauuuuaaugauauauuuugcuuaacccaauggauccaacacauuauaauuucaacauggaacugauauuuuuaaaugaugagauauuuuacauuuuuucauaagauuucaaaaucuaacauauauuuuacauuuaugacacaucucaauuugaaacuaguuucacuuuaaguguugaauagucacauaaaacuagugucuaccauacugaauagcacaggucuagacuacuuaaauaaauuuucaaaaaauuaaauucaugugcuaauaaacauuuuuaaacuucaaucauuaauaauauacaaauuaaaagacauuacuuucaccuauaacacugacaaaguguuuuuuguuuuuuuuuuucaagugauaacacuccaagcauacgaaaguacagcaaacaggaauucacugacucaacaaauacacagucugaguacaagaaaaagauuagggauacaggggagaauaaacgagauaaaacuccuuaucuguucacauauaacuuaacuucugaauuagauuacaguguucccacacuucugauugguuugccacucuuacuuucugauguuaaaguccuugaaauccugucauaggcugcugucuagcuauaaaauguuacuccaggccgggcgcgguggcucacgucuauaaucccagcacuuugggaagccgaagugggcggaucacccgaggucaggaguucaagacaagccuggucaaugugacaaaaccccaucuauacuaaaaauacaaaaauuagccggaugugguggugcaugccuguaaucccagcuacuugggagacugagguagaagaaucgcuugaacccgggagguggagguugcagugagccgagaucaugccacugcacuccaggcuggguggcagagugagauuacaucuuggaaaaaaaaaaaauguuacuccaaguagcuggagcuuagacacauuauauaauauuuccuaaguaacuaaacuucuaacaaaaugaacuauuuauauaucacuuaaaauuacaacugaaaaaaagucaccuaaaacgucuccacauuucuuuuuccaauaauucaauuuaaucuuaucaacuuaaacguauuauuuuaguaacuauuaaauuuuauuaaaguauaauauuaauguaauaaaaugaagauacuugugaaacggcaccacagaauccuucuguguucccuuccagucuuuguauagcaccccuaaagguacucaggaugcugacuuguaaucauacagguuaaaauaaccauaaacuuuuuuuucuuuuuuugagacaaagucuugcucuguggcccaggcuggagugcaguggcacgaucucagcuuccugcaaccuccaccucccggguugaagcaauucuccugccucagccaccaaguaaaugggauuacaggcacacgccaucgcacucggcuaauuuuuguauuuuuaguggagaugggguuucgccauguuggccaggcuggucucgaacuccuaaccucaagugaucugcacgccuuggcaucccaaagugcugggauuacaggcgugagccaccacacccagccaacaacuauaaacuuuuaauagcauauauucacuauauaagccuaccacaaucacaaaacauaaauauuuuucagaauaaaauuaaacuagcuucuagggaaauaaaacuaucauacacuaugacucaauuauuuuuaaacuuuagaaauauacauacauuccaaaaacaaacugaaagauaacccaaauuauuaaaagccauuauuuaaaauuauuuauuuaauuaaauauuuaacauauugaauauauuuaauuuauuuaacauuuaaaauuccacuauuuaagguggaaaguuucuaaguuucugcaaugggcacauauuaauuucauaacacaggaaaaggaaucuuagaauaugcacucggguaugauauuaaauaauucaaguacaguugaagguaugaaguuauuaugugaaaaacaucuauagaaacaaaaacaauggcaaagccaagacaggagaguuauagacaacguaauugcaguuaccccuccugauaucaaaacauccucagcaaacacaaauaaucccaucuauacauaaacaaagggcauuuuuuugugacaucacuucuguccuuaacccacacaucugucuugcucucaccucucagccuuucaaccuaccuuucacccuucuuacaauuuuuccacuuuuugguagagccuauccuuuuucaaaauccagucuuuuauucuuuauuuuuucuuuaauagagacagggucucgcuauguugcugagguuggucucgaacuccugggcucaagcaauccuccugccucagccccucaaaaugcucagauugcaggccuaagccaccacgcccagcccaaaauccaaccuuaaaugccuccauuaaacuuccuguagucauguuacauggcagagcuaugauaaagugggauaccuacaaacucaggagaccuagguucaagauuaugcucuacaaccuagauaacugacaaacuuucagaucuccaguugcagcuguaaaauggaguuuguguaaagauuaaauagaaaauacauacugaggcaguuuguaaagauaaaagccuuccaaauguagaauaauaucuauuuaccuauaauauugguauccauaaucccaaagaaagaaauuuuggccauaauucagaccacuguauauaaaaaucaaaucugccacuaauguaucguaguauguuccuuuuaaaaagccacuucuaggcugggugugguggcucacgccuguaaucccagcacuuugggagggcaaggcagguggauugucugauaucaggaguucgagaccaaccuggccaacacagugaaaccccaucucuacuaaaaauauaaaaaauuagcugggcaugguggcgggugccuuuaauccccacuacuugguaggcugaggcaggagaaucacuggaacccaggaggcagagguugcagugaacuaagauggcgccacugcacuccagccugggcaacagagugagacucagucucaaagaaaaaaugaaaaagaaaaagccacuucuagaucuuuacauacagaagugauggaaaacagugccguggcaucacuguuuacuauaauacauuacuccuaacaagacuagaauucuuauucaguuuuuauucauuuauuucugugaccaagaauuuguaugguuuuauccuucacaguuuaaucucaggcuugggaaaaauucguaacugaucuucucaucauaauucucagaauaaaaguaagaauucuaacaccauaaaagcaagaaauucucugaaaagucaaacuaaauauaaggauuacacauuuuauuuaaaaauaaaaagagaaaucaugacaauguauuauaggcaaaagaauacacaaacagaucaauggaacaaaauagggaguccagaaacagauccacuuaaauacaaucaacuuaucuugauggagauagaagucuuuccaacaaacgguacuggaacaacuggauauccacauaccaaaaaaaaaaaagucuaaacuaggagaagugguaugugcuagaaaauaacacagaagaaaaucuagaugaccagggauuuuggcaaugacuuuuuagauucagcaccaaaggcacaauagauuaaaaaaaagaacugauaaagcuggauuucauuaaaauuaaaauuuucuguucugcagaagacacagucaagggacuaaaaagaagccacagacuauaagaaaauacuugguaaagauguauccaauaaaggguuauuauccaaaaaaagguaacucuuuaaacucaauaauaagaaaacaaacaauuaaaaauggaccaggcugggcacaguagcucaagccuguaauaccagcauuuuggaaggcugaggcaggcggacugcuagagcccaggaguucaagaccagccugggcaacaugaugaaacccugucucuacuaaaaguacaaaaauuagcugggcacgguggugcgugccuguagucccagcuacucgggagguugaggugggaguuuuaggugagagguugagauggaucacuugaguccaggagacagagguugcagggagcagagaucgugccacugcacucaagccuggaugaacgagugagacccugccucaaaaaaaacaaacaaaccaaaaaaaacacuaaagaccuuaagagacaccucaccaaagaagauauacagauagcaaauaagcauaggacaagauacuccacaccugaugucaucaaggaaacacaaauaaaaacaaaaaugagauaccacuacacaccuauuagaaugaccaaaauccagaacacugacaacaccaaaugcugacaaaaauacagagcaaaaggaacucucaucugcugcuggugcgaauguaaaaugguacagccacucuggaaggcugguuagcaguuuauuacaaaacuaaauauacucuuaucauauguuccagcaaucacagucuaugguauuuaucuaaaggagcugaaaacuuaugucuacacaaaaaucuguaccacaacauuuacagcagguuuacucauaauuggcaaaacuugggaacaaccaugauguccuuuagguagcacauucagacaauggaauauucuucagcacuaaaaagaagugagcuaucaagccaugcaaagacauggaggaaauguaaaugcauacuaaguaaaagcagugugaaaaggcuacauaacguaugcuucuaaccauaugacgcuguggaaaaggcaaaacuacggagacuuuaaauaaaaagaucagugguugccaggguauaguggggaggagggaugaauaggcagagcacaaaggauuuuuaagacaauuaaaauacucugugguguaugguggauacaugucauuauacguuuguccaaacccaugaaaauuuauaacaccaagagugacuccuaauguaaaugauagacuuugggugguaaugauguguuaaugcagguucaucaguuggaacaaauguaccacucugauaggggauguuaauaauggggaaggcuaugcaagugucgggggagaggauauaugagaagucuguagcuucugcucaauuuugcuaugaaccaaaagcugcucuaaaacaugaggucaacuuuuuaaggcauaaauaaguaaauacaaaggggagugggagaaacagaugcaaacagaccuaugauacaguuuaaacccaaacagccaaaggaaucuaagaacggaagaaagaaggaauguaugacuaaguuacuaucaacccagaacaaaaaagaaaucauauauguggaaaaaugaacaugggcuaaacacacacuuuuuaaacauauauaaaguauguguuuagcccacacauaaagauuaagauauaaaaaagaaacucauuaaaauaauuguuuuuuugagacaggguuuugcucugucacauggacuggagugcaguggcaugaccacagcucacugcagccuugacuucccaggcucaagcgauccuccuaccuaagccccucaaguagcugggaccacagguguacaccaucacacccagcuaauuuuuuaauuuucuguagagacagggucucacuauguugcccaggcuagucucaaacuccugugcucaaacacuccaccuacccucagccucccaaagugcugggauuacaguggugagccacugcacccagccuaaaauaauuuuaaacaaaauacaaaugggaucuucagaaauauggugaacuuaugauuuagcaguauaagccacauaugcuucaguguaauauguaucucauucacccaauauacuucuauuaagcauguauggauuuaggaaauaaagaugaauacugcacuaagaaucuuacagucaacaaaugccaguugauucuuauuguaacuaccacuuuggaacaccuguucuuaguaacaaaauaaucucaucugguuucaauaaaauucacuagucuccacuauuauuaaagucaugagggcucccaaggugagucaguaguggacacugccuucauuucuguucugaccuugcagcuauggggcccccagaaaccuuggagaaauucuuguucaccaccuccuuccaacugcagccauacagaccucaaaauuagggcagaaaaucagacucaagaaaguuaauaacucuuacauggaauaaauaaaaagaauuccacacauaaaaacaccacaauggaagcugcaaaacagcuaaagacaaagagaagacuauaaaagaagcggaaggaaaaaacagacuacagccaagagucuacugacuucucaacagccauaagccagcaaaauauuuucaauauguuaaaaaauaaauaaauaaggacaguggcaucaucaaauggcagagcagaagccaucuggcuucacucuuccccacagaaaaccaaaaacaaauauccaggaucaagacuaucguuagcaauaucccagaacucaaaccugagguacagauaaucuccagggucacagggaaauuuaaaacuccaaacagaugguaagagaaaucgacuucugugauuccccuccccaaauaugcgaggcaccccauagaaaaaucccccaagacuaaaaguuuuacauuagaaaaaguaagaaugaggcagacagccagcuucuucaccaucuuguguucuccugcaggaaaacaauuucugccuuaauccgcaagaagcacugcaagugccuuuagggagaaaaagcccugaaggcagcuagagacagcccaggaaacugcuguuuaucucugccaaaaaugaugccaaaucaggguggcuguugagcagcgccacaccauaggaggcaagcuccacgggucuucugggcgugaaccuauagccagcccucgugacuuuuuaaaauguacuaaaacccucuagaggaaaguaaaaaauaaacagauuacauaaaagaucagguaacuauggaaaugaacucuucaacaguaacaguacacagaugcuaaaaagcaauacagcaaugccuucaaaauugcgaaugaaaauaauuuuuaacauacaauuuuauaaucugccaaacuaucaaucaaguaugcaggaaggcauauucagacaagcaaaaauuuuuaaaaaauuaccacacaugcaugcugucacaggaaguuauuugagggugugcucaaguaaacuagggaguaguaaacaaaggaagacaaugugagaucggaggacccagcauaaaagagcagaugagaauguauuaaaauaaacacugugcagauggcucagcggauaacuaguucaggcugaaguacaagaauggagcucuuaaaaacaagaccuccagaaacaaagggggaccugacaaauuuucucuuaucacagaacacagagaauagagagaaaaugaagcaauggauacauaaguaaaugaaaaagagaggcaauuuuuaacuacacaaaaaugaagaaagccauauaaaaggaucucucccugaucugcauuaaacagcauuugcagagucauuauaagcacugacuauuguuuuaacuaagguauguggaauuauuaaaaaggaaagaagcuagguuauaaaaguggucauucuggccaggcucagcggcuuacaccuguaauccaaacacucugggaggcucaggcacgagguguacuugaugccaggaggguaagaccagccuggggaagaaagugaggccuugucucuacaggggaaaaaaaaaaaaaaaauuuguuuuuuaauuagcugaguaaggugggacaggccuguagucccugcuacuaacugagccacugcauucuaaccugggugacaagcgagucugucuugaaaaaaauacuaaaaauaaaaauaaauaauaaaagugacaauucuuaucuaaacaagaaugcacuauaugucuaaaacuaacuaaaaaaaaguaguaugagcauuuuauucagaaacuuggaauuaaaagcagauggggggcugggcgugguggcucacgccuguaaucccagcacuucaggaggccgagacagacagaucacuggaggucgggaguucgagaccagccucaccaacauggagaaaccccgucuguacuaaaaauauaaaacuaguugggcgugguggcacauguguguaaucccagcuacucaggaggcugaggcaggagaaucgcuugaaccuaggaggcggaggaugcagugagccaagagagugccacugcacuccagccugggcaacaagagcgaaacuccaucucaaaaaaaaaaaaaaagcagaugauggccaggcacaguggcucacaccuguaaucccagcacuuugggaggccaaggcggguggaucacgaggucaagagauugagaccauccuggccaacauggugaaaccccaucccuauuacaaauacaaaaauuaggccgggcacagugacucacaccuguaaugccagcauuuugggaggccaaggcgggagaaucacuugaacccaggaauguggagguugcagugagccgagaucgcaccacugcacuccagccugggcaacaagagcgagacucugccucaaaaaaaaaaaaaaaaaaaaauuagcugggugugguggcacgcgccuguagucccagcuacuagggaagcugagacaagagaaucgcuugaacccgagaggcagaaguugcggugaaccuagauugcgccacugcacuccagccugggugacacagcaacguuccgucucaaaaacaaaaaaaaguagaugggauacuaaacgagcugaggaacacgaaaucaguagggaaagcuagggacacuucuuacuauaaauuuuucgauauuuuuaaauuaaauuuuguuuuuaaaauuuacaguuauugucuuccuccccaaaacccuaaacuccagucuaaucaugaggacaacaucagacaaaucccaguugggagacguuccacaaaauaccuaacugguacaccucaaacaaucaaggucauuaaaagcgauggaagucugagauacugucucagccaaaaggaaucuaacgagacaugaugauuaaauguaauacaguauccuggaugggauccuugaacagaaaaaggauauaagacaaaauacuaaggaaauucugaauaaaguauggacuuuaguuaauaauaaugcaucacuacuguuucuuaacuaugauaaacgugcuagaaaaauguaagauguuaauaaugguguaugggaauucuguacuaccuuugcaacuuuucuguaaaucuaaaacuacucugaaaugaaaugcuuacuaaaaaacuuauaaaggcaaaacuuaauuagaaauacagacagauacacauguauauguauguguauauaaauuuaacaauauauaacagaagcgcuacaagacacacuguuaacuaaaaaaaaaagcagguuacagaaaaaggcauauauauaguauauuuagguuuuuaaaaauaaacuagauaaucuuagccaggcgcaguggcucuugccuguaaucccagcacuuugggaggcaggcggaugaccugaggucaggaguuccagaccaaccugaccaacauggagaaacccugucucuacuaaaaauacaaaauaagccgggcaugguggcgcaugccuguaauccagcuaccugggaggcugaggcaggagaacugcuugaacccagccugagcaacaagggcgaaacuccaucucaaaaaauaaaauaaaauaaaauaguaaacgauauaaucucuucugugaguguguguuuacauauguacauauguaaaugcacagaacacuuaaaagggcuuaccccuggccgggcgccauggcucaugccuguaaucccagcacuaugggaggccgaggcagguggaucaccugaggucaggaguucgagaccagccucgcaaacauggugaaaccccguucauacuaaaaauacaaaauaagccgggcaugguggcgcaugccuguaauccagcuaccugggaggcugaggcaggagaaucgauuggacccaggaggcagagguugcagugagcagagaucgcaccacugcacuccagcuugggccacaagagcaaaauuccaucucaaaaaaaaaaaaaaaaaaaaaguggggggcuuaucccuagggaagaaagaaaaagaacuucugguuuuuauuucauuuacuuccuaaauuauuugaaacuucugcaagagaaagggauuuguggccgggcgcaguggcucaugccuguaaucccagcauuuuggaaagccaaggcggguggaucaccggaggucaggaguucaagaccagccuggccaacauggugaaaccccguuuguacuaaaaauacaaaaaauuagccaggcaugguggugugugccuauaaucccagcuacucgggaggcugaggcaggagaaccgacuggacccgggaggcggagguugcagugaaccgagauugcaccacugcacuccggcuugggccacaaaagcgaaacuccgucucaaaaaaaaaaaacaaaaaagaaaaagaaaaaaaauagggggcuuaccccuagggaagaaagacaaggaacuucugguuuuuauuucauuuacuuccuaaauuauuugaaacuucuacaauagaaagggauucauggccgggcgcaguggcccaugucuguaaucccagcacuuugugagggcaaggcagguggaucaccugaagucgggaguucgagaccagccuggccaacagggugaaaccccaucucuacuaaaaauacaaaaauuagcugggcauggugaugcacgucuguaaucccagcuacucaggaggcugaggcaggagaaucacuugaacccaggaggcacagguugcagugaaccaagagcgcaccaguguacucccaccuggacaacagagugagacucucaaaaaaaaaaaaaaagaaaaaagaaaaagaaagggauucauauauuauguauuauuuguacaaucaaguugguagccuaacucuccuucccgaaagaauuaauaauuauguucagauacauacuuuuuuaaagauuuagaaucacucaguauauuagaaggagauacaagaaaaaaaaauucaaaguaaaacacugaauauauaacauaauauguacucacauaaacacauuaaaaaaaguuuccaaaggucucccuccauuaaaacuguucaagugcuguucuaccucacuugauauauauuaucucgauguuaugcuauaguuaaucaagaggagaaaaaaaggagaaaauuagaaauaauuauaagcuggugcaaaggcucauucaugccuguaauccuagcacuuugggaggccaaggugggaggauagcuugagcccagaaauucaagaccagccugggcaacacagagagauccugucccuauuaaaaaaaaaaaaauuuuuuuuuugagacagaguuucacucuugugucccaggcuggagugcaguggcgugaucucagcucccugcaaccuccgccucccagguuaaagcaguucucuugccucggccacccgaguagcugggauuacaggcaugcuccaccauguccagcuaauuuuuguauuuuuaguagauacuggguuucaccaugcuggccaggcuggucuugaacuccuaaccuugugauccucccaccucggccucccaaagugcuaggauuacaggugugagccaccacgcccagccaaaaaaauucuuuuuaaauuaacugggcauggugguacaugccugcagucccagcuacuugggugggugaggugggaggaucgcuuaaacccagcaggucacggcugcagugagcugugaucaugccacugcacuccagucugggcaaagagugagacccuaucucaaaaaauuaaaauuagaauuaaaaaauaaauuauauauguauucugaauaugcauacacacauacauuauuuauuaggcuuaacaguuuuuaagaaaaagaagcuauacuuuuacucaaccacagauuuugauguauaggaaauucuuuauauagguucauuaauuuuuuuaagaaauuacagcaucauaaaaauccacacuggaaguucuuaagaaauguuggccgggcgcaguggcucacaccuguaaucccagcacuuugggaggccaaggcacguggaucacuugaggucaggaguuugagcccagccuggccaacauagugaaaccccaucucuacuaaaaauacaaaauuagccaggcgagguggcgcaugccuguaaucccagcuacucggaaggcugagacacaagaaccgauugaaccaggaggcggagguuguggugagccgagauugcaccacuguacuccagccuggguaacaaagcgaaacucugucucaaaaaaaaaaaaaaaaagaagagagaaagaaauguuagaauuucauacuacagcuuucagucacaauauauuguugcugcacaaacaucaaacaagcuucacaccaucacaguuuugccugcccugaauaugagccaugagccauaauucacaccauaauaacgcaguccaugaaaucaacugaacugaacgacaacaaugacauuccccaccuucccucucuuacauuauuccuuccaggaauaauguauggcuagaaauagaugagagaacaagcagcggcagaagaagagaaauguaaagaauuugaagcagaaggaaaagcaguuacauuacaaaaugauuacaauuacauacacuaaaauaaaaauugaaggagaugaaggauacaguaaaaagaagagaaaggacuucacaaacaguaaaugggaaagaagugauuuaucacagccccucgcuaacacagcuaaucaaagcuaaaaaauccaguggcuucucagcccuuuuuuccguggaccucacugcaacauaacaguaucaauuccuucucaaaauuucucccuaaguuucacugaaacuguacuauccuaccugacuccucccucauucucauaaucccaccauccaaaccugcacauuuaccuaggaucucuccuaggcauuccucucucuucucuauauugccucuaaaaaugcacucacaugauguaaacuauaacccuguggcaaacuaaucuccaaauuaaucucccaacccaaccccucugccaaacuccacaucuucaucuccauaauauuuaacaccaaaauaucaucuuucuaauauaaaaaaguucaaguucuccuuccaauucucuauguuaauggcacauccucauccaacauccaaauacaaaaaauuuucaguaacacuaauaauacuucuuucuucaauuuuccccuaacacuaaaucacuugaccaguucaguuuauacuucguuaaaauauuuccaucuuuuuuucccuuuccagagucaccaccuaguguauucucacuagcuuuuaaaagaaaggguuuccguaccuauaguuucuuuccuuuccaccaaguaagcacagugaccaaaaaagauuccuuaaauguauaguuuaccaugucacuaucuucugcuuaaaacgaaugaauaaaccaacucagcuuaccucugccuaucuaaaaacagaaaacucccauaauaugucauucaagaaucuucaguuaagacucaccuucuuuuagccuuuucuucaacuauucacccacauauauaacaagauuccggauuacuugauucaucauuacucaaaugucuuacuccaauauuuuuacuaauauaucccuuagcuaaaaugcgauugcccaucccaauuccuccugcccaaauccuacacauccuguaagauuacggugaaauuuagcuucuuccacuaagcacuccuugaugcccaugaucacaaaugaucauauccuccuccucccucuucuauaauuugaauucugauuuuuuguauaacugcucaaucugcccuccugguuucuaagcuccuuugcaauuaucauaucuugcucuuugcuaccuucuguagaaccuagaauggugcuuugcauauaagugaugcucaaugugaaugaaguuuccaggaggcaaaagauuuaaguaaaaagaaggaaauuacuauugauaagcauuugaaggcaaucauagaagacaaaaaagcaauacacagaaaaaaaaaaaacaaaauuaccaacaaugagcagugucuuuuacauugcagcuauuuaucucuccaauuaaauuaaaaauuaucucaaggcaagaaacagaaaguucuccucuuuguaucucccuuucuuccaccaccacccaagcacaaagcgggccauaaauaaguguuaaauccacauaagaaaaaaagcaguaggcugggcacgguggcucaccgcuguaaucccagcacuuuggcaugccgaggcaggcagaucacuugaggucauaugaccaaaauggugaaaccccaucucuacuaaaaauacaaaauguagccgggcaaggucgcccacgccuguaauuccagcuacucaggaggcugagggaugagaaccugggaggcugaugcugcagugagccaggaucacaccacugcacucgagccugggugacagagugagacucugucucaaaaaaaaaaaaaaaaaaaagaaaaagaaaaugaaaaagaaagaaaccccaaauguauugugauauaauagaaauaauucaggcuuuguaauuauacauauuaagcucaaauucuagcucugccaauaacugaucaagugacaugaagcaaguuacuuaaccguguugugccucaguaaucucaucuguauagauaauaacacuugucuucugcaauuuuuuuuuuaacggaguuucgcucuuguugcccaggcuggagugcaauggcacgaucucagcucaccgcaaccucugccucccggguucaagcgauucucugccucagccucccgaguagcugggauuacgggcaugcagcaccacgcccagcuaauuuuguauuuuuaguagacccgggguuucuccauguuggucagucuggucuugaacucccaaccucaggugauccacccaccuuggccucccaaagugcuaagauuauaggcacgagccaccacgcccagccuuuuacaauuuuuauaacaaggcaacauaugcauuauuuccaacacuaugcacaauaccuaauuuuaagcacuggacaaauguagcuauuauuauuaaauauaaacagaauuuuauuacaaaagcacccaguaacaaagaguuacaaaaauacuacaauaacaauagucacaagaacacacaaagaguaagaggaaaauaaaaaaggacacauacagcugggaacaguggcucacaccugcaaucccagcacuuuggaggacaaggugggaggauggcuugaggccaggaguucaaggccagccuggacaauauggcgagacccuuucucuacggaaaauacaauaauuagccaggcacaguggugcgcaccuauaguacuggcuacucagaaggcucagucagauggaucacuugagcccaggagucugaggcugcagugagccaugaucacaccacugcacuccaaccugagcaacagagugagaccuugucucuaaaaaaaauuuuuuuaaauacauauauacauaaaaaccaugccaggcauaacaugauaaaguggccugugaaaaauuuuagcucagguuuuccucacuaaacuaucagaaaagauuggucuccagagcagaaauaaaagcauuucgucuguucucaacauauuauaaaaccaagauaugaaguacuaagauauuguaggugguaucugguuacagaauuaaaucacuuuaaaucacugaaucgugugucuauagcuacuauaucaaacgugauuguuucacauauauacaaccuggggcauucuuagaccucuaaguccacauuauacaauuacauuauuuauuacaauuuaaauuauacucuguaaugcaaaugguaaaucauauacauaguucuuaaugauaacaauaugugugggcauauguaacuaugggaaccagacucucguuguacuuguuauauacucuuaguuacacuuuuucacacaaccaauuaaaguucuacauuuuuuaaaaguuguauauuuagcuaacaucauuagauacacaccuacagaugcuuuaucaaucuuaauucaauuggaaugugcuccaagugaaauuuuccaaaacacacauacauuaugugcccuaauguaugugcagugagaaauugguucagacuuccaaagcuaagucauaagaagacuugcuguuuccaccuaugucgcugggugucaagacucuuggaguccugagcugccacguaagaaauccaacuuccuaauuaacagaccauguggaaugguccugaaacaacuuggagaaagagaaggguucacucaguucaguaucuagccauacauaacacagcaacaggcacgugaguaaagucaucuuggaccuuccauaccagaccagccaccaacucaacaccaaugagcaacuccagucaacacugcgugaagcagaggaaaucacccagccaaucaugccagaauuugugauucacaaaaucaucugauauaauaaaaugguuauuguuucaaaccacaaaauuuuagggcaguuuguuaugcauuaagagauaauucagccuucacaaagucuuauuauagauaaugaaaaaguuguuuuguuuaaguauauacaagacaugcacugacucuagaaaaauguuaaaguagaaaacugucuuacaaaauacacugaugggccaggugcgguggcucacaccuguaaucuagcacuuugagaggccggggcaggcagauugcuugaacccaggaguuugagaccagccuggcaaacaugauaaaaccucaucucuauaaaaaauacaaaaaaauuagccagguguggucgugcacuuguagucccaguuacucaggagacugaggugggaggaucaacugagcccagaaguugaagccgugauugcaccagugccuaccagccuaggcaacagugagacucagucucaaaaaacauaaaacaaaauacacugauauauuaaaaucaagaagugaagggcuaaaagaaaaaaggcuuaauauauaaugucagagcuauaaacacaaucaaacgccuugaaauuauuuccucccauaacuucugugacauuguagagcucgcuuuuccuaucuagcugccaugaauauuaguucauauaauguucucucuccccacaacuccuuuaucucuuugcugaaauccuaccauacugcccuuucaaaguuucucucaaauaucuccucuccuacaucucuucucccuuucuuuucugagacacagucucgcucugucgccccgacuggagugcagcagcacgaucucggcucacugcagccuccgccugccagguuccagugauucuccugccucagccucccaaguagcugagauuacaggcacacagcaccacgcccagcuaauuuauauauuuuuuaguagagacaggguuucaccauguuggccaggcuggucuugaacuccugaccucaggugauccgcccaccucagccucccaaagugcucagauuacaggugugagcagccacacccgggaccuugucccuuucuuaacugccuuaguaucugccugcccucacuccacaccacaacuuucuacuuaugguauuuaacuuacugcaguauauauuauaaguauccugcuacauuguuuggaggcagaaauuguauuuaucgauuuugccauuuuucuuaacacuuugccacagcauuuaagaaccaaaaauauuuaucucugcuaaucucagauuucaaagacaaaaacaaugcuugaaguaccacaaaguauuuuacuauaauucauucuguuucugauuacaauuguauagcuucucacuguuauaacauuauauauccaauuaccaauuauauguagaaaaaccaaagucuuuuuuauauacuaguaauaaucucacaaaaauauacuaggaaaaacucccaucauaaaaauaaaaauacuagaagaaaacuuacaaucuguauuaaauaccaauaaaaaucucuaagacgauauaaaauaauauaagacuacggccaggcacaguggcugacgccuguaaucccaacuuugggaggucaaggagagaggauuccuugaguccaggcaacauggcaagacuaucucuacaaaaaauaaaauaaaaaacagcugggaguggugucgcucaccuguaguccuagcuacucaagaggcuaagaugggaagauagcuuaaggccagcaguuccagacugcaaugagcuaugauuacgccacugcacuccagccugggcaacagagcaagacccugucuccuuugaaaaaaaaaaaagaauguaagaauagauaggccaggcacaguggcucaugccucaugccucaugccuguaauuucagcacuuugggaggccaaggcaagcagaucaccugaagucaggaguucaagaccaccuggucaacauggugaaaccccgucucuacuaaaaauacaaaaaauagccuggcgugguggugcacgccuguaaucccagcuacucgggagguugaggcaggacaaucgcuugaacacaggaggcggagacugcagugagccaagacugagccacugcacuccagccugggugacagagcaagacaccgucuaaaaaaaaaaaaaaaaaaaaaaaaaagaugaagauacacaugcagcuuuuaaguacaaagauaauucugucaugacuauaauuuccuccuaguuuaaucaauaaauuuaaugaaaauaucuagagcgugacaguggguagaagaacuuuacagaauaauucucaaguuaauaaaaauggugaaaaaaaaaaaaaggagccagacagcugaggcgggaggaucaucugagcccaagaguucaaggcugcagugagccaugaucgcaccaccacacuccugcagccugggugacaaaagugagagacggugucaaaaacaaaaacaaaaacaaaacaaaacaaaaaaaacaaagaaaaagacaaagggaaucuugacccaaaccuuacagacggaaguuuucaaaaugcauugcggaccuaaaugugaaaccuaaaccuauaaaaugccuagagaaaucuaagagaaaauccugugaucuaggguuaggaaaagcuuucgaaguuaagaaacaaaagaugcaaaccauaaaagaaauaaaaguauaaagugggcuucauuaauuuauaaauuucugcuaugaaaaacugugaaaguauuaagagaaagaaaagacagagaaugguagaaaacauuugcaaaacauguaucugauaaaggaguucuacccagaauauguaaagaacuuucacaauuugauaauaagaaaacaacccaauaacagacacuuugaacagacaacucaucaaagagauauauauagaaaauaaguacaugaaaagaugcucaacaucacuauucauuaggguaauguaaauuaaaacuacaaugaacuacuacuaugcaacuacuagaauggcugaagauuuuuaaacuggcaauaucaaguuaggauucuuucuugaggggaggucugaauaaggaaaaaacagagcuggcagaaaugaaaaauacaaccacuuuggaaaacaguucagcaguuucuuaugaacuuaaacacacuuaacaggccacuuacacuuaacagcccaacaauuccacugcuagggccaggcacagugucgugccuguaauucuagcacuuugagaggcuacggcaggcgaaucacuugaggccaggaguucgagaccuuccuggccaacauggugagccccccaucuugacuaaaaauuuuuaaaaaauuacccgagugugguggcgggcaucuguaaucccagcuacuugggaggcugaggcacaagaaucaccuagccgagaucacaccacuacacuccagccugggcgacaaagugagacucugucacacacacaaaauaucccacugcuagguauuuacccaagaaaaaugaaaacauacauccacucuaaucuuucuuucuuuuugagacagagucuuacucuguugcagguuggacugcaguggugcaaucucagcuaacugcaaccucugccucccagguucaagcaauucucaugucucagccucccaaguagcugggauuacaggcacaugccaccacaccugacuaauuuuuguauuuuuaguagagauaggguuucaccaugcuggucaggcuggucuuaaacuccugaccucaggugaccugcccauaucagccuaccaaaguacugggauuacaagcaugagucaccacauccagcccacuacaagauuuuuuuuuuuuuuuuuuuuugagauggagucucugucacccaggcuggagugcaguagugccaucucagcucacugcaagcuccgccucccggauucacgccauucuccugccucagccucccgaguagcugggacuacaggcgccugccaccaugcccagcuaacuuuuuuguauuuuuaguagaaacgggguuucaccguguuagccaggauggucucaaucuccugaccucgugaucggcccgccucagccucccaaagugcugggauuacaggugugagccaccgugcccggccacccacuacaagauuucuaugugaauguuuagggcaggcuuacccacaaucuucaaauacuagaaacaacccaaauguccaucaacuuguagcaccaaauugugcuaucuccacaaaaggaauuacuacucagaaauaaaaauaaaugaacugauucaugcaacuguacugauggaucucaaaaguaauauaacaagugaaaaaagcuagaccgaaaaagcuaguguaugauucaacuuauaugacauucuaaaaaaggcaaaacuacugagacagaaaacagaucacccuuggauuagagaugaugggagagcacugaguagcaagagagaacuuucugcggugauaaaaaucugcuaugucauuacucuacugguggcuaucaacuauucaucaaaacucauaaaacuauauaccuaaaaagggcaaaucuauuuuauguaaauuauaauucaauaauguuucaaaaagccaggaaaauucugaauaagaauaucgggauuuuugcccuauagauaucaaaucuauccuaaagauagaguaaugaggguguuaguugagcagaaacaaacuuacagagguaaauguaaaaaagugcaaaucuaaaaacagacccaacuacacaugugauuuuaguaugauaaacauuagcauucuacaucuuuauggaaaggaaggacuagucaauaaaugauguuaaaacaacuaauuacuggaacaaaauuaauuuggauuccuaauuuugugucuaaauaaauucuaaacagagcaaagauuuuaaucaauaaugucauauaaaauaacaauaggcuauuuaagaaaauauuguuaugaacuaaagguagaaauaacuuuucuaagaaauaaaagccagaagagccaggcgagguggcucacaccuauaacuccaacacagggaggaggccaaggcaugaggacugcuugaggccaggaauuugagaucagccugggcaacacagcaagacugugucucuauuuuuaaaaaaaaaaaaaaggaagagagaggccgggcaugguggcucacgccuguaaucccagcacuuugggaggccaagguggguggaucaugaggucaggagaucgagaccauccuggcuaacauggugaaaccccgucucuacuaaaaauacaaaaaauuagccgggcaugguggcgggcgccuguagucccagcuacucgggaggcugagguaggagaauggcgugaaccugggagguggagcuugcagugagcugauaucacaccacugcacuccagccugggcgacagagugagacucugucucaaaggaaaaaaaaaaaggaagagagagaaauaaaagccaaaaaauuaaauuacugaugaauuugaguacauaaaaacagaaaacuucuguaugaaagaccaaguacacccccuuaaauaauguuuaugaacuaaugauaguuuagagagaaaaaaauugcaacaguaaagggcuaauauucuaauauacaaaguuucacaaaucaauuuuuaaaaaaagaaaaggauaagucccuuagacuuggcaaagcacaugaacauauaagugaaaugugaaaaaauguuuaaucuuaaucauuaauaaaugcaaauaauaaaaucuucaacaaucaaaacauggaagauuuugaaaucugagaaaacuuagcauuggaaagaauguaaaaaauggacagucucauauauaaugcaagugagacagcaaauuguuuaucuuucacgaaagcauuauuuaucaaaauuuaaaguguauguaucuuuaacuuuccccuuacccccuauaauucaacuuuuagaacuuuauccuaaguuuuaagugaauaaacgccuacacauuguuuuauuuuagcaucauuuacaacagaaaaaagaaucuaaugucccacaauacaguaucaguuaaauauauuaugguuuauacauauaaugcaaacaugaauacuagguaagcaauuaaaauugauaauauaguucuacacauauugacauggaacaguauuucuaauauacugcuaaaugaaaaaagcagguugcagaacacauaaacaauguugugugcauuaaaaaaucacauauguggccaggcacaguggcucacgccuguaaucucaggacuuugggaggcugaggaggguggaucaccugaggucaggaguuuaagaccagccuggccaacaucgugaaacccgucuccacaaauauacaaaaauuagccagucaugauggcacgugucuauaauuccagcuacucaggaggcagaggcaggaaaauggcuugaaccuggaguggagguugcagugagccgagacugcaccacugcacuccagccuggauaacagagcgaaacuccgucucaaaaaaaaaaaaaucauguauguauauauaagauuuguacacauauaaaaaagcauaugcauaaaaaauuauauacauguauauacuaagugaaaauaauacacuaagugaaaauguaaucauuaaaacaacaguauuucagaugcuuuucuuccuaaaauuugaauuauuuuuacaaugaacauauauuauuauaauuagaaaauuuaauuaggcaauuuuuauuaugauuacaaaaaaaacauacaauuauaaaaugucaaacgagcuuacaaagaacuuucaguauuugguucaaaccucuuauuuuacagaugaagacccuuacccucacacagguuuuacuccuuuccuucagaucacaaaugggugguagggcaagaauuugcuccuaaggccuccugauucucaguccuaugguuuuuccauuguauauuacacaacauguauguuuucacucauaauucuauauauauggaaauaugcacaacagguaaaauuuuacuaaaaauuuacacuguacuuaaacaugguuacuucugaacacagaacaauuacucaaaaugccacuauucuaaaauaagaaaaaguauucccuccuuuacuucuauuuauucauucccaaacuguuguugguuaacacagcuuuaacaauacaggcugggcacuuuggcucacacuuguaauccuaguacuuucagaggcuaagacaggaggauugccggaacgcaggaguucaagaccagccugagcaacacagcaagaagccauaucuaugaaaaacuuuuuuuaaaucagccagguguaguggugcucaccuguaguccuagcuacucaggaggcuggggcaaggggaccgcaugagcccaggaguucgacguuacagugggcuauaaucaagccacugcacuccggccugggugacagcaagacuaugugccaaagaauaaaaaugguaaaaaaaaaaaaaaaaaaaaauuaauaugcaaaauaucuuuuuuauacaauguagugcuaaguuucaacuaugugcaguuagaguauacaaaauggcaauucugauaacucaauuugucaaauauaauuugguuauuauuuacccacaguuuauuuccuuuccacuugacaauuugccuguugucuaugagcugcuggucaacuucuuaucccauuaucacccuucugcuguuuucaguuugaaauaccagccaauuguuuuucuaaaugauaaucgggcaucucuucugagcaggcaaaaagggcugaaauauacugcaagucauucaguucccaaauauguauccagaaguugaaggucugauccaaaagaagauaaucacagacccagcuuucacagaacuugcagucuagcaaagaugacaaacgaguuacuaaaaugaaggaaagaaggcugggcacgguggcuuaagccuguauagcacuuugggaggcugaggcgggcguaucacuugaggucaggaguuugagaccaaccaggccaacaugguggaacuccaucucuacuaaaaauacaaaaauuagccaggcaugauggcaggcgccuguaaucccagcuacucgggaggcugaggcaggagaaucaccugaauccaggaggcagaguuuacggugagccaagaucgcgccacuacacuccaaccugagcaacagagcgagacucuaucucaaaaaaaacaaaaaacaaacaagaaaaugaagcaaagaaagucaggauaagagaagaacaaagugaagggaaccuaaccuagucauagaggagcacaggccucccucucaaguugagaccuagagagaugagcagacauuagcuagguguaguaaaaguguggagcuggggauggaaagaaaacggguagagaaaguucuaggcggcgaggagcacugaggagaaccugaagaacaaaacaagaauaugaucauccagagcuguggaagacauuucaaggaaucugaacuucaucccauaaacagaaaagugagaugauuagacaugcauuuagaugagauacaggguucagggugguaugucuguagacuauaugcauuuagauaucugguuaucacucugacuauauagcaugaagaaugaagugaaagcacauggaucugaaauagggagcccacuaaggaggcaacugugcaauaauccuggcaagagauaaugguaauuugaacuaaaacuaguagaaaagacagagcaaaaguggaaagauaugaaagacagugagugguaacaagauuuggccacaaguucaaugagagcagaggguacaaauccaguuuccaagacggagccacuagguauaugguacugagacaaggaacauacauagcaagacaaaucuggauaaagaagacuaaaaguuuugaacacguuaauuuuacaguuuaaaaaauaucuaaggacauauuaaaugucaaggaggcaauuuauauagauuuaaaaauggacuaaguuaaaauuugaggagugcuaacaauggacacuagaaaaauaccagggcaauuagcaaaagccagaaagaagaguacaaagggcccaaaaccaaaccaaaugcugaaacuuaguggcagaagacaaauaaggaaaauuaggggguggggcuggaagacucugaacaguuaauugcuuaccuaggaacuaagaaggauucuagauuauuugcuccucauaaaaaaaaguaacuauugguggggaacgguggcucacgcuuguaaucccagcacuuugggaggccaagguggguggaucaccugaggucaggaguuugagaccagccuggccauuauggugaaaccccagcucuacuaaaaauacaaaaauuagccaggcguaguggugggugccuguaauuccagcuaauugggaggcugaggcaggagaaucacuugaacccaggagguggcgguugcagugagccaagauugugccacugcacuccagccugggugacacaggaagacucugucucaaaaaaaaagaaaagaaaaaaauaacuacugcuaucugccacuguaaggagaguucuaaaaggguccccuccacacaggcaggcagacacacauacacauacacauacauacacacacacacacacacacacacacacacacacacacacacacaaacagaaucccuucuaugucgagcaguuauuuuuaacccuuaccacugacucaccacuaauuuugaguucuaucugauaacaaaacucuaauauaagguaccugccuacauuucaaacucaguucugugggccaacucucaauucuucagugauaugcuuauucucuucaucugaagccaugaaaauaucuaugaauccuucuuucuugcuacauauucaauaaucaagaugcuuuaucauauauuucucucuagguuuuccuugccauguccaaguauaccaaucauuuuaucaguaaaaucacuucauuuaacuaauacaguagucuucaauaucugucuccaauucuucccucagccaauccauccuacacaaugccaaaguuaugacugcuaaaauaccaauuugaauauauuaucacccuccuaaaaaaccaugucuugcuguugcccacaaaauagucugaacucggcugggcgcgguggcucacgccuguaaucccagcacuuuggaaggucgaggcggguggaucacaaggucaggagaucgagaccauccuggcuaacaccgugaaaccccgucucuacuaaaaauacaaaaaaaugagccaggcgcgguggcggacgccuguagucccagcuacuccggaggcugaggcaggagaauggcaugaacccaggaggcggagcuugcagugagccgagaucaugccacugcacuccagccugggugacagagcgagacuuaucucaaaaaaaaaaaaaaauagucucauccuggcaaaaggaaggcacacuguggccaacuuucaacugccaugccaucuuaacuuccaauuccguacaaaagcaucaaucuuagccagugguucucuucacacaccaccgaacacaccacgcacccuccugccucuacaaucuuauucacaccaucccacccccuaccccaaacaagccugucuccaucaucuccauuuaccuaaauucuacucuuccuccaaaacccaguucauucauuugguagucucacaacgcaaaguacgauucuggaugaaggugacuuaaaaacaaauuuaacaaaguuugcaagguauuugagaacuggggcucugaaaucagacuaucuaaagaucugaaaccuagauuuacaacuuauuuuauauuuaaauuuucugaacuuccauacaguauuuaugaaaggcuaauaucuaauuaaacuuuaaaggacuugugaaaauuauauaaaaccacaguauauguaaagugcugaguacaggucuauacauuuuagcuauuauuauuauuguuucuguccucaaagagcucauaucccagcucauggugcacccaaguacucacugcauaagcuuaugaccuaucucgaaagugcuugauauagaugccagucaucuauaauuuaaaaaaagaaagaagugcuugacaaaguuuacaaauuuugguacuuucauuauuaucaaaugagaaaauugaguaauagugaacauuuacuccuuuaagauauaaaauucaucacuaauucaaccagaauauuaucccaggacaucugcuuucuauacauugcuccaaugacaaaccagugaaaguggcucugaguuaaauaucuacaggaaauauauacucuucuauaaaaaaagcuaacaaaaguagcuacuuaaauaugcaaugcaaagauggcugauaaaauuaauuucuuaauaaaaagguauuauauauuuuuucuucagauuaaucauugagaguaaaggaaaggucauaaaugaucacuaaaacaauaccugcucugaaggacuuuauaaaaucuaguucaaggccagacacgguugcucaagccuauaaucccagcacuuugggaagccaaggcagauggaucacuugaggucgggcauucaagaccagucuggucaacaugguggaacccugucucuacuaaaaauacaaaaauuagcugggcgugguggcacacaacuguaaguccagcuacuuggguggcugaggcaugagaaucacuugaaccugggaggcagaggucgcaaugagccaagaucgcgccacugcacuccagccugggugacagagugagacucuguuucaaaaaaaaaaaaaaaaaaaucuaguuuaaugggaauucauacggguauacaguuaauuuacauuagccaagagaggacauuauggaauagagauuauaauucuaaauuauacacaguaucauuaauauauauuugcuauauuuaaaaacuggcagggcuuuuuuauuuuuggccauguugccaauauuguaauagauuaccaacuguaauugcccuacuacaaucaaucuuuaucuacaagcacugugcaaguggccuuccaaaauucaaacuauggugaauuaagaauucaauaaaagaguuuaccaaaagauucugaccauacagguaacaauaaacuuacaguauuuacucugguaucugaaaucaaaauagauugccaaauuuuaaacuagacauaggaggagcaauuuauacugaauuucccaccccccagaauaauucauuuuauauuuagaaaucauuuggcaucauucuuuaacccccaaugaaaugguuaggcugggauaauuaacaauauaauaccauuaaggccaggccuagugguucacaccuguaaucucagcacuuugggaggucgaggcaggcagaucacuugaggucaggaguugggagaccagucuggccaacaugguaaaacccuguuucuauuaaaaauacaaaaguugcugggcgcgguggcucaggccuguaaucccagagcuuugggaggccaaggcaggcagaucaugaggucaggagcucgaaaccagccuggacaacauggugaaaccccaucucuacuaaaaauacaaaaaauuagcccaacguaguggcaggcgucuguaaucccagguacucaggaggccgaggcaggagaaucgcuugaaccuggggggcggagguugcagugaaucaagaucgcaccauugcacuccaccaugggcgacaaaagcaagauuccgucucaaaaaaaaaaaaacauuaaauaaaaaaguuaggcgggcaugguggcaggcaccuguaaucccagcuacuugggaggcugaggcaggaaucgcuugaaccugggagguggagguuacagugaaccaagaucacaucacagcacuccagccuuggcgacaaagugagacuucaucucagaaaaaaacaaaaaagaaaauguuauuaaguaaaagacaauuagggaauuggauauucacaaagcaucaccccacagauuacaagcuaaaugcaaauauaaaaaugaaccauuacaggccaggcgugguggcucaugccuguaaucgugagaccgaggcaggcagaacaccugaggucaggaguucaagaccagccuggucaacauggugaaacccugucucuacuaaaaauacaaaaauuagcugggcaugguggcaugcgcccguaaucccagcuacccaggaggcugagacaggagaaucacuggaacccgggaggcagaggcugcagugagccgagauugagccacugcacuccagccugggcaacagagcaagacuccaucacaaaaaaaaaaaaaaaaaaaccauuacaauggagagaccuaguggucaccucaaucaaguaaucaaauuuagcaucauuaauaaugggacaaucuaaagacuguaugccuccugauccaaacguaauaugaguaccuaggaaacacucucaccaaaauuguuuaacucgaauuuaaucaagucuuuauaguuaacuuucaauuuacaugaaauacaaaguaaauaucaccacaauaagacaauuauuuuaaaaauuaugaauacaggaaaaucugcaugauaacagguaugcuggacugguaucuucaaaaagucaaugucauauuaaaaagucaagguacauguauuuuaucacaauuuuuaaaaauaauuuuuuaacaagagcuaaucuggaaaauauaaaagcgaaucuagacuggcaauauaccaaauuaaugauaguauggggguuaagauauuggagauacaucaauuaaugauaguuugggguagaggaagaaucucacucuuauauuuauacauuuacacacacacacacaacuuuuuuuuuuuugagacaguuucacucuuguugccugucgcccagggucaagugcaauggugccaucuuggcucacugcaaccuccaccucccagguucaagugauucuccugccucagccucccaaguagcugggauaacaggcgcccgacacaccuaauuuuuguauuuuugguagagacaggguuuuaccauguuggccaggcuagucucgaacuccuugaccccaggugauccacccaccucagccucccaaagugcuggguuuacaggcaugagccaccacgccuggccacaauuuaaacuuuauaagcacuauuaguuacuuaaugggaaaaaaaaaucagcucuaauuguuucuuaaugaaauuauuuaugucuggaauaugcuuuaaaaugcuagagccaaaaauaaauaaauuaauggaggagcggaggugaaaaaaacuguugaaguagcauaauggguacacccagaauucaauguauacugguuucuuuuguauuaauuuaaaaucuuaugauuaaaaaguuaaacuuuucaaucuguaauucaagaaaaaauaaaacauacaacauaaaguuuaauguauacucaaaaauaaaaauguuuugaaguuuuaaguuuaucauuauuuuucaauauccuauuuuagguaguuuauccauuacuugaaaaguuuaauucauuugagauuggugaaaaauuaaugagauuuauuauaaucaacuuaaaacuucugaaauacaaacuucuuucaaaaaguuaguauuguucauucuaacauaucagauggucucagaaaccaggacaccaugagaaaauuagacaaauuauacuuacuugugaauucagugaaacuacaugucuccaaugcguuagguaugaaagaaaggucaggaacuagcaucccuuaugaaugccuaacaauaugccagguucuacaauauaccauguucacauaauucuaacaaucacccugugaaaauaucaucccuuuauaacggauguauaucagcucaaaaagaguaaguguaucggggcgugguugcacaccuguaguccuagcuacuggggagggugaagcaggagaauccuuugggcucaggaguucaagguuacauugagcuaugauugugccacugcauuccaaccugggcaacagagcaagauuccugucucuuaaaaauauacccaaauaggccgagcgcgguggcucacgccuguaauccuagcacuuugggaggccgaggcaggcagaucaccugagguuaggaguucgagaccagccuggccaacauagugaaaccccuucucuacaaaaauacaaaaauuagcugggcauguuggugggcaccuguaguuccagcuacuugggaggcugaggcaggagaaucgcuugaacuugggaggcagagguugcaaugagcaagauugugccacugcacuccagccugggugaaauagugagaguccuucucaaaaaaaaaaaaaaaaaaaaaaaaaaaaaacccaaacaguaggaaaaaagagacacacacacacuccacgucugacauaacuaggagauacuguaacuauuaccugaaauacaauguauaaagacaaaaagcugaugguagaaugguaaaugccuuagcauaaugggagagauaaugacaaacaauccucuuuauccugcaauaccccagaaaagcucagaaaucagagggcgcuaggaaauagggcagaauacccacaaacacacacuccuaaggaaacaagagguaugguccucaguaaaacugaaucagaguggcuccaagaugagggguaucccucacagaaaagagaagugaaaugcugguaugaaaacagggagacuagguaaaaacuuaugaaaugaaugacaagacuuguagcuuucuucccccaugaagcgcuagaacccugucauacaaacucauuaccucugccaagcccuucacuauggacugaaucaugccuccccaaaauccauauguugaagccuuaaugcccaaugugacuguaucugaaaauaaggcuuuucggagguaacuaagauuaaaugaggucaaagggcacagucccaauccaauaaaauugguagcuuuauaaagagaaaaggaagagauuuuucuuuccauuauaggaaaagucaugugagcacacaggaagaaggcagucaccuacagaccaggaaaagagcccuuaccagaaccuggccaugauggcaugcugaccucacgcuuccagccaccagaauuauaaaaaaauuaauuucuguuaagucacccauucuaugguauuuuauuauagcagcccgagugacuaagacaccccuccucucuccaucauuccacccacaaagagacaggaaaauuaaaggacaucuaucugaagaaacugaaagccuucuugcccaccacccagagaaaagaaaugaagauuaaaaacacagcaguccauuagucauuaaccuugcucaugaucacaaagaucugaacaaaaccuccaacuaaaagaaagcaaccaaaacaaacagaaauaaguaagaaaaaccaaaaauaauagggagaacagaagaacaccucaaagaagcuguaauuaauauccuugaagaggaaacagaaaacguugcacccaugaaaaaggaacaaaauacuauaauacugaaacaaaggacaggagcucuuaaaaauucuuauuaaaggcuuaaacuuuuccaggcgcaguggcucacaccuguaauaccagcacuuugggaggccaaggcggguggaucaugaggucaggaguuggagaccagccuggccaacacagugaaacccuaucucuacucaaaaauacaaaaaauuagcugggugugguggugugcgccuguagucccagcuacucaggaggcugaggcaggagaaucaugcgaaccugggaggcagagguugcagggagccaaaacugcauugcacuccagccugggcgacaguacaagaccgucucaaaaaaacaaaagcuaaaacuuuaaaauucagucaaggccagccacgguggcucacgccuauaaccccagcacuuugggaggccaaggcagacagaccaucugaggccaggaguuccagaccaucccggccaacauggaggaaccccaucucuacuaaaaauacaaaaaauuagcugggcgugguggcgcacaccuguaauaccagcuacuugggaggcugaggcaggagaauugcuugaacccaggaggcagagacugcagugagccaagaucaugccacugcacuccagccuaggcaacagagcaagacuccaucucaaaaaaaaaaaaaaaaguaaaauucagugaaaguucagaaggaagagugagaugugaagaaaaacaccaaagaaaaaaauauauaaauuauaaaauucagugaaaggauugacauuccccagauaguagaauagacaacuuuuuggagaucagacgucuuaacaucuacuuugggaaccaggcaauaagggaacaccaccuucaaacuuuugagggaaaauuauuuccaaugcagaaaucucuuaacugccagucaaguaaaaggauaaaaaugaaauccaaaaugaaaauccaaaaugaaggaagaaaccaaaaggaaggcaugagauccggaaaaauaaaauucaacaaaaguuaaagaaauucccagaaugucaacuaaggaaagucccaaggugacagcuaugcagcaggccuaaagaggaaacaacccaggcuaaagcaguaaggacagcuacagaagggaugucguuuuuuuuuguuguuguuguuguuguuguuuuuuuuuuuuuuuuuuugagccagagucuugcucugucgcccaggcuggaguacagugacgccaucucagcuuacuguaaccuccgccuccuggguucaagcgaugccucagccucccagguagcugagacuauaggugcgugccgccacacccggcuaauuuuuuguauuuuuaguagagaugggguuucaccguguugcccaggcuaguguugaacuccugagcucaggcgauucgccagcuucagccucccgaagugcugggauuacaggcgugagccaccgcgcccggccccagaagggaugucuacaggaacaaauggaauggguaaguuuaucugacagauuugcccauguggaaaauuguacugagaagcauuuuauggagcuacuggaggguacagaaagacucugccagagaaaacuaagcaaaugaaaaaaaugagacaugaaaaacaaaagguuacacaagaaaauaaaaucauaguaaauuauucccucagcagagacaaauauuuagucauaugauaaaaacucugaauaugaauuuaaccuaaaauuguacaguaacaauacuggaggagaguguaguuagaaaaaucuucagacacccaucccuuugacaucacucacauuuauauaccucaaauuauuugauucuaagaaaagcugcuauuuucauuagaguuaaauccugcaacuacacuuucaaggcaaaaauucagugaaaugcucugguuuugucuugaaauacuucacagggucauuuuaaggaaaaaaguaaguuaacaaauacaaagcaaaaguacuaacaaaaguuagaagaucuauacaaauuuugcugguuacuggagucagugaaggcacacugacagcuaaugaaauauuuguugugguuugccauaaaauaauucuaaauuuuggauacccuugguauauguccacuuuuacuuuccacacuuaccaauucuacaauuuauucagucuuacaggaauauugauuaacucuccaguaaauuaccuccguaagcacuaaaaucagguuauuuucugguuuuaaaaaucuaaaauguuggccaggcacgguggcucacgccuguaaucucagcacuuugggaggccaaggcaggcagaucacaaggucaggaguuugagaccagccuggccaacauggugaaacccccucucuacuaaaaauacaaaaauuagccaggcguguuggcgagugccuauaauuccagccacucgggaggcugaggcaggagaauugcuugaacccgggaggcggagguugcagcgagccgagaucgcgccacugcacuccaaccuggccaacaagagcgagacucuguuuccaaaaaaaaaaaaaaaaucuaaacuguuuugcacuuuuccuucuuauaagaaauuuaacuuuuacuuggugagucaagcuaucacgcaagucagcuacaguacuaugauuagauggccuuagagauugugaggcaucaggcccugguacuaaauggggccauauuaguauacuuucauaauucucuuguucagcauucuuaacuuucauaucugucaaugauccuuccucuaucagcauucacccaucuuucaauuaguuauaggguuaaaaaauuaauaacuaugcuucagacucaaauaacauuuacuaaauacccugcuaggcccuuucuuauacaugcuuucauuuaacccaaauacguucuguuagaauggucaccaauguaaaaauaaagcaguucugacuuaggacuuuuuaaaagcccuacuauuaauaaauacaggagcuuaauuguuuaaucaaauuggggugcaggcuaggucuuucgagugugugugguucaguuuuguuuuguugagggagaaucucuuccuuguuuaggugucuuuauagcuaaugucugguucugacucagacuguucaaucagccagcuguggauaauugagggguuacugaaccaugcacagccaacuuagggcaacacuaaaaagagguauauaccuaaacaaacacuuggucacccauucacuaagauuuuuacaaaaagcacagagaaaugaucauuguauugcaaaucaggacuuucauauuugcaauuauaucuauaauaaaggcauauauguauucuugcuauaccacuuguuaauaccgcuauuuaagaaucuucuuaauucguuaaaacagaacaucaauucaguuaaauccaaacuuuagaaagauauaaguauuccccaaguuacgagggaaaaauuuucaccauuaaauuuaccaccaagacacuggaaaggaaucuuuuucucugauaguuuuuccucaacaagauagcauuugugucugaaaaaaugaaaaucuuacaguaguguuaauaucuugucacuacuccaaaaaacccacauaggucaugggaaaagaucauucccacaucuuaauguaaaaccuaucacuguuuauauucaggauuaauaauauuaguguuaacccucaaaagaagaaggauucuaaauguaauugaaaagacuauaaaaauuccucuuuaacagccauuucacuuuaaggaccauuuguguacuccacauuuuaaguuagaauuguuaaagaaugcuuacuuauuucuucucaaauauuccauuacuccaacuauguaauacucauauucacuuccucuuucagagaacuuacagcaaaugugcaguuuacacaccacaaacacuagugaugauaccaagcugcauauggacaaacuuccaggcacuuaucuccuaaauuuuacauauaaauuguuaaaacaaaauagcuuuaaaauacuaaucaccuggaauuccugacuaaaaguaccaaaaucccauccucaaaaccacuuuccuagaaacaacacucccagaagcugaaagauauuuacauugcaccagagucccugauggcuaugcuuagauguuaaagcuuugcuacaggcaaaaaauaucaaggaagaagugacacuauugcuacaugcacaugcagcauguuuuaaguugugaaaacaaaccauuauaauccaaacagaauuuuucaugaucugagcuacuguuagaucagcaaugcugaaacugcuugacauuucuuuuucuaaaaaacaaaaagaguuauuugacaacacuguguagcagugcacauuuauaauaaagauuaugcgcuuuaagcuugcgaucacauaaagauuugauuuucaacuaguccguauguugcacuauugucagaucauuguguauccguagcugaagugguggaaacaccugaaaaauuauacgacuagccuacauuuaaaaacaaaacugacccugucugacaagaacccuuaagaauucgccuuuuucuaaugcucaaacauucugcagccgcuugaucuggcgaaaaaucgucaaagcuccugguuuuaucauuugcugcagggaaaaaaagaauauggcugaaaauucuuucagaagggugguauuucaaacaggaccacccaaaacacuuaagaauacgcagcggagaguagggugcagggaggguaccuuacgaaacagcgcacuucgggcccugcacgcuaccucauuucccuaauagggaugaaaagcucaggccucugguagcuuccagcugacgccagugcucucuccacaccccuuuuuugacaggauuauccgggguugaacgcugugucacaaauacgaauucccgcgaccacgucuaaguggucuaacaaucaaucaagcaucuuuuacaaaaccaaacccuucccccaucccguucccuccaucucucucccuagccaaacaaaccuaggagaguccucaagauggauuuucacaaauccugcagcgcacuaacugggaggaagaaacgauacagaaaauaagagugucggccaucccccucucugcaaccgaaauuacaggcuccauuuccuguccccuugggaacugcaaaauccucugcugaaaaccggacgccucccagccccuccaggccggcgcacgcggccgccgcgcucccccuucccgggccccgugggcgccagggggcggcggggacccacggcgcccuccccucccccuccccgcacggcacccaccucggggcagcggcuucaccuccccguucuccucccgggaggccccgccggccucucgggccccaccgagaccgugccuccuccucuccuucucccgcuucuccuuaggucugcgcgacuuggcguuagccgaggcagcggcggcggcggcgggcaggaggagauggugaggcugagcgugcagcagcguaggagggaccagcaguuugcgcggcaccggcugagacaaggaagcggaggcugaggagggaacggccgugccagcggagaaagagaaacugcuccgagaagaggacggggagggagcagcagacagaggggcaaagcuccaagacgcggggcugccauagcucugaggcgaaggugcugccggcggcugcagcugccugcuguucccgccgcugcccccuucuccguucacucuccgcggugccuucuucuccucaguccggaccuucuuggcggacagagaacccggagggucccgggaggagaguugcagcuugccaaacgguucuuucuccgagacgguggcggugggggccgcggcagcgacacagugcacggggcucggcgguuccgccauuuugcgcuccuguuguauuuacucuccuccgcuagccggcgcgg

SEQ ID NO: 191449 - RNA, 83378 nt, Homo sapiens
ccgcgccggcuagcggaggagaguaaauacaacaggagcgcaaaauggcggaaccgccgagccccgugcacugugucgcugccgcggcccccaccgccaccgucucggagaaagaaccguuuggcaagcugcaacucuccucccgggacccuccggguucucuguccgccaagaagguccggacugaggagaagaaggcaccgcggagagugaacggagaagggggcagcggcgggaacagcaggcagcugcagccgccggcagcaccuucgccucagagcuauggcagccccgcgucuuggagcuuugccccucugucugcugcucccuccccguccucuucucggagcaguuucucuuucuccgcuggcacggccguucccuccucagccuccgcuuccuugucucagccggugccgcgcaaacugcuggucccuccuacgcugcugcacgcucagccucaccaucuccuccugcccgccgccgccgccgcugccucggcuaacgccaagucgcgcagaccuaaggagaagcgggagaaggagaggaggaggcacggucucgguggggcccgagaggccggcggggccucccgggaggagaacggggaggugaagccgcugccccgaggugggugccgugcggggagggggaggggagggcgccguggguccccgccgcccccuggcgcccacggggcccgggaagggggagcgcggcggccgcgugcgccggccuggaggggcugggaggcguccgguuuucagcagaggauuuugcaguucccaaggggacaggaaauggagccuguaauuucgguugcagagagggggauggccgacacucuuauuuucuguaucguuucuuccucccaguuagugcgcugcaggauuugugaaaauccaucuugaggacucuccuagguuuguuuggcuagggagagagauggagggaacgggaugggggaaggguuugguuuuguaaaagaugcuugauugauuguuagaccacuuagacguggucgcgggaauucguauuugugacacagcguucaaccccggauaauccugucaaaaaagggguguggagagagcacuggcgucagcuggaagcuaccagaggccugagcuuuucaucccuauuagggaaaugagguagcgugcagggcccgaagugcgcuguuucguaagguacccucccugcacccuacucuccgcugcguauucuuaaguguuuugggugguccuguuugaaauaccacccuucugaaagaauuuucagccauauucuuuuuuucccugcagcaaaugauaaaaccaggagcuuugacgauuuuucgccagaucaagcggcugcagaauguuugagcauuagaaaaaggcgaauucuuaaggguucuugucagacagggucaguuuuguuuuuaaauguaggcuagucguauaauuuuucagguguuuccaccacuucagcuacggauacacaaugaucugacaauagugcaacauacggacuaguugaaaaucaaaucuuuaugugaucgcaagcuuaaagcgcauaaucuuuauuauaaaugugcacugcuacacaguguugucaaauaacucuuuuuguuuuuuagaaaaagaaaugucaagcaguuucagcauugcugaucuaacaguagcucagaucaugaaaaauucuguuuggauuauaaugguuuguuuucacaacuuaaaacaugcugcaugugcauguagcaauagugucacuucuuccuugauauuuuuugccuguagcaaagcuuuaacaucuaagcauagccaucagggacucuggugcaauguaaauaucuuucagcuucugggaguguuguuucuaggaaagugguuuugaggaugggauuuugguacuuuuagucaggaauuccaggugauuaguauuuuaaagcuauuuuguuuuaacaauuuauauguaaaauuuaggagauaagugccuggaaguuuguccauaugcagcuugguaucaucacuaguguuugugguguguaaacugcacauuugcuguaaguucucugaaagaggaagugaauaugaguauuacauaguuggaguaauggaauauuugagaagaaauaaguaagcauucuuuaacaauucuaacuuaaaauguggaguacacaaaugguccuuaaagugaaauggcuguuaaagaggaauuuuuauagucuuuucaauuacauuuagaauccuucuucuuuugaggguuaacacuaauauuauuaauccugaauauaaacagugauagguuuuacauuaagaugugggaaugaucuuuucccaugaccuauguggguuuuuuggaguagugacaagauauuaacacuacuguaagauuuucauuuuuucagacacaaaugcuaucuuguugaggaaaaacuaucagagaaaaagauuccuuuccagugucuuggugguaaauuuaauggugaaaauuuuucccucguaacuuggggaauacuuauaucuuucuaaaguuuggauuuaacugaauugauguucuguuuuaacgaauuaagaagauucuuaaauagcgguauuaacaagugguauagcaagaauacauauaugccuuuauuauagauauaauugcaaauaugaaaguccugauuugcaauacaaugaucauuucucugugcuuuuuguaaaaaucuuagugaaugggugaccaaguguuuguuuagguauauaccucuuuuuaguguugcccuaaguuggcugugcaugguucaguaaccccucaauuauccacagcuggcugauugaacagucugagucagaaccagacauuagcuauaaagacaccuaaacaaggaagagauucucccucaacaaaacaaaacugaaccacacacacucgaaagaccuagccugcaccccaauuugauuaaacaauuaagcuccuguauuuauuaauaguagggcuuuuaaaaaguccuaagucagaacugcuuuauuuuuacauuggugaccauucuaacagaacguauuuggguuaaaugaaagcauguauaagaaagggccuagcaggguauuuaguaaauguuauuugagucugaagcauaguuauuaauuuuuuaacccuauaacuaauugaaagaugggugaaugcugauagaggaaggaucauugacagauaugaaaguuaagaaugcugaacaagagaauuaugaaaguauacuaauauggccccauuuaguaccagggccugaugccucacaaucucuaaggccaucuaaucauaguacuguagcugacuugcgugauagcuugacucaccaaguaaaaguuaaauuucuuauaagaaggaaaagugcaaaacaguuuagauuuuuuuuuuuuuuuuggaaacagagucucgcucuuguuggccagguuggagugcaguggcgcgaucucggcucgcugcaaccuccgccucccggguucaagcaauucuccugccucagccucccgaguggcuggaauuauaggcacucgccaacacgccuggcuaauuuuuguauuuuuaguagagaggggguuucaccauguuggccaggcuggucucaaacuccugaccuugugaucugccugccuuggccucccaaagugcugagauuacaggcgugagccaccgugccuggccaacauuuuagauuuuuaaaaccagaaaauaaccugauuuuagugcuuacggagguaauuuacuggagaguuaaucaauauuccuguaagacugaauaaauuguagaauugguaaguguggaaaguaaaaguggacauauaccaaggguauccaaaauuuagaauuauuuuauggcaaaccacaacaaauauuucauuagcugucagugugccuucacugacuccaguaaccagcaaaauuuguauagaucuucuaacuuuuguuaguacuuuugcuuuguauuuguuaacuuacuuuuuuccuuaaaaugacccugugaaguauuucaagacaaaaccagagcauuucacugaauuuuugccuugaaaguguaguugcaggauuuaacucuaaugaaaauagcagcuuuucuuagaaucaaauaauuugagguauauaaaugugagugaugucaaagggaugggugucugaagauuuuucuaacuacacucuccuccaguauuguuacuguacaauuuuagguuaaauucauauucagaguuuuuaucauaugacuaaauauuugucucugcugagggaauaauuuacuaugauuuuauuuucuuguguaaccuuuuguuuuucaugucucauuuuuuucauuugcuuaguuuucucuggcagagucuuucuguacccuccaguagcuccauaaaaugcuucucaguacaauuuuccacaugggcaaaucugucagauaaacuuacccauuccauuuguuccuguagacaucccuucuggggccgggcgcgguggcucacgccuguaaucccagcacuucgggaggcugaagcuggcgaaucgccugagcucaggaguucaacacuagccugggcaacacggugaaaccccaucucuacuaaaaauacaaaaaauuagccggguguggcggcacgcaccuauagucucagcuaccugggaggcugaggcaucgcuugaacccaggaggcggagguuacaguaagcugagauggcgucacuguacuccagccugggcgacagagcaagacucuggcucaaaaaaaaaaaaaaaaaaacaacaacaacaacaacaacaaaaaaaaacgacaucccuucuguagcuguccuuacugcuuuagccuggguuguuuccucuuuaggccugcugcauagcugucaccuugggacuuuccuuaguugacauucugggaauuucuuuaacuuuuguugaauuuuauuuuuccggaucucaugccuuccuuuugguuucuuccuucauuuuggauuuucauuuuggauuucauuuuuauccuuuuacuugacuggcaguuaagagauuucugcauuggaaauaauuuucccucaaaaguuugaaggugguguucccuuauugccugguucccaaaguagauguuaagacgucugaucuccaaaaaguugucuauucuacuaucuggggaaugucaauccuuucacugaauuuuauaauuuauauauuuuuuucuuugguguuuuucuucacaucucacucuuccuucugaacuuucacugaauuuuacuuuuuuuuuuuuuuuugagauggagucuugcucuguugccuaggcuggagugcaguggcaugaucuuggcucacugcagucucugccuccuggguucaagcaauucuccugccucagccucccaaguagcugguauuacaggugugcgccaccacgcccagcuaauuuuuuguauuuuuaguagagaugggguuccuccauguuggccgggauggucuggaacuccuggccucagauggucugucugccuuggccucccaaagugcugggguuauaggcgugagccaccguggcuggccuugacugaauuuuaaaguuuuagcuuuuguuuuuuugagacggucuuguacugucgcccaggcuggagugcaaugcaguuuuggcucccugcaaccucugccucccagguucgcaugauucuccugccucagccuccugaguagcugggacuacaggcgcacaccaccacacccagcuaauuuuuuguauuuuugaguagagauaggguuucacuguguuggccaggcuggucuccaacuccugaccucaugauccacccgccuuggccucccaaagugcugguauuacaggugugagccacugcgccuggaaaaguuuaagccuuuaauaagaauuuuuaagagcuccuguccuuuguuucaguauuauaguauuuuguuccuuuuucaugggugcaacguuuucuguuuccucuucaaggauauuaauuacagcuucuuugagguguucuucuguucucccuauuauuuuugguuuuucuuacuuauuucuguuuguuuugguugcuuucuuuuaguuggagguuuuguucagaucuuugugaucaugagcaagguuaaugacuaauggacugcuguguuuuuaaucuucauuucuuuucucuggguggugggcaagaaggcuuucaguuucuucagauagauguccuuuaauuuuccugucucuuuguggguggaaugauggagagaggaggggugucuuagucacucgggcugcuauaauaaaauaccauagaaugggugacuuaacagaaauuaauuuuuuuauaauucugguggcuggaagcgugaggucagcaugccaucauggccagguucugguaagggcucuuuuccuggucuguaggugacugccuucuuccugugugcucacaugacuuuuccuauaauggaaagaaaaaucucuuccuuuucucuuuauaaagcuaccaauuuuauuggauugggacugugcccuuugaccucauuuaaucuuaguuaccuccgaaaagccuuauuuucagauacagucacauugggcauuaaggcuucaacauauggauuuuggggaggcaugauucaguccauagugaagggcuuggcagagguaaugaguuuguaugacaggguucuagcgcuucaugggggaagaaagcuacaagucuugucauucauuucauaaguuuuuaccuagucucccuguuuucauaccagcauuucacuucucuuuucugugagggauaccccucaucuuggagccacucugauucaguuuuacugaggaccauaccucuuguuuccuuaggaguguguguuuguggguauucugcccuauuuccuagcgcccucugauuucugagcuuuucugggguauugcaggauaaagaggauuguuugucauuaucucucccauuaugcuaaggcauuuaccauucuaccaucagcuuuuugucuuuauacauuguauuucagguaauaguuacaguaucuccuaguuaugucagacguggagugugugugugucucuuuuuuccuacuguuuggguuuuuuuuuuuuuuuuuuuuuuuuuuuuuugagaaggacucucacuauuucacccaggcuggagugcaguggcacaaucuugcucauugcaaccucugccucccaaguucaagcgauucuccugccucagccucccaaguagcuggaacuacaggugcccaccaacaugcccagcuaauuuuuguauuuuuguagagaagggguuucacuauguuggccaggcuggucucgaacuccuaaccucaggugaucugccugccucggccucccaaagugcuaggauuacaggcgugagccaccgcgcucggccuauuuggguauauuuuuaagagacaggaaucuugcucuguugcccagguuggaaugcaguggcacaaucauagcucaauguaaccuugaacuccugagcccaaaggauucuccugcuucacccuccccaguagcuaggacuacaggugugcaaccacgccccgauacacuuacucuuuuugagcugauauacauccguuauaaagggaugauauuuucacagggugauuguuagaauuaugugaacaugguauauuguagaaccuggcauauuguuaggcauucauaagggaugcuaguuccugaccuuucuuucauaccuaacgcauuggagacauguaguuucacugaauucacaaguaaguauaauuugucuaauuuucucaugguguccugguuucugagaccaucugauauguuagaaugaacaauacuaacuuuuugaaagaaguuuguauuucagaaguuuuaaguugauuauaauaaaucucauuaauuuuucaccaaucucaaaugaauuaaacuuuucaaguaauggauaaacuaccuaaaauaggauauugaaaaauaaugauaaacuuaaaacuucaaaacauuuuuauuuuugaguauacauuaaacuuuauguuguauguuuuauuuuuucuugaauuacagauugaaaaguuuaacuuuuuaaucauaagauuuuaaauuaauacaaaagaaaccaguauacauugaauucuggguguacccauuaugcuacuucaacaguuuuuuucaccuccgcuccuccauuaauuuauuuauuuuuggcucuagcauuuuaaagcauauuccagacauaaauaauuucauuaagaaacaauuagagcugauuuuuuuuucccauuaaguaacuaauagugcuuauaaaguuuaaauuguggccaggcgugguggcucaugccuguaaacccagcacuuugggaggcugagguggguggaucaccuggggucaaggaguucgagacuagccuggccaacaugguaaaacccugucucuaccaaaaauacaaaaauuaggugugucgggcgccuguuaucccagcuacuugggaggcugaggcaggagaaucacuugaaccugggagguggagguugcagugagccaagauggcaccauugcacuugacccugggcgacaggcaacaagagugaaacugucucaaaaaaaaaaaaguuguguguguguguguaaauguauaaauauaagagugagauucuuccucuaccccaaacuaucauuaauugauguaucuccaauaucuuaacccccauacuaucauuaauuugguauauugccagucuagauucgcuuuuauauuuuccagauuagcucuuguuaaaaaauuauuuuuaaaaauugugauaaaauacauguaccuugacuuuuuaauaugacauugacuuuuugaagauaccaguccagcauaccuguuaucaugcagauuuuccuguauucauaauuuuuaaaauaauugucuuauuguggugauauuuacuuuguauuucauguaaauugaaaguuaacuauaaagacuugauuaaauucgaguuaaacaauuuuggugagaguguuuccuagguacucauauuacguuuggaucaggaggcauacagucuuuagauugucccauuauuaaugaugcuaaauuugauuacuugauugaggugaccacuaggucucuccauuguaaugguuuuuuuuuuuuuuuuuuugugauggagucuugcucuguugcccaggcuggagugcaguggcucaaucucggcucacugcagccucugccucccggguuccagugauucuccugucucagccuccuggguagcugggauuacgggcgcaugccaccaugcccagcuaauuuuuguauuuuuaguagagacaggguuucaccauguugaccaggcuggucuugaacuccugaccucagguguucugccugccucggucucacgauuacaggcaugagccaccacgccuggccuguaaugguucauuuuuauauuugcauuuagcuuguaaucuguggggugaugcuuugugaauauccaauucccuaauugucuuuuacuuaauaacauuuucuuuuuuguuuuuuucugagaugaagucucacuuugucgccaaggcuggagugcugugaugugaucuugguucacuguaaccuccaccucccagguucaagcgauuccugccucagccucccaaguagcugggauuacaggugccugccaccaugcccgccuaacuuuuuuauuuaauguuuuuuuuuuuuugagacggaaucuugcuuuugucgcccaugguggagugcaauggugcgaucuugauucacugcaaccuccgccccccagguucaagcgauucuccugccucggccuccugaguaccugggauuacagacgccugccacuacguugggcuaauuuuuuguauuuuuaguagagaugggguuucaccauguuguccaggcugguuucgagcuccugaccucaugaucugccugccuuggccucccaaagcucugggauuacaggccugagccaccgcgcccagcaacuuuuguauuuuuaauagaaacaggguuuuaccauguuggccagacuggucucccaacuccugaccucaagugaucugccugccucgaccucccaaagugcugagauuacaggugugaaccacuaggccuggccuuaaugguauuauauuguuaauuaucccagccuaaccauuucauuggggguuaaagaaugaugccaaaugauuucuaaauauaaaaugaauuauucuggggggugggaaauucaguauaaauugcuccuccuaugucuaguuuaaaauuuggcaaucuauuuugauuucagauaccagaguaaauacuguaaguuuauuguuaccuguauggucagaaucuuuugguaaacucuuuuauugaauucuuaauucaccauaguuugaauuuuggaaggccacuugcacagugcuuguagauaaagauugauuguaguagggcaauuacaguugguaaucuauuacaauauuggcaacauggccaaaaauaaaaaagcccugccaguuuuuaaauauagcaaauauauauuaaugauacuguguauaauuuagaauuauaaucucuauuccauaauguccucucuuggcuaauguaaauuaacuguauacccguaugaauucccauuaaacuagauuuuuuuuuuuuuuuuuuugaaacagagucucacucugucacccaggcuggagugcaguggcgcgaucuuggcucauugcgaccucugccucccagguucaagugauucucaugccucagccacccaaguagcuggacuuacaguugugugccaccacgcccagcuaauuuuuguauuuuuaguagagacaggguuccaccauguugaccagacuggucuugaaugcccgaccucaagugauccaucugccuuggcuucccaaagugcugggauuauaggcuugagcaaccgugucuggccuugaacuagauuuuauaaaguccuucagagcagguauuguuuuagugaucauuuaugaccuuuccuuuacucucaaugauuaaucugaagaaaaaauauauaauaccuuuuuauuaagaaauuaauuuuaucagccaucuuugcauugcauauuuaaguagcuacuuuuguuagcuuuuuuuauagaagaguauauauuuccuguagauauuuaacucagagccacuuucacugguuugucauuggagcaauguauagaaagcagauguccugggauaauauucugguugaauuagugaugaauuuuauaucuuaaaggaguaaauguucacuauuacucaauuuucucauuugauaauaaugaaaguaccaaaauuuguaaacuuugucaagcacuucuuucuuuuuuuaaauuauagaugacuggcaucuauaucaagcacuuucgagauaggucauaagcuuaugcagugaguacuugggugcaccaugagcugggauaugagcucuuugaggacagaaacaauaauaauaauagcuaaaauguauagaccuguacucagcacuuuacauauacugugguuuuauauaauuuucacaaguccuuuaaaguuuaauuagauauuagccuuucauaaauacuguauggaaguucagaaaauuuaaauauaaaauaaguuguaaaucuagguuucagaucuuuagauagucugauuucagagccccaguucucaaauaccuugcaaacuuuguuaaauuuguuuuuaagucaccuucauccagaaucguacuuugcguugugagacuaccaaaugaaugaacuggguuuuggaggaagaguagaauuuagguaaauggagaugauggagacaggcuuguuugggguagggggugggauggugugaauaagauuguagaggcaggagggugcgugguguguucgguggugugugaagagaaccacuggcuaagauugaugcuuuuguacggaauuggaaguuaagauggcauggcaguugaaaguuggccacagugugccuuccuuuugccaggaugagacuauuuuuuuuuuuuuuugagauaagucucgcucugucacccaggcuggagugcaguggcaugaucucggcucacugcaagcuccgccuccuggguucaugccauucuccugccucagccuccggaguagcugggacuacaggcguccgccaccgcgccuggcucauuuuuuuguauuuuuaguagagacgggguuucacgguguuagccaggauggucucgaucuccugaccuugugauccacccgccucgaccuuccaaagugcugggauuacaggcgugagccaccgcgcccagccgaguucagacuauuuugugggcaacagcaagacaugguuuuuuaggagggugauaauauauucaaauugguauuuuagcagucauaacuuuggcauuguguaggauggauuggcugagggaagaauuggagacagauauugaagacuacuguauuaguuaaaugaagugauuuuacugauaaaaugauugguauacuuggacauggcaaggaaaaccuagagagaaauauaugauaaagcaucuugauuauugaauauguagcaagaaagaaggauucauagauauuuucauggcuucagaugaagagaauaagcauaucacugaagaauugagaguuggcccacagaacugaguuugaaauguaggcagguaccuuauauuagaguuuuguuaucagauagaacucaaaauuaguggugagucagugguaaggguuaaaaauaacugcucgacauagaagggauucuguuuguguguguguguguguguguguguguguguguguguguguguguauguauguguauguguaugugugucugccugccuguguggaggggacccuuuuagaacucuccuuacaguggcagauagcaguaguuauuuuuuucuuuucuuuuuuuuugagacagagucuuccugugucacccaggcuggagugcaguggcacaaucuuggcucacugcaaccgccaccuccuggguucaagugauucuccugccucagccucccaauuagcuggaauuacaggcacccaccacuacgccuggcuaauuuuuguauuuuuaguagagcugggguuucaccauaauggccaggcuggucucaaacuccugaccucaggugauccacccaccuuggccucccaaagugcugggauuacaagcgugagccaccguuccccaccaauaguuacuuuuuuuuaugaggagcaaauaaucuagaauccuucuuaguuccuagguaagcaauuaacuguucagagucuuccagccccacccccuaauuuuccuuauuugucuucugccacuaaguuucagcauuugguuugguuuugggcccuuuguacucuucuuucuggcuuuugcuaauugcccugguauuuuucuaguguccauuguuagcacuccucaaauuuuaacuuaguccauuuuuaaaucuauauaaauugccuccuugacauuuaauauguccuuagauauuuuuuaaacuguaaaauuaacguguucaaaacuuuuagucuucuuuauccagauuugucuugcuauguauguuccuugucucaguaccauauaccuaguggcuccgucuuggaaacuggauuuguacccucugcucucauugaacuuguggccaaaucuuguuaccacucacugucuuucauaucuuuccacuuuugcucugucuuuucuacuaguuuuaguucaaauuaccauuaucucuugccaggauuauugcacaguugccuccuuagugggcucccuauuucagauccaugugcuuucacuucauucuucaugcuauauagucagagugauaaccagauaucuaaaugcauauagucuacagacauaccacccugaacccuguaucucaucuaaaugcaugucuaaucaucucacuuuucuguuuaugggaugaaguucagauuccuugaaaugucuuccacagcucuggaugaucauauucuuguuuuguucuucagguucuccucagugcuccucgccgccuagaacuuucucuacccguuuucuuuccauccccagcuccacacuuuuacuacaccuagcuaaugucugcucaucucucuaggucucaacuugagagggaggccugugcuccucuaugacuagguuagguucccuucacuuuguucuucucuuauccugacuuucuuugcuucauuuucuuguuuguuuuuuguuuuuuuugagauagagucucgcucuguugcucagguuggaguguaguggcgcgaucuuggcucaccguaaacucugccuccuggauucaggugauucuccugccucagccucccgaguagcugggauuacaggcgccugccaucaugccuggcuaauuuuuguauuuuuaguagagauggaguuccaccauguuggccugguuggucucaaacuccugaccucaagugauacgcccgccucagccucccaaagugcuauacaggcuuaagccaccgugcccagccuucuuuccuucauuuuaguaacucguuugucaucuuugcuagacugcaaguucugugaaagcugggucugugauuaucuucuuuuggaucagaccuucaacuucuggauacauauuugggaacugaaugacuugcaguauauuucagcccuuuuugccugcucagaagagaugcccgauuaucauuuagaaaaacaauuggcugguauuucaaacugaaaacagcagaagggugauaaugggauaagaaguugaccagcagcucauagacaacaggcaaauugucaaguggaaaggaaauaaacuguggguaaauaauaaccaaauuauauuugacaaauugaguuaucagaauugccauuuuguauacucuaacugcacauaguugaaacuuagcacuacauuguauaaaaaagauauuuugcauauuaauuuuuuuuuuuuuuuuuuuuuaccauuuuuauucuuuggcacauagucuugcugucacccaggccggagugcaguggcuugauuauagcccacuguaacgucgaacuccugggcucaugcgguccccuugccccagccuccugaguagcuaggacuacaggugagcaccacuacaccuggcugauuuaaaaaaaguuuuucauagauauggcuucuugcuguguugcucaggcuggucuugaacuccugcguuccggcaauccuccugucuuagccucugaaaguacuaggauuacaagugugagccaaagugcccagccuguauuguuaaagcuguguuaaccaacaacaguuugggaaugaauaaauagaaguaaaggagggaauacuuuuucuuauuuuagaauaguggcauuuugaguaauuguucuguguucagaaguaaccauguuuaaguacaguguaaauuuuuaguaaaauuuuaccuguugugcauauuuccauauauauagaauuaugagugaaaacauacauguuguguaauauacaauggaaaaaccauaggacugagaaucaggaggccuuaggagcaaauucuugcccuaccacccauuugugaucugaaggaaaggaguaaaaccugugugaggguaagggucuucaucuguaaaauaagagguuugaaccaaauacugaaaguucuuuguaagcucguuugacauuuuauaauuguauguuuuuuuuguaaucauaauaaaaauugccuaauuaaauuuucuaauuauaauaauauauguucauuguaaaaauaauucaaauuuuaggaagaaaagcaucugaaauacuguuguuuuaaugauuacauuuucacuuaguguauuauuuucacuuaguauauacauguauauaauuuuuuaugcauaugcuuuuuuauauguguacaaaucuuauauauacauacaugauuuuuuuuuuuuugagacggaguuucgcucuguuauccaggcuggagugcaguggugcagucucggcucacugcaaccuccacuccagguucaagccauuuuccugccucugccuccugaguagcuggaauuauagacacgugccaucaugacuggcuaauuuuuguauauuuguggagacggguuucacgauguuggccaggcuggucuuaaacuccugaccucaggugauccacccuccucagccucccaaaguccugagauuacaggcgugagccacugugccuggccacauaugugauuuuuuaaugcacacaacauuguuuauguguucugcaaccugcuuuuuucauuuagcaguauauuagaaauacuguuccaugucaauauguguagaacuauauuaucaauuuuaauugcuuaccuaguauucauguuugcauuauauguauaaaccauaauauauuuaacugauacuguauugugggacauuagauucuuuuuucuguuguaaaugaugcuaaaauaaaacaauguguaggcguuuauucacuuaaaacuuaggauaaaguucuaaaaguugaauuauaggggguaaggggaaaguuaaagauacauacacuuuaaauuuugauaaauaaugcuuucgugaaagauaaacaauuugcugucucacuugcauuauauaugagacuguccauuuuuuacauucuuuccaaugcuaaguuuucucagauuucaaaaucuuccauguuuugauuguugaagauuuuauuauuugcauuuauuaaugauuaagauuaaacauuuuuucacauuucacuuauauguucaugugcuuugccaagucuaagggacuuauccuuuucuuuuuuuaaaaauugauuugugaaacuuuguauauuagaauauuagcccuuuacuguugcaauuuuuuucucucuaaacuaucauuaguucauaaacauuauuuaaggggguguacuuggucuuucauacagaaguuuucuguuuuuauguacucaaauucaucaguaauuuaauuuuuuggcuuuuauuucucucucuuccuuuuuuuuuuuccuuugagacagagucucacucugucgcccaggcuggagugcaguggugugauaucagcucacugcaagcuccaccucccagguucacgccauucuccuaccucagccucccgaguagcugggacuacaggcgcccgccaccaugcccggcuaauuuuuuguauuuuuaguagagacgggguuucaccauguuagccaggauggucucgaucuccugaccucaugauccacccaccuuggccucccaaagugcugggauuacaggcgugagccaccaugcccggccucucucuuccuuuuuuuuuuuuuuaaaaauagagacacagucuugcuguguugcccaggcugaucucaaauuccuggccucaagcaguccucaugccuuggccuccucccuguguuggaguuauaggugugagccaccucgccuggcucuucuggcuuuuauuucuuagaaaaguuauuucuaccuuuaguucauaacaauauuuucuuaaauagccuauuguuauuuuauaugacauuauugauuaaaaucuuugcucuguuuagaauuuauuuagacacaaaauuaggaauccaaauuaauuuuguuccaguaauuaguuguuuuaacaucauuuauugacuaguccuuccuuuccauaaagauguagaaugcuaauguuuaucauacuaaaaucacauguguaguugggucuguuuuuagauuugcacuuuuuuacauuuaccucuguaaguuuguuucugcucaacuaacacccucauuacucuaucuuuaggauagauuugauaucuauagggcaaaaaucccgauauucuuauucagaauuuuccuggcuuuuugaaacauuauugaauuauaauuuacauaaaauagauuugcccuuuuuagguauauaguuuuaugaguuuugaugaauaguugauagccaccaguagaguaaugacauagcagauuuuuaucaccgcagaaaguucucucuugcuacucagugcucucccaucaucucuaauccaagggugaucuguuuucugucucaguaguuuugccuuuuuuagaaugucauauaaguugaaucauacacuagcuuuuucggucuagcuuuuuucacuuguuauauuacuuuugagauccaucaguacaguugcaugaaucaguucauuuauuuuuauuucugaguaguaauuccuuuuguggagauagcacaauuuggugcuacaaguugauggacauuuggguuguuucuaguauuugaagauuguggguaagccugcccuaaacauucacauagaaaucuuguaguggguggccgggcacgguggcucacaccuguaaucccagcacuuugggaggcugaggcgggccgaucacgaggucaggagauugagaccauccuggcuaacacggugaaaccccguuucuacuaaaaauacaaaaaaguuagcugggcaugguggcaggcgccuguagucccagcuacucgggaggcugaggcaggagaauggcgugaauccgggaggcggagcuugcagugagcugagauggcacuacugcacuccagccugggugacagagacuccaucucaaaaaaaaaaaaaaaaaaaaaucuuguagugggcuggauguggugacucaugcuuguaaucccaguacuuugguaggcugauaugggcaggucaccugaggucaggaguuuaagaccagccugaccagcauggugaaacccuaucucuacuaaaaauacaaaaauuagucaggugugguggcaugugccuguaaucccagcuacuugggaggcugagacaugagaauugcuugaaccugggaggcagagguugcaguuagcugagauugcaccacugcaguccaaccugcaacagaguaagacucugucucaaaaagaaagaaagauuagaguggauguauguuuucauuuuucuuggguaaauaccuagcagugggauauuuugugugugugacagagucucacuuugucgcccaggcuggaguguaguggugugaucucggcuaggugauucuugugccucagccucccaaguagcugggauuacagaugcccgccaccacacucggguaauuuuuuaaaaauuuuuagucaagauggggggcucaccauguuggccaggaaggucucgaacuccuggccucaagugauucgccugccguagccucucaaagugcuagaauuacaggcacgacacugugccuggcccuagcaguggaauuguugggcuguuaaguguaaguggccuguuaaguguguuuaaguucauaagaaacugcugaacuguuuuccaaagugguuguauuuuucauuucugccagcucuguuuuuuccuuauucagaccuccccucaagaaagaauccuaacuugauauugccaguuuaaaaaucuucagccauucuaguaguugcauaguaguaguucauuguaguuuuaauuuacauuacccuaaugaauagugauguugagcaucuuuucauguacuuauuuucuauauauaucucuuugaugaguugucuguucaaagugucuguuauuggguuguuuucuuauuaucaaauugugaaaguucuuuacauauucuggguagaacuccuuuaucagauacauguuuugcaaauguuuucuaccauucucugucuuuucuuucucuuaauacuuucacaguuuuucauagcagaaauuuauaaauuaaugaagcccacuuuauacuuuuauuucuuuuaugguuugcaucuuuuguuucuuaacuucgaaagcuuuuccuaacccuagaucacaggauuuucucuuagauuucucuaggcauuuuauagguuuagguuucacauuuagguccgcaaugcauuuugaaaacuuccgucuguaagguuugggucaagauucccuuugucuuuuucuuuguuuuuuuuguuuuguuuuguuuuuguuuuuguuuuugacaccgucucucacuuuugucacccaggcugcaggagugugguggugcgaucauggcucacugcagccuugaacucuugggcucagaugauccucccgccucagcugucuggcuccuuuuuuuuuuuuucaccauuuuuauuaacuugagaauuauucuguaaaguucuucuacccacugucacgcucuagauauuuucauuaaauuuauugauuaaacuaggaggaaauuauagucaugacagaauuaucuuuguacuuaaaagcugcauguguaucuucaucuuuuuuuuuuuuuuuuuuuuuuuuuuagacggugucuugcucugucacccaggcuggagugcaguggcucagucuuggcucacugcagucuccgccuccuguguucaagcgauuguccugccucaaccucccgaguagcugggauuacaggcgugcaccaccacgccaggcuauuuuuuguauuuuuaguagagacgggguuucaccauguugaccagguggucuugaacuccugacuucaggugaucugcuugccuuggccucccaaagugcugaaauuacaggcaugaggcaugaggcaugagccacugugccuggccuaucuauucuuacauucuuuuuuuuuuuucaaaggagacagggucuugcucuguugcccaggcuggagugcaguggcguaaucauagcucauugcagucuggaacugcuggccuuaagcuaucuucccaucuuagccucuugaguagcuaggacuacaggugagcgacaccacucccagcuguuuuuuauuuuauuuuuuguagagauagucuugccauguugccuggacucaaggaauccucucuccuugaccucccaaaguugggauuacaggcgucagccacugugccuggccguagucuuauauuauuuuauaucgucuuagagauuuuuauugguauuuaauacagauuguaaguuuucuucuaguauuuuuauuuuuaugaugggaguuuuuccuaguauauuuuugugagauuauuacuaguauauaaaaaagacuuugguuuuucuacauauaauugguaauuggauauauaauguuauaacagugagaagcuauacaauuguaaucagaaacagaaugaauuauaguaaaauacuuugugguacuucaagcauuguuuuugucuuugaaaucugagauuagcagagauaaauauuuuugguucuuaaaugcuguggcaaaguguuaagaaaaauggcaaaaucgauaaauacaauuucugccuccaaacaauguagcaggauacuuauaauauauacugcaguaaguuaaauaccauaaguagaaaguugugguguggagugagggcaggcagauacuaaggcaguuaagaaagggacaaggucccggguguggcugcucacaccuguaaucugagcacuuugggaggcugaggugggcggaucaccugaggucaggaguucaagaccagccuggccaacauggugaaacccugucucuacuaaaaaauauauaaauuagcugggcguggugcugugugccuguaaucucagcuacuugggaggcugaggcaggagaaucacuggaaccuggcaggcggaggcugcagugagccgagaucgugcugcugcacuccagucggggcgacagagcgagacugugucucagaaaagaaagggagaagagauguaggagaggagauauuugagagaaacuuugaaagggcaguaugguaggauuucagcaaagagauaaaggaguuguggggagagagaacauuauaugaacuaauauucauggcagcuagauaggaaaagcgagcucuacaaugucacagaaguuaugggaggaaauaauuucaaggcguuugauuguguuuauagcucugacauuauauauuaagccuuuuuucuuuuagcccuucacuucuugauuuuaauauaucaguguauuuuguuuuauguuuuuugagacugagucucacuguugccuaggcugguaggcacuggugcaaucacggcuucaacuucugggcucaguugauccucccaccucagucuccugaguaacugggacuacaagugcacgaccacaccuggcuaauuuuuuuguauuuuuuauagagaugagguuuuaucauguuugccaggcuggucucaaacuccuggguucaagcaaucugccugccccggccucucaaagugcuagauuacaggugugagccaccgcaccuggcccaucaguguauuuuguaagacaguuuucuacuuuaacauuuuucuagagucagugcaugucuuguauauacuuaaacaaaacaacuuuuucauuaucuauaauaagacuuugugaaggcugaauuaucucuuaaugcauaacaaacugcccuaaaauuuugugguuugaaacaauaaccauuuuauuauaucagaugauuuugugaaucacaaauucuggcaugauuggcugggugauuuccucugcuucacgcaguguugacuggaguugcucauugguguugaguugguggcuggucugguauggaagguccaagaugacuuuacucacgugccuguugcuguguuauguauggcuagauacugaacugagugaacccuucucuuucuccaaguuguuucaggaccauuccacauggucuguuaauuaggaaguuggauuucuuacguggcagcucaggacuccaagagucuugacacccagcgacauagguggaaacagcaagucuucuuaugacuuagcuuuggaagucugaaccaauuucucacugcacauacauuagggcacauaauguauguguguuuuggaaaauuucacuuggagcacauuccaauugaauuaagauugauaaagcaucuguagguguguaucuaaugauguuagcuaaauauacaacuuuuaaaaaauguagaacuuuaauugguugugugaaaaaguguaacuaagaguauauaacaaguacaacgagagucugguucccauaguuacauaugcccacacauauuguuaucauuaagaacuauguauaugauuuaccauuugcauuacagaguauaauuuaaauuguaauaaauaauguaauuguauaauguggacuuagaggucuaagaaugccccagguuguauauaugugaaacaaucacguuugauauaguagcuauagacacacgauucagugauuuaaagugauuuaauucuguaaccagauaccaccuacaauaucuuaguacuucauaucuugguuuuauaauauguugagaacagacgaaaugcuuuuauuucugcucuggagaccaaucuuuucugauaguuuagugaggaaaaccugagcuaaaauuuuucacaggccacuuuaucauguuaugccuggcaugguuuuuauguauauauguauuuaaaaaaauuuuuuuuagagacaaggucucacucuguugcucagguuggagugcaguggugugaucauggcucacugcagccucagacuccugggcucaagugauccaucugacugagccuucugaguagccaguacuauaggugcgcaccacugugccuggcuaauuauuguauuuuccguagagaaagggucucgccauauuguccaggcuggccuugaacuccuggccucaagccauccucccaccuuguccuccaaagugcugggauugcaggugugagccacuguucccagcuguauguguccuuuuuuauuuuccucuuacucuuuguguguucuugugacuauuguuauuguaguauuuuuguaacucuuuguuacugggugcuuuuguaauaaaauucuguuuauauuuaauaauaauagcuacauuuguccagugcuuaaaauuagguauugugcauaguguuggaaauaaugcauauguugccuuguuauaaaaauuguaaaaggcugggcgugguggcucgugccuauaaucuuagcacuuugggaggccaagguggguggaucaccugagguugggaguucaagaccagacugaccaacauggagaaaccccgggucuacuaaaaauacaaaauuagcugggcguggugcugcaugcccguaaucccagcuacucgggaggcugaggcagagaaucgcuugaacccgggaggcagagguugcggugagcugagaucgugccauugcacuccagccugggcaacaagagcgaaacuccguuaaaaaaaaaauugcagaagacaaguguuauuaucuauacagaugagauuacugaggcacaacacgguuaaguaacuugcuucaugucacuugaucaguuauuggcagagcuagaauuugagcuuaauauguauaauuacaaagccugaauuauuucuauuauaucacaauacauuugggguuucuuucuuuuucauuuucuuuuucuuuuuuuuuuuuuuuuuuuugagacagagucucacucugucacccaggcucgagugcaguggugugauccuggcucacugcagcaucagccucccagguucucaucccucagccuccugaguagcuggaauuacaggcgugggcgaccuugcccggcuacauuuuguauuuuuaguagagaugggguuucaccauuuuggucauaugaccucaagugaucugccugccucggcaugccaaagugcugggauuacagcggugagccaccgugcccagccuacugcuuuuuuucuuauguggauuuaacacuuauuuauggcccgcuuugugcuuggguggugguggaagaaagggagauacaaagaggagaacuuucuguuucuugccuugagauaauuuuuaauuuaauuggagagauaaauagcugcaauguaaaagacacugcucauuguugguaauuuuguuuuuuuuuuuucuguguauugcuuuuuugucuucuaugauugccuucaaaugcuuaucaauaguaauuuccuucuuuuuacuuaaaucuuuugccuccuggaaacuucauucacauugagcaucacuuauaugcaaagcaccauucuagguucuacagaagguagcaaagagcaagauaugauaauugcaaaggagcuuagaaaccaggagggcagauugagcaguuauacaaaaaaucagaauucaaauuauagaagagggaggaggaggauaugaucauuugugaucaugggcaucaaggagugcuuaguggaagaagcuaaauuucaccguaaucuuacaggauguguaggauuugggcaggaggaauugggaugggcaaucgcauuuuagcuaagggauauauuaguaaaaauauuggaguaagacauuugaguaaugaugaaucaaguaauccggaaucuuguuauauaugugggugaauaguugaagaaaaggcuaaaagaaggugagucuuaacugaagauucuugaaugacauauuaugggaguuuucuguuuuuagauaggcagagguaagcugaguugguuuauucauucguuuuaagcagaagauagugacaugguaaacuauacauuuaaggaaucuuuuuuggucacugugcuuacuugguggaaaggaaagaaacuauagguacggaaacccuuucuuuuaaaagcuagugagaauacacuagguggugacucuggaaagggaaaaaaagauggaaauauuuuaacgaaguauaaacugaacuggucaagugauuuaguguuaggggaaaauugaagaaagaaguauuauuaguguuacugaaaauuuuuuguauuuggauguuggaugaggaugugccauuaacauagagaauuggaaggagaacuugaacuuuuuuauauuagaaagaugauauuuugguguuaaauauuauggagaugaagauguggaguuuggcagagggguuggguugggagauuaauuuggagauuaguuugccacaggguuauaguuuacaucaugugagugcauuuuuagaggcaauauagagaagagagaggaaugccuaggagagauccuagguaaaugugcagguuuggauggugggauuaugagaaugagggaggagucagguaggauaguacaguuucagugaaacuuagggagaaauuuugagaaggaauugauacuguuauguugcagugagguccacggaaaaaagggcugagaagccacuggauuuuuuagcuuugauuagcuguguuagcgaggggcugugauaaaucacuucuuucccauuuacuguuugugaaguccuuucucuucuuuuuacuguauccuucaucuccuucaauuuuuauuuuaguguauguaauuguaaucauuuuguaauguaacugcuuuuccuucugcuucaaauucuuuacauuucucuucuucugccgcugcuuguucucucaucuauuucuagccauacauuauuccuggaaggaauaauguaagagagggaagguggggaaugucauuguugucguucaguucaguugauuucauggacugcguuauuauggugugaauuauggcucauggcucauauucagggcaggcaaaacugugauggugugaagcuuguuugauguuugugcagcaacaauauauugugacugaaagcuguaguaugaaauucuaacauuucuuucucucuucuuuuuuuuuuuuuuuuugagacagaguuucgcuuuguuacccaggcuggaguacaguggugcaaucucggcucaccacaaccuccgccuccugguucaaucgguucuugugucucagccuuccgaguagcugggauuacaggcaugcgccaccucgccuggcuaauuuuguauuuuuaguagagaugggguuucacuauguuggccaggcugggcucaaacuccugaccucaagugauccacgugccuuggccucccaaagugcugggauuacaggugugagccacugcgcccggccaacauuucuuaagaacuuccaguguggauuuuuaugaugcuguaauuucuuaaaaaaauuaaugaaccuauauaaagaauuuccuauacaucaaaaucugugguugaguaaaaguauagcuucuuuuucuuaaaaacuguuaagccuaauaaauaauguauguguguaugcauauucagaauacauauauaauuuauuuuuuaauucuaauuuuaauuuuuugagauagggucucacucuuugcccagacuggagugcaguggcaugaucacagcucacugcagccgugaccugcuggguuuaagcgauccucccaccucacccacccaaguagcugggacugcaggcauguaccaccaugcccaguuaauuuaaaaagaauuuuuuuggcugggcgugguggcucacaccuguaauccuagcacuuugggaggccgaggugggaggaucacaagguuaggaguucaagaccagccuggccagcauggugaaacccaguaucuacuaaaaauacaaaaauuagcuggacaugguggagcaugccuguaaucccagcuacucggguggccgaggcaagagaacugcuuuaaccugggaggcggagguugcagggagcugagaucacgccacugcacuccagccugggacacaagagugaaacucugucucaaaaaaaaaauuuuuuuuuuuuuaauagggacaggaucucucuguguugcccaggcuggucuugaauuucugggcucaagcuauccucccaccuuggccucccaaagugcuaggauuacaggcaugaaugagccuuugcaccagcuuauaauuauuucuaauuuucuccuuuuuuucuccucuugauuaacuauagcauaacaucgagauaauauauaucaagugagguagaacagcacuugaacaguuuuaauggagggagaccuuuggaaacuuuuuuuaauguguuuaugugaguacauauuauguuauauauucaguguuuuacuuugaauuuuuuuuucuuguaucuccuucuaauauacugagugauucuaaaucuuuaaaaaaguauguaucugaacauaauuauuaauucuuucgggaaggagaguuaggcuaccaacuugauuguacaaauaauacauaauauaugaaucccuuucuuuuucuuuuuucuuuuuuuuuuuuuuugagagucucacucuguuguccaggugggaguacacuggugcgcucuugguucacugcaaccugugccuccuggguucaagugauucuccugccucagccuccugaguagcugggauuacagacgugcaucaccaugcccagcuaauuuuuguauuuuuaguagagaugggguuucacccuguuggccaggcuggucucgaacucccgacuucaggugauccaccugccuugcccucacaaagugcugggauuacagacaugggccacugcgcccggccaugaaucccuuucuauuguagaaguuucaaauaauuuaggaaguaaaugaaauaaaaaccagaaguuccuugucuuucuucccuagggguaagcccccuauuuuuuuucuuuuucuuuuuuguuuuuuuuuuuugagacggaguuucgcuuuuguggcccaagccggagugcaguggugcaaucucgguucacugcaaccuccgccucccggguccagucgguucuccugccucagccucccgaguagcugggauuauaggcacacaccaccaugccuggcuaauuuuuuguauuuuuaguacaaacgggguuucaccauguuggccaggcuggucuugaacuccugaccuccggugauccacccgccuuggcuuuccaaaaugcugggauuacaggcaugagccacugcgcccggccacaaaucccuuucucuugcagaaguuucaaauaauuuaggaaguaaaugaaauaaaaaccagaaguucuuuuucuuucuucccuagggauaagccccccacuuuuuuuuuuuuuuuuuuuuugagauggaauuuugcucuuguggcccaagcuggagugcaguggugcgaucucugcucacugcaaccucugccuccuggguccaaucgauucuccugccucagccucccagguagcuggauuacaggcaugcgccaccaugcccggcuuauuuuguauuuuuaguaugaacgggguuucaccauguuugcgaggcuggucucgaacuccugaccucaggugauccaccugccucggccucccauagugcugggauuacaggcaugagccauggcgcccggccagggguaagcccuuuuaaguguucugugcauuuacauauguacauauguaaacacacacucacagaagagauuauaucguuuacuauuuuauuuuauuuuauuuuuugagauggaguuucgcccuuguugcucaggcuggguucaagcaguucuccugccucagccucccagguagcuggauuacaggcaugcgccaccaugcccggcuuauuuuguauuuuuaguagagacaggguuucuccauguuggucagguuggucuggaacuccugaccucaggucauccgccugccucccaaagugcugggauuacaggcaagagccacugcgccuggcuaagauuaucuaguuuauuuuuaaaaaccuaaauauacuauauauaugccuuuuucuguaaccugcuuuuuuuuuuaguuaacagugugucuuguagcgcuucuguuauauauuguuaaauuuauauacacauacauauacauguguaucugucuguauuucuaauuaaguuuugccuuuauaaguuuuuuaguaagcauuucauuucagaguaguuuuagauuuacagaaaaguugcaaagguaguacagaauucccauacaccauuauuaacaucuuacauuuuucuagcacguuuaucauaguuaagaaacaguagugaugcauuauuauuaacuaaaguccauacuuuauucagaauuuccuuaguauuuugucuuauauccuuuuucuguucaaggaucccauccaggauacuguauuacauuuaaucaucaugucucguuagauuccuuuuggcugagacaguaucucagacuuccaucgcuuuuaaugaccuugauuguuugagguguaccaguuagguauuuuguggaacgucucccaacugggauuugucugauguuguccucaugauuagacuggaguuuaggguuuuggggaggaagacaauaacuguaaauuuuaaaaacaaaauuuaauuuaaaaauaucgaaaaauuuauaguaagaagugucccuagcuuucccuacugauuucguguuccucagcucguuuaguaucccaucuacuuuuuuuuguuuuugagacggaacguugcugugucacccaggcuggagugcaguggcgcaaucuagguucaccgcaacuucugccucucggguucaagcgauucucuugucucagcuucccuaguagcugggacuacaggcgcgugccaccacacccagcuaauuuuuuuuuuuuuuuuuuuuugaggcagagucucgcucuuguugcccaggcuggagugcaguggugcgaucucggcucacugcaaccuccacauuccuggguucaagugauucucccgccuuggccucccaaaaugcuggcauuacaggugugagucacugugcccggccuaauuuuuguauuuguaauagggaugggguuucaccauguuggccaggauggucucaaucucuugaccucgugauccacccgccuuggccucccaaagugcugggauuacaggugugagccacugugccuggccaucaucugcuuuuuuuuuuuuuuugagauggaguuucgcucuuguugcccaggcuggagugcaguggcacucucuuggcucacugcauccuccgccuccuagguucaagcgauucuccugccucagccuccugaguagcugggauuacacacaugugccaccacgcccaacuaguuuuauauuuuuaguacagacgggguuucuccauguuggugaggcuggucucgaacucccgaccuccagugaucugucugucucggccuccugaagugcugggauuacaggcgugagccaccacgcccagccccccaucugcuuuuaauuccaaguuucugaauaaaaugcucauacuacuuuuuuuuaguuaguuuuagacauauagugcauucuuguuuagauaagaauugucacuuuuauuauuuauuuuuauuuuuaguauuuuuuucaagacagacucgcuugucacccagguuagaaugcaguggcucaguuaguagcagggacuacaggccugucccaccuuacucagcuaauuaaaaaacaaauuuuuuuuuuuuuuuuccccuguagagacaaggccucacuuucuuccccaggcuggucuuacccuccuggcaucaaguacaccucgugccugagccucccagaguguuuggauuacagguguaagccgcugagccuggccagaaugaccacuuuuauaaccuagcuucuuuccuuuuuaauaauuccacauaccuuaguuaaaacaauagucagugcuuauaaugacucugcaaaugcuguuuaaugcagaucagggagagauccuuuuauauggcuuucuucauuuuuguguaguuaaaaauugccucucuuuuucauuuacuuauguauccauugcuucauuuucucucuauucucuguguucugugauaagagaaaauuugucaggucccccuuuguuucuggaggucuuguuuuuaagagcuccauucuuguacuucagccugaacuaguuauccgcugagccaucugcacaguguuuauuuuaauacauucucaucugcucuuuuaugcuggguccuccgaucucacauugucuuccuuuguuuacuacucccuaguuuacuugagcacacccucaaauaacuuccugugacagcaugcaugugugguaauuuuuuaaaaauuuuugcuugucugaauaugccuuccugcauacuugauugauaguuuggcagauuauaaaauuguauguuaaaaauuauuuucauucgcaauuuugaaggcauugcuguauugcuuuuuagcaucuguguacuguuacuguugaagaguucauuuccauaguuaccugaucuuuuauguaaucuguuuauuuuuuacuuuccucuagaggguuuuaguacauuuuaaaaagucacgagggcuggcuauagguucacgcccagaagacccguggagcuugccuccuaugguguggcgcugcucaacagccacccugauuuggcaucauuuuuggcagagauaaacagcaguuuccugggcugucucuagcugccuucagggcuuuuucucccuaaaggcacuugcagugcuucuugcggauuaaggcagaaauuguuuuccugcaggagaacacaagauggugaagaagcuggcugucugccucauucuuacuuuuucuaauguaaaacuuuuagucuugggggauuuuucuauggggugccucgcauauuuggggaggggaaucacagaagucgauuucucuuaccaucuguuuggaguuuuaaauuucccugugacccuggagauuaucuguaccucagguuugaguucugggauauugcuaacgauagucuugauccuggauauuuguuuuugguuuucuguggggaagagugaagccagauggcuucugcucugccauuugaugaugccacuguccuuauuuauuuauuuuuuaacauauugaaaauauuuugcuggcuuauggcuguugagaagucaguagacucuuggcuguagucuguuuuuuccuuccgcuucuuuuauagucuucucuuugucuuuagcuguuuugcagcuuccauugugguguuuuuauguguggaauucuuuuuauuuauuccauguaagaguuauuaacuuucuugagucugauuuucugcccuaauuuugaggucuguauggcugcaguuggaaggagguggugaacaagaauuucuccaagguuucugggggccccauagcugcaaggucagaacagaaaugaaggcaguguccacuacugacucaccuugggagcccucaugacuuuaauaauaguggagacuagugaauuuuauugaaaccagaugagauuauuuuguuacuaagaacagguguuccaaagugguaguuacaauaagaaucaacuggcauuuguugacuguaagauucuuagugcaguauucaucuuuauuuccuaaauccauacaugcuuaauagaaguauauugggugaaugagauacauauuacacugaagcauauguggcuuauacugcuaaaucauaaguucaccauauuucugaagaucccauuuguauuuuguuuaaaauuauuuuaggcugggugcaguggcucaccacuguaaucccagcacuuugggaggcugaggguagguggaguguuugagcacaggaguuugagacuagccugggcaacauagugagacccugucucuacagaaaauuaaaaaauuagcugggugugaugguguacaccuguggucccagcuacuugaggggcuuagguaggaggaucgcuugagccugggaagucaaggcugcagugagcuguggucaugccacugcacuccaguccaugugacagagcaaaacccugucucaaaaaaacaauuauuuuaaugaguuucuuuuuuauaucuuaaucuuuaugugugggcuaaacacauacuuuauauauguuuaaaaaguguguguuuagcccauguucauuuuuccacauauaugauuucuuuuuuguucuggguugauaguaacuuagucauacauuccuucuuucuuccguucuuagauuccuuuggcuguuuggguuuaaacuguaucauaggucuguuugcaucuguuucucccacuccccuuuguauuuacuuauuuaugccuuaaaaaguugaccucauguuuuagagcagcuuuugguucauagcaaaauugagcagaagcuacagacuucucauauauccucucccccgacacuugcauagccuuccccauuauuaacauccccuaucagagugguacauuuguuccaacugaugaaccugcauuaacacaucauuaccacccaaagucuaucauuuacauuaggagucacucuugguguuauaaauuuucauggguuuggacaaacguauaaugacauguauccaccauacaccacagaguauuuuaauugucuuaaaaauccuuugugcucugccuauucaucccuccuccccacuauacccuggcaaccacugaucuuuuuauuuaaagucuccguaguuuugccuuuuccacagcgucauaugguuagaagcauacguuauguagccuuuucacacugcuuuuacuuaguaugcauuuacauuuccuccaugucuuugcauggcuugauagcucacuucuuuuuagugcugaagaauauuccauugucugaaugugcuaccuaaaggacaucaugguuguucccaaguuuugccaauuaugaguaaaccugcuguaaauguugugguacagauuuuuguguagacauaaguuuucagcuccuuuagauaaauaccauagacugugauugcuggaacauaugauaagaguauauuuaguuuuguaauaaacugcuaaccagccuuccagaguggcuguaccauuuuacauucgcaccagcagcagaugagaguuccuuuugcucuguauuuuugucagcauuugguguugucaguguucuggauuuuggucauucuaauagguguguagugguaucucauuuuuguuuuuauuuguguuuccuugaugacaucagguguggaguaucuuguccuaugcuuauuugcuaucuguauaucuucuuuggugaggugucucuuaaggucuuuaguguuuuuuuugguuuguuuguuuuuuuugaggcagggucucacucguucauccaggcuugagugcaguggcacgaucucugcucccugcaaccucugucuccuggacucaagugauccaucucaaccucucaccuaaaacucccaccucaaccucccgaguagcugggacuacaggcacgcaccaccgugcccagcuaauuuuuguacuuuuaguagagacaggguuucaucauguugcccaggcuggucuugaacuccugggcucuagcaguccgccugccucagccuuccaaaaugcugguauuacaggcuugagcuacugugcccagccugguccauuuuuaauuguuuguuuucuuauuauugaguuuaaagaguuaccuuuuuuuggauaauaacccuuuauuggauacaucuuuaccaaguauuuucuuauagucuguggcuucuuuuuagucccuugacugugucuucugcagaacagaaaauuuuaauuuuaaugaaauccagcuuuaucaguucuuuuuuuuaaucuauugugccuuuggugcugaaucuaaaaagucauugccaaaaucccuggucaucuagauuuucuucuguguuauuuucuagcacauaccacuucuccuaguuuagacuuuuuuuuuuuugguauguggauauccaguuguuccaguaccguuuguuggaaagacuucuaucuccaucaagauaaguugauuguauuuaaguggaucuguuucuggacucccuauuuuguuccauugaucuguuuguguauucuuuugccuauaauacauugucaugauuucucuuuuuauuuuuaaauaaaauguguaauccuuauauuuaguuugacuuuucagagaauuucuugcuuuuaugguguuagaauucuuacuuuuauucugagaauuaugaugagaagaucaguuacgaauuuuucccaagccugagauuaaacugugaaggauaaaaccauacaaauucuuggucacagaaauaaaugaauaaaaacugaauaagaauucuagucuuguuaggaguaauguauuauaguaaacagugaugccacggcacuguuuuccaucacuucuguauguaaagaucuagaaguggcuuuuucuuuuucauuuuuucuuugagacugagucucacucuguugcccaggcuggagugcaguggcgccaucuuaguucacugcaaccucugccuccuggguuccagugauucuccugccucagccuaccaaguaguggggauuaaaggcacccgccaccaugcccagcuaauuuuuuauauuuuuaguagagaugggguuucacuguguuggccagguuggucucgaacuccugauaucagacaauccaccugccuugcccucccaaagugcugggauuacaggcgugagccaccacacccagccuagaaguggcuuuuuaaaaggaacauacuacgauacauuaguggcagauuugauuuuuauauacaguggucugaauuauggccaaaauuucuuucuuugggauuauggauaccaauauuauagguaaauagauauuauucuacauuuggaaggcuuuuaucuuuacaaacugccucaguauguauuuucuauuuaaucuuuacacaaacuccauuuuacagcugcaacuggagaucugaaaguuugucaguuaucuagguuguagagcauaaucuugaaccuaggucuccugaguuuguagguaucccacuuuaucauagcucugccauguaacaugacuacaggaaguuuaauggaggcauuuaagguuggauuuugggcugggcgugguggcuuaggccugcaaucugagcauuuugaggggcugaggcaggaggauugcuugagcccaggaguucgagaccaaccucagcaacauagcgagacccugucucuauuaaagaaaaaauaaagaauaaaagacuggauuuugaaaaaggauaggcucuaccaaaaaguggaaaaauuguaagaagggugaaagguagguugaaaggcugagaggugagagcaagacagauguguggguuaaggacagaagugaugucacaaaaaaaugcccuuuguuuauguauagaugggauuauuuguguuugcugaggauguuuugauaucaggagggguaacugcaauuacguugucuauaacucuccugucuuggcuuugccauuguuuuuguuucuauagauguuuuucacauaauaacuucauaccuucaacuguacuugaauuauuuaauaucauacccgagugcauauucuaagauuccuuuuccuguguuaugaaauuaauaugugcccauugcagaaacuuagaaacuuuccaccuuaaauaguggaauuuuaaauguuaaauaaauuaaauauauucaauauguuaaauauuuaauuaaauaaauaauuuuaaauaauggcuuuuaauaauuuggguuaucuuucaguuuguuuuuggaauguauguauauuucuaaaguuuaaaaauaauugagucauaguguaugauaguuuuauuucccuagaagcuaguuuaauuuuauucugaaaaauauuuauguuuugugauugugguaggcuuauauagugaauauaugcuauuaaaaguuuauaguuguuggcugggugugguggcucacgccuguaaucccagcacuuugggaugccaaggcgugcagaucacuugagguuaggaguucgagaccagccuggccaacauggcgaaaccccaucuccacuaaaaauacaaaaauuagccgagugcgauggcgugugccuguaaucccauuuacuugguggcugaggcaggagaauugcuucaacccgggagguggagguugcaggaagcugagaucgugccacugcacuccagccugggccacagagcaagacuuugucucaaaaaaagaaaaaaaaguuuaugguuauuuuaaccuguaugauuacaagucagcauccugaguaccuuuaggggugcuauacaaagacuggaagggaacacagaaggauucuguggugccguuucacaaguaucuucauuuuauuacauuaauauuauacuuuaauaaaauuuaauaguuacuaaaauaauacguuuaaguugauaagauuaaauugaauuauuggaaaaagaaauguggagacguuuuaggugacuuuuuuucaguuguaauuuuaagugauauauaaauaguucauuuuguuagaaguuuaguuacuuaggaaauauuauauaaugugucuaagcuccagcuacuuggaguaacauuuuuuuuuuuuccaagauguaaucucacucugccacccagccuggagugcaguggcaugaucucggcucacugcaaccuccaccucccggguucaagcgauucuucuaccucagucucccaaguagcugggauuacaggcaugcaccaccacauccggcuaauuuuuguauuuuuaguauagaugggguuuugucacauugaccaggcuugucuugaacuccugaccucgggugauccgcccacuucggcuucccaaagugcugggauuauagacgugagccaccgcgcccggccuggaguaacauuuuauagcuagacagcagccuaugacaggauuucaaggacuuuaacaucagaaaguaagaguggcaaaccaaucagaagugugggaacacuguaaucuaauucagaaguuaaguuauaugugaacagauaaggaguuuuaucucguuuauucuccccuguaucccuaaucuuuuucuuguacucagacuguguauuuguugagucagugaauuccuguuugcuguacuuucguaugcuuggaguguuaucacuugaaaaaaaaaaacaaaaaacacuuugucaguguuauaggugaaaguaaugucuuuuaauuuguauauuauuaaugauugaaguuuaaaaauguuuauuagcacaugaauuuaauuuuuugaaaauuuauuuaaguagucuagaccugugcuauucaguaugguagacacuaguuuuaugugacuauucaacacuuaaagugaaacuaguuucaaauugagaugugucauaaauguaaaauauauguuagauuuugaaaucuuaugaaaaaauguaaaauaucucaucauuuaaaaauaucaguuccauguugaaauuauaauguguuggauccauuggguuaagcaaaauauaucauuaaaauuaauaaaauuguuuaccaauucagauuuagauuacugucuagaucuggacagugcuuauauagacaguaaucuaaucacuacaugauuaggaccuggguuaugguaguguuuauagaaaggaaaguaaggagugauuuuuaagagauuaugcaguaugcauguauacuauauaaucucuacuauauuccaggacauuucacaguucuuguauacuuccaucaugguuuuguaaucagucguaagcuuuuugagggcaaagguuuaugucacuauuuguauauccuucucuguauuuugucuuuugcugggugcauaggaagucauuugaacaaagaagaauuuaauaggcuaucaaauauuuuguuugaaguuuuagaaugcaaaugaaugaucccuagaguuauuaugcccuuuauuuaaauaucacaguaucaccaaguagucagauugagucauacuauuuuuaaaaggagccaaggguaagggaaccaacaucuagucuuauguaugccaggcucuauguagucauuuuauauauuuuuucauuuaguccuuauaguaaccauaaugaggaagguaucaauuaccauuuacagauuaggaaacugagaucaaguaauuuuucuguuaugcugcuaauccauagaugcucaauuucaacacuggcacuuuuccaucguagcuuuugcuucaccuaaaguuaguuauuuuaagugauuugaaauaaauuuaauauuuugguugacacgaagugaagaauacuuagaauaaaauguauaaugauacauuuugacaauauguauuucauauucaauaaaaagggaaauuuagaaauauuccccaaaaccugagaggaaaaagaaaaggcauuauuuguuccucauucugauuuucuuuguguauuguaauuccagaaauuuaccuauaguuugugcagauaaaugaaguuguaauuuuuucauuuuaaauauuuccuuuguuuugucuuccagauaaaaucaaagacaaaauuaaagagagagacaaagaaaaagaaagagaaaaaaagaaacauaaaguaaugaaugagaucaagaaagagaauggagaaguaaagauuuugcugaaaaguaaguuuuauucagugauuuuaguucuacuuuauuauacuguucaguaucuuuauuggcuaagugaauaaaauaagaaauguuauuuggugcugaauuuugcggagaaugaacaaugaugaggaaaugaaaaguaaauguaacaacggagaguucuaaucuguaugguaacaugucuuauaguauauuuagugagccauuaaaaaguuaaaagguuaagcuucguuaaacuuaauuucuuaaauuauuuuaaaauaaguuaauucuauguuugcauuacuagucuuacucauauuuagauaaucuaaaaggaagaaauuaagaaaaauugccaaagcaaguuuuaguaugauagggauggugaaguaagugaucuucuuaaaaauauuugacugucaucaccauaccauagucuagcauuuagagggaacauuuuacucugagcuaaaucagaagcgguauguuucuuguauguuuaagaauauccuuguuuuauucuuuuuuuucucuguuacaguugcauucauuugcuguuuauauaugagggugggguggagagaagaauuugggggguaggugguuggguaauaaguauacugcaaauccugucaauaagucugaacuuguaaagagagaauuugugguagaauagacguaaggauagucuuaaauucacucagaugucaagguaagaagaauccguggcauucgguugcuagacaacuagcgaauucacuagcuagcaaauuuacuagugcuaucauguugauaguugaugaugagaauauguugaccuugauuaacuucauauugaauuuaauuguugauaaggcuuuauauuugcuugagggggaaagaccacgacacugcauauguagcaaaauaacugguaguuuauauuaucuaagauaaagaguauuagauucuguauuuucauugcauucuuugucauguuuucagauauucguuuucuauuaucuacaugucagaacuucauuuucuacgauauucuuucaaccuugaagaaauacgucagagcuuaaguugauggcugcuuauuaguuaaugcucaugauccuuuuguucuguuucuuuugccugcauauucuaucuguguugucuaauuagauuguaagccuuugaggcaggaauugaauauaaccacacuaguuauuuauagcagcuagugaugaaugcuugaaaagucugcuuaaggccagguucggucgcucaugccuguaaucccagcaauuugggaggccgaggcggguggaucacuugaggucaggaguuugagaccagccuggccgauguggugaaaccucgucucuacuaaaaaugaaaaauuaguggggcaugaugguggacaucuguaaucccagcuacuggggaggcugaggcaugagaauugccugaacccgggagacaagagguugcagugagcugagaucaccccacuguacuccagccugggcaauagagugagauucagucucaaaaaaaaaaaaagaaaagaaaaagucaagucuacuuaacuuuacccuugguuuagcccaauagccauuuuuuuuucugauuuaaucaaauaguuuucuuauucauuugaaaauaucaugcuguaaauucuauuacuugagaaggaaucuguuuuagaaauacuuuauaaaagccucauauguucuugauugaauacuggauuccuaacauaaugugaauuaugugaauccagagauuacacaugaaaauaaaauuuaaaacagccuaaaaauugagauuuuuaaaaaaugaaauauacgauauuaacuuugaaguagacaaaaauuuaggugauauuuugaaccgaguuaaacugaaacuagugaugauuaagguaaaagaaugagauagauguggaaauuaauuugugacuucugggauguccauggaaaaauuuagggaaaauguauucacaguggagguaaguaauaauuuaauuacugccuuacaguguuaccaagauuaaaugagggaaaguaugaggaaagugccaaguauagaaucuggcucacagguacuuacuacugaguaguaaauaguuaugaaaucuuucuuguaaguauguaugagagauuaacuuugugauuaaaaagcaacaaaauuggccaggcacaguggcugaagccuguaaucccagcauuuugggaggccgaggcagguggaucaccugaggucaagaguucaagaccagccuggccaaguuggugaaaccccaucucuacuaaaaaauacaaaaaauuacggugggugccuguaaucccagcaacucgggaggcugaggcaugugaaucgcuugaacccaggaggcggagguugcggugagccaagauggugccacugcacuccagccugggcaacagagagagacuccaucucaaaaaaacaaaaaacaaaaaacaccaauaaaaccaaacuaucuccucuccucaguguguaguacauagauaauuaagugaauaaacacaugauucauugggaaaacagugcuugucgcauugaaagcacugaguguuaucuguuguuacuaucuacgagaaagaauuugcuuaguauguggggccauuucccaagugagccugugguggugguagggaaaggcaucuuuuguuguuggugacuuggaacaacaaaucauuuacuuugcugagggaaaauauacuuucauuuacuacugugugccacuuuuuuccuuguggccuccaacuuuuauucuauccuuguaauuuuuuucuucuguuaaugauaauguugcaagcugugguauacacagguguugauggaugauggcauuugaaaaucuaaaauagaugucaaguaugucacaccaauucauuuucuccagguuuuucuuaaaaauugugucagguaggcugggcgcagugucucacgccuguaaucccagcacuuugggaggccaaggcgggugggccacuugaagcuaggaguuugagaccagcuuggccaaccuggugaaaccccaucucuacuaaaaauagaaaaauuagccgggcgugguggcgcucgucuguaaucccagcuacucgugaggcugaggcaggagaauugcuugaacccaggaggcaaaggcugcagccgagauugugccacugcacuccagccugggugacagagcaagacuuggucucaggaaaaaaaaaaaaaaaaaaaaaaugugucuuuuuuuuuuuuuuuuuuuuuuuuuuuuugagaggagucuugcucugucauccaggcuggagugcaguggcgcgaucucggcucacugcaaacucugccuccuggguucaagcaguuuuccugccccagccuccugaguagcugggauuacagccgcacgccgccaugccuagggcuaauuuuuuguauuuuaguagagacaggguuucaccauguugcccaggcugauggcgaacuccugaggucaggcagccugccugacccggccucccaaagugcugggauuauaggcaugagccacugcguccggccugucaaguuuuuucugacuggaaauacacacaaaauuauauauaugauaaaaaguguuuuauuaaugcgaaaaccuuauaaaaguuuauuugguaagaaaguuggauuauuugcucuuuucaaaauaguuuaaaggaacaaauaaguuugaaacaaagcuuauuuagugggucuuauuuuauacuaaaguucaccaacugcuuuuucugauuguaugcauuauguuccaggcauuuuuauguuguuuauuaaugauaaagugugagaacauguguuaugauuauaguauuuuuuagaguaaauguuugucauuauagcauuuuaaauaaguuugcuggugagcaguuagaaugaggguugaaagaagccaguguccaaggugacugguaguguacuaaaggucacagguagguaaaucauggcuggaagagugacaacauugcagugcaaaaaaagcagauucgaaucccagaggccaaaaguugagaauaacuaagcuaauuaguacuuuuuuccuauauguaauaaugggaugggggagagagaaagauagauauaaauuuuauaaauuuuucugaauuuuguuuuucacuuuauuaauacagaaaguauacgaaaauuagugguagaauuaacucaaugaauuugugaucuuaaaaguuuuuuuuuauuuuucuuuucauaauuagccauuaacaacacaugcugucuuuguuucugugugcgcuucuuucugccucugugagugucucucucuggcucuaaguauaccugcaucucuguuucugauucccucacucccagucuggcacacucucucuggcucugacucuauacacguguguaucugugguacuuuguguguguggucugcuuugugcauuuguauguggcuuuggggagggucucccaucaacauuuuucuuuucuuuucuuuuuuuuuuuuuuuuuuugagacggaguuucacugugauacccagucuggagugcgauggcacagucugggcucacuguaaccucuguuucccggguucaagcgauucuccugccucagccuaccgaguagcuggaacuacaggcgugcgccaccacgccuggcuaauuuuuguguuuguaguagagaugggguuuuaccauguuggccaggcuggucucgaacuccugaccucaagcaguccacccgccucagccucccaaagugcugggauuacaggcaugagccacugcaccuggccaccauuuuacuucucaucuuacacuuuugaaggggcagauuaguuggauagcaguucuauucuuucuguuauagguaccugucaggauccuuuauuggguucuguuacagaauuauagauuuaggccagaugugguggcucacgccuguaaucccagcauuuugggaggcugagauggguggaucaugaggucaggagaucaagaccauccugguuaauguggugaaacccugucucuacuaaaaauacaaaaaaauuagcugggcgugguggcaggcaccuguagucccagcuacucgggaggcugaggcaggagaauggugugaacccgggagguggagcuugcagugagccaagaucgugccacugcacuccaaccugagugacagagcaagacucggucucaaaaaaaaaaaaaaagaaaagaaaagaauuauagauuuaauguggacuuuaaauacucuuuaguguaggagaagcaaauugguauuuaaaauggccuuuuuccuuauuuuaaaauuuucugcauacauaucuacugcauuucauauguagagauaggaaaugagcgagagauuacauaaagcucuuaaucuaucuggugaaugcuaguaccccaguuugguuucauguaaagaaugcauuuugccuguguccacugggauuccuaaggcuacucccagggccugugauuugcugaaaggauucacaggacucagcauaugguuguacuuauggcuaugauuuguuauagugaaggaggacaggcaugguggcucacagcucuuaucccagcauuuuggggagcuggggccggaggauugcuugagccugggaguacgagaccagccugggcaacguggcaagaacccaucuuuaaaaaaaaaaaaaaaaauacacacacacacacacacacacacacacacacacacggcaagaauccaucuuuaaaaaaauauacagacacacagugaaaggauacaaaguaaaaucaacaagaaaaauagcacuuggugcaauuucugaaagaaacuaggcacaaguuucugagaguccuuucccaauguugucacaugugaugugcuuaauucuugcaguggugaauugugacaacacaugugaaaucuugucugccagagaagcucauuaaaaacucagugcccaggguuuuucuuggacauuggucauauaggcaccauuugccuaccacaaacuaaaauuccagacucccagaaggaaaacaaguguucagcaaaaccauguuguuuaggccuggugugguggcucacaccuguaaucccagcacuuugggaggccgaggcacgcagaucacuugaggucaggaguuugagaccagccuggccaacguggugaaaccccgauuccacuaaaaauacaaaauuagccaggcgugguggugcaugccuguaauuccagcuacucaguuggccgaggcaggagaaucgcuugaacccaggaggcggcggaaguugcugugagccgauugcacgauugcacugcacccugggcgacagagugagacccugucuuaaacaacaacaacaacaacgaacuauauuguuugcacaguuuuggcacagugaagacucuuacuuauggaauggggggaacccuccaaaaauaagaguuccuagaugcuagccgagagucagccuugcaaacaggacugagaauaacagucucaggcauauuaucucuucugcauacagugcucauuucaguauuuaauuacagaauaguuuuccaugggaauuuuuuuuuuucgagacaaggucuuacucuguugccaguauggaguacaguggugugaucacaggccacugcagccuuuaccuccccaggcucaggugauccuucugccucagccuccugaguagcugggaauacagguauuugccaccacacucagcuaauuuuuguauuuuuuguagagacagugucuugcuuuguuucccaggcugcucugcugugagaauuuaacuccuugaugcucagucuaagaaucucuuggccaggugcaguggcucaugccuguaaucccagcacuuugggaggccgagacggguggauaaucugaggucaggaguuugagaccagccugcgcaacauagugagaccuugucucuauuaaaaaaauaaauaaauaaguugguuuuguuuuuuuuuuuuucuaaaggaaucucuuaacugauuucuuauugguuugcauuuuucaguuccuguuauaguaccuuuugguuuaucuucaugccuaugaaauagacuaaguguugucucuguucuauuucaaacuaauguguucuccugguaauauuuucugauuuaaccuuuuuugguguuaggcauaaguguaggauauuaaauauacuuucacucaaaugaaguuuuauucauuuuggcaacaauugcguaauuuaugcaguucuacauauauuuucaguuguauuuaggaaugucauuaaucacaccuuugcccuuuaagcuuuguuaaauucuauuuuuuauugcauuacugccuucuuucccugauuuuuuuugauuguuucaucuuucauuuugguuaguccccuguuucacuuauuuuuauuucauuuuuuuuguagagaugaggucucucuauguuccccaagcugaucucgaacuccuggccucaagugauccuccugccuuggccucccaaaguguugggauuacaggcaucagccaccaugucuggacuguuuuacuuuuuacauuuauuuuuauuuuauuuuuuucucuguugccuuggcuggggugcaguggcaugaucauggcucacagcauccucaaccuacugugcucaagccauccuccugccucagccuccugaguagcugggacuacgggcauguaccaacaugcccagcuaauuaaaaaaaaaagauuuuguagagacagggucucaccauguugccuacacuggucuggaacugcugugugcaagugauccuccugccuugcccucccaacaugcugggauuacaggugugagccaccaugccuggccuacuguuugacuuuuuuuuaaaaauuaauuuuguccuuaagauacuaauuaaccuaaauaugauauuuugauaguucauaccuagguggcaagucugaauuugauaacguuauucaagugugugucuuagcugcuuagagauagacuuuuuuuuugagggggagacgucucacucucgucacccaguuuggagugcgguggugcaauuucggcugggauuacaggugccugccaccacgcccggcuaauuuuucauauuuuuaguagagacgggguuucaccauguuggccaggcuggucucgaacuccugaccucaggugauucaccugccucggccucccaaagugcugggauuacaggugugagccacugcgccuggccacagauagacucuuuagagaauuaacacuuugccuuuuaugacuuuauacaccuguguaaugaauaauguugacagauuacuguuuuugcuucucauacuaguucuucauuggauacuuaugaauuaucacgucugugaauuuuuacagagaauuucuuaacauuaaacuucacuuuuauggauugcuaucaacuuaaaauaguuuuuguuguuuucagggcuagaauuuagugguauucauaugugcaaaagcuugacugaggcugggcacaguggcucacgccuguaaugccagcacuuugggaggcugaggcggguggaucacuggaggucaagaguucaagaccagccugaacaacauggugaaacccugucucuacuaaaaauacaaaauuagcuggucauguuggcgcaugccuguaaucccagcuacuugggaugcugaggcaggagaaucacuugaacccgggaggcggagguugcagugagccgagauuaugccauugcacuccagccugggaaacaaaaagcaaaacuccgucucaaaaaaaaaaaaaaaaguugacugaaaggaagauaagggaaaaaacuauaagccucagguagucuguuagugagacagauuuuuucauucauacuuucauuaaauauucuuauguagcaauaugccagauacuaugagggauauaaugauggaaaaggagguaucauuucacucuaaauuaauauaaagguuauuuguuucacucauaguguugauugacauauaguauacagguauccuaugagagaaacauguaacuuuuguaacauaugacuuaggagugaagugauuucaguucuaauuugagaaaugagggaaagcaacaugaaggaaaggauauaagaguugucuuuaaugcagugguccccaaccuuauugguaccagggacugauuucacggaagacagugauuccauggacagaugggaugguuucgggaugauucaaggacacuacauuuauugugcacuuuauuucuauuauuauacauuauaauauguaaugaaauaauuauauaacucaccauaauguagaaucagugggaacccugagcuuguuaaucuguauuuggagcagcucccagcacuaguaucaucucagaucguuaggcauuagagucuccauaaggagcaggcaaccuagauuccucacaugcaugguucauaauaggguucacccuccuaugagaaucuaauacugacaggaaguggagcucaggcaguaaugugagcaauggggaauggcuguaauacagaugaagcuucgcuggcucgcccacugcucaccuccugcuguguggccuaguugugacaggcuauggaccaguaccggucuguugcccugggauuggggaugccugcauuaaaggauaguguauuaguccauuuucgcacuucuauaaagaaguacccgagacuggguaauuuauaaagaaaagagguuuaauuggcucaugguucugcaggcuguacaggaagcauggugcuggcaucugcucagcuuucgggaggccucaggaaacuuucaauuaugguggaaggugaagggaaagcaggcacgccguacauggccagagcaggagagagguggugaugggggaggugcugcacacuuguaaacaaccagaugucacucacaauggugaugcagaaccaagggggaaauucacccccaugauuucaguuaccuccuaccaggccccaccuucaauuguaauuggggauuacaguucgacaugagauuugggaggggacacagauccaaaccauaucauuucaccccuggccccucccaaauaucauguccuucucacauugcaaaauucagucaugccuugccaacaguccccccaaaucuuaacucauuccagcauuaacccaaaaguucaaaguccaaagucucauuugagacaaggccaagucucuuucaccuaugagcguauaaaauauaaaacaaguuaguuacuuccaacauagagggggguggguauaggcauugaguaaauacuucuguuccaaaagggagaaauuggccaaaaaaaggagcuacagaccucaugcaaguccgaaacccagcagggcagucauuaaaccuuaaagcuccaaaauaauccccuuugacuccaugacccacauccaggacacucucaugcaagaggugggcucccagugccuuggguagccccaccccuguggcuguguaggguucagccccuguggcugcucucaagggcugguauugagggcuugaggcuuuuucaagugcguggugcaagcuuuugguggaucuaccauucuggggucuggaggacaguggcccucuucucauagccccacucugcaguacccugguggagacucagugugggggcuccaaccccacauuuccccacauuaccuuuuccaaaccauaaagguuuggaaaauuugcagucuggccaugugguagaaaagaaaagccuauugucagggaagaguucaagcaggcugcagaaauuuguguaaauaacugcagaaauuuguguaaauaaaacgaaagagccaacugcuaauagacuagacaaugggggaaaguccuagaaggcauuucagagaacguuguggcagcuccucccaucacaggccuggaggccuaguaggacugagugguuuccugggccaggcccagggcccugcugcucugcacagccucaggauacugcucccugcuccccagccaucccagcuccagcuguggcucaaaggugcccagguauagcuugagccacuacuucaagggugccagccauaagucuugguggcucuaugugguauuaagccugccaguacacagaaugcaagauucgaggcuugggagcuuccaccuaguuuucagaggcuguauggaaacaccuggauguucaggcagaagccugcuaaaggaauggagcucucauggagaaccucucuacuagggcagucacuuccacauugucagaugucuuuauagcaaugccccauuccucaguaccaguuuucuguauuaguccauucuuauacugcuauaaagaaauacuucagacuggguaauuuauaaagaaaagagguuuaauuggcucaugguucuacaggcuguacaggaagcaugaugcuggcaucugcucagcuucucgggggggagcucaggaaacuuucagucacaucaaauggauagaaaagaguucauuuguaaauaaugagcaagugaaguguauuuuaaggagaggaaauaccuuugccaguagaguuauguuuuauaagaaauuguaaauaaauaguucaguuugaccagaguaugagguacuugagggcacugucuuuggauuccagacugaagagauuauagguagacauugagagcucuugaaagcaguuuagcuaaggaaugaauaugaucaaaagaauacauaaaaauuauagaaagguuaauauggcuguagcauucaggaugagagacaguuaugcagcuguuagaccaaaaauuaagacaguggcaucaaggaauucagaaguaaucaaggaugagcuggauaauucugucaaaucacggagacaccagaaaaaaugacuugaguaaauaugacuggauuugauauuucaacauucugggaaagcaaauuuaaacagauugaaaacagaaccagaauuuaagcaguaagaaugauaaggugguaaaggaaagacacuaggcauagaugauucuuuuuuucuuuauuuuuuucuuuuugggauaggguuucgcugugucacccaggcuggagugcaguggcacgaucuuggcucacugcaaucugccucucaguucaagcaauucuccugccucagccucccggguagcugggauuacaggugcucaccaccaugcccagcuaauuuuuguguuuuuaguagagaugggguuuugcucucuugggcgggguggucucgaacuccugaccucaagcaauccacucaccucggccucccaaagugcugggauuacaggcaugagccacugcgccuggccugaagauuguuuucuaaaauauucauucaucuccuuauuucuguaaacugugagcauuugcuauaugucagaaugguagcacacacuguagauguaacuuugcucuaugcccgucugucugucugucugucucucucuuucucucucucucucugucucucucucgcuguguacaugaagagacuggcuggcugggugugguggcucacgccuguaaucccagcacuucgggaggccgaagcgggcagaucacgaggucaggaguuugagaccagccuggccaacauggugaaaccuugucucuucuaaaaacacaagaauuagcugggcauggugacgcgcuccuguaaucccagcuacuugggagacugaggcaggagaauugcuugaacccaggagguggaguuugcagugagacaggauuguggcacuggauuccagccugggcgacagagcaagacucugucucaaaaaaggcugacuaaauauugauuaucaauucuguaaaaaaugaguccuaaauauauaauucugaguaaauuuucagaaguaaacuucuuacuuagacaaaacuguuccuaaagcaugguuuuuaaaguaauuaaaauauggaguuucaaaaaacauuuuuuccaacaggugggaaggagaaaccaaaaacaaauauagaagacuuacaaauuaaaaagguaaagaagaaaaagaaaaagaaacacaaagagaaugaaaaacggaagcguccgaaaauguauagcaaaucuauucagaccaucugcucaggauugcuaacugauguugaagaucaagcagccaaaggcauccuaaaugauaacauaaaagauuacguugggaagaauuuggauaccaagaacuaugauuccaaaauuccagagaacagugaguuuccauuugucucauuaaaggagccacgaguucagaauaaccucaaaagguuggacacuuuggaauuuaaacaacucauucauauagagcaccagccuaauggaggugcaucgguuauccaugccuacaguaacgaacucucccaccugucuccuauggagauggagagguuugcagaagaguuugugggucuaguguucagugaaaaugaaaacucugcagcuuucuacgugauggguauuguucauggggcagcuacuuauuuaccugacuuuuuagacuauuuuucauuuaauuuucccaauucaccagugaaaauggagauauugggaaagaaagauauagagacaacgacuauguccaauuuucaugcucagguaagagguuuuuaguuuuauaaaauaacuuuuaauuauauauuuuuagaugaguuucuguuuuuuguuccuaauuauagggcugaaauaaaaagguaagaauauaaugaaaccauuugggaguauuaagaguaaauuacuuucuugaugugagcaucagaauuuaaaauucaauuuucacuuauguauguuuuuuuuuaaagacaauuaaugaaauaauuaagauucuguguuuuuuuuuuuuuuuuuuuuuuuuugcaaggaguggucuugaaccuaaggaaaugaauuuagccauguauuuuccaguccuuaaauaguuuucuuaccuggaaaucaccuaaaauugucuucuagcuuuaggaugcuuuaagguacuuagcaccaggcccaucacaugguagguacugaagaaauguuggccauuaaaaauauugugguaugaaggaaucaucaguuacuguguaaugauguguuaaaaguagcaaucaguauauugagcuaauuuucauuuccuacccuucucuaugguggagaauauauauuauucuggaaagcagacagaauagagucugcugggucuugaacaucagugugggcccaucugaaaggcuggugccauuaucacccauccucagauugggacuguuuagucuggagauuggccaguucucacauuuauugaugcuguaguuuuugguuuucuaggaacgguuuuugguuucuaggacaacauucuaguuuggaaggagggaaaaaguaaaggaagucucaaauggaucuuagugauuauuuaucccaacaccucucaauuuacaaauaaguaaacagacguagagagagaggaguaagguauuguuuaacauugucagcagugucaggauuagaacaaaaucuuaaucuucauccagggcuccuuuccuuauucugaauauguuccuuuuuggaugggugcucaaguuauaguuuccacuuuaaaugguagucuggauguucagucacauccacauguaccccgcccccaauaguaugaguauguuugguguauauucuguaguagauuguagucuggaaaauaaugugguguuuuuuuguuuuuuguuuuuugagauggagucagacuggagugcaguggugcgaccuuggcucacugcaaccucugccuuccggguucaagcgauucuccugauucagccucccaaguagcuggaauuacagacaugcaccaccaugccuggcuaauuuuuguauuuuugguagagacaggguuucgcuauguuggccaggguggucucgaacuccugaccucaagugaccugccugccuuggccucccaaaguguggggauuacaggcgugagccaccucgcccggccuggaaaauaauuuuuaaugugcguaugugggaauuauucucuaacauguuugagaauugaaaauuaaauauuuucuaaacuagauagggagcuauagagcauccauuacuagcccugucauuuuauagaaacccaaaauggugaguuacuugucugagguuacaccugaauauaauggcagaaucaggacuggcaucuaauaauaguguuuacuauuuauugaguacugacugugccaaggacuaguuguucugaguauuuuauauguaguaacucauuuaauccucauuauaaucuuacuuuagcagugaagaaacagauccagugagagaagagauaacauguucaaagugccuuaucaccuuaucauucauuugucguuuauugcaugucuccuaaauguccgguuuucuauugggccucuuggcucccauucccgguuauuuccacaauaccacaaacuuucuugcuuugauacuaugcaaguuugcuucaguaaccuuuuaaaugugacaguacauugaugugcaucacauuacaugcuuuucagaugguuuuucaaauaaguuuaggaauuauuuuauacuaaaugauaaaaauuuucaucuaaacuaucuaauauguacaccaugaaaacugcuuuuguuacuaaauaaaaugagaugcuggacuuguuaaucauggcagugugugccugggauguggaucucaaguccuugaugagccaccuccucugguugucaccaugucuucgggcuucuuggguaauauauauugcaaagaggaaacuccaggcagauggauccuguuuuuuaccaguugugguucuggccccauaucugugugaucugcuacccuggugaccuaagcaugucagcugcagggacuacuuuugcuucuuuagcuuuagacuuaaaggcaggaaaguacaugugcaaggcccguauuccuuuuaucacaagauucuucagaucuuauuccugugaguggggaaguuguugugugcagauuggggagguagccuuugauuuguccuuaggcacuggcuuuaugaaacugaaugggauccagaagagagagcaguaggagaaaaaugagcaugcuucuucuugcacaguucuauuucucaucccuggaguccucccaguuaaagcucucucagccuacauugaagugucccuccaggaguugauuuuauuuaguaaacuuuuuauugaaguguaauguaugacauaguauacauauuauaaauguauaacuugaugaaucuucacagggaacacacccaugauuuuaaaaagccaaauauuguuaauagccagaaaccauccccgaacccuucuuuaucaguacugugccaaccccccagucccaccacaugaacaaauacccaggugaucacuguccugacuuugaacaucacugauauauuuugcuucuuuuugaacuuagguggaaucagauaguacguacauuguugugucuggucucuuuucuguaguauaacguuugugagauucauccaucuuguguguagugguacugcuguaugguauuccacuguguuaguauaccaguguuaauauaccacaguuuguugaucuuguuaccauauggauggacauuugaguuguuuccaguuugaggcugguagaacacggaugcuaugaauauuuuucacaugucuugaugagcauauguauguguuucuuuugaguauauaccuaagauuaggauuucaggaucaaaacauaugcaccuauucaguuuugcuagguacugccaguguuccaaaguuaaaugugccuauuuacauucccaguggcaguguuucacauccuuugccacgguuaguagugucuuuuucauuuaagucauucuggugacuauguagugguagcucccugugguuuaauuuguauuucccugaugacuaaggaugucaaguaccuuuuuauaugauuauuauccaguugaauauccucuuuuguaaaguaccuguccacucugucaauuucuuauuugcuuuuuuucuaguugauuuguuggacuauuauauauguagauaagaaucuuuugucagcuaacuguauugcaaauauuuccucucacuuggugucuuaccuuuucacucauagauguuuuugguaacuagaaguuccuaaguuuaauguaaucuaauuuauaauuuauaauccauuuaugauaacuguuucuuacauucuguuuuagaaaucuuugccuaccacaaagucauuaauauauucugugaaguuuucuucuggaaacuuuuauuguuuuaccuuucaugguuaaaucuauaguuaauaaaacagcagcuaaaaguauuggaaaaauaaucuguaguucaucuggaauugaucuuuguauauggcaugagguaaagaucaggguuuauguuuuuccauauaaauauauccaaaagacccagcaucauuuauggaaaagauaccccuuccucauuguauuguagugucaccuuaaaccagcuaaucauaugugugugggucuguuucugggcucccuuugauuccauuguuuuguuugucuaauuguuacagcuuuauaauaacucuuucuauugauugauugauagauacagggucuuguucuaucagccaggcuagagugcaaugguacgaucauagugcuuuguagucucagauuccuggccucaagugauccucccaccucagcuuccuggguagcugggacuacaggugugagccacugugccuagcuuuaucauuaaucucaauaaucuagaaucgguuugccagcuuuguucuucaagauuuccuuggcucuuuacauuuccacauaaacuuucgaaucagcuuuucaaguuucaaagaguuaucugcuagaauauugcuuaguauuacauuaaggcuauagauaaguuaggguagaaucgaugccuuuacaacauugagucuuccgaucugugaucaugguauuccccuucauuugucuuuuuauuuucugucaguaauauuuuuugguuuucagcauagaggucuugcagauuuuuaagauuuauuccuguauauucaagaccucauguuguuaaucacccuuuuugagaacauggaaguuuucagcacuucuuagaauaugacauuaacauucauccugagaaacugaaacaguauuuuguacuccauuuaucuuccaacaucccccuuucccuuaucugugguacugucaugcauaugcuaguuauuuggaaugucagaaguuuaguaauuagccauggcacuauucaggaggcugaggcaagaggaucacuaggacccaggaguuugagcccagccugagcaacauagcaaggcccaugucucuuugaaaaugaagaaaaucacagcacugcacuccagccugggcagcagagugagauccugucucaaagaaaaccccaaaaaacaaaaacaaaaguuuaguaauuagguuuuaugaaauuuagaaaaaacuaguuuuccauuaaugaaugcuuguuauuagaauauagugaauaucuauucacuauauauauauucacaaaauauagugaaacuguauauuuugguggugucaaguggaucagccuacauacugcugugugaaauugcuuucaccaaaagaauugguugagacgacauuaauugagcuaaugugagucaguauucuaggggaaggaagagcagagguaccaauauuggaauguaguuuuacuuaauauaaaccacagcaaaaacaaauuguggauaauaaagccaaauuaauguuaaaguguuugcucaggaaucaaacuuguugauuuggucaugaugauuccucaguaacuucagcugcuccucaacuuacgcuagggcugcauccuaauaaaccuguaagucaaaaauauuuuuaaguugaaaaugcauuuaaaacucugauaagcagcugggcgugguggcucaccccuguaaucucagcacugugggaggccgaggcagucggaucaccugaggucaggaguuaagagaccagccuggcuaacauggugaaacuccgucucuacuaaaaauacaaaaauuagcugggcaugguggugggcaccuguaaucccagcuucucgggaggcugaggcaggaagaaucacuugagcccuggaggcggagguugcagugaaccgagaucgcgccauugcacucuagcuugggugacagagugagacuugucucaaaaacaaaacaaaaacaaaaaacaaacaaccucugauaagcccacugaaaaaaaaaauuguaaguaagcugaaccaucuuaaguccugaugccgcuugaccuaacuaugaaguuucaaccugauaaacccguaauaaagucaaaaaauuaugaguugaaccuucugaguuggggaccaucuugacuaaguucacuagguucaguucaguagaaccugcucuuguuaugagaugauaaugcuuucuacagagcagaggaaagcagaacuguagagaaaaguucuguaccugacaucuuuguaauucaguaacuauccuucaauucccuuuucugccuuuuauauucugaaaaaucuuugaucuaguuaaaacuaguccaaaagcaguauucaaaagaucuagaaaaaugugggaagacagaguagagugaagaugauagagaaaaauggugcaaaucugacuuuuauuuuuuuauuuuuuuuuugagacagagucuagcucugucauccaggcuggaguguaguggcaugaucucaguucacugaaaccucugucucccggguucaagcgguucuccugccucaacuuccugaguagcugggacugcagacgcguaccaccacaccuggcuaauuuuuuguguuuucaguagagaugggguuucaccauguugcccaggcuggucuugaacuccugacuucaggugaucuaccugccucggccucccaaagucuuggguuuacaggcaugagccaccccggccugaccuuuauuuuuuagaauauaauauaguuuggaaaauacauuuagcagcauuaaagacauuuauagcugggugugguggcucaugccuguaaucccagcacuuugggaggcugagcugggcggaucacaaggucaggaguuccagaccagccuggccaauauggugaaacuccguuucuaauaaaaaaaauacaaaaauuagcugggcaugguggugggcgccuguagucccagcuacucgggaggcugaggcaggagaaucgcuugaauccaggaggcggagggugcagugagccgagauugcgccacuguacuuccagccuggacgacagagugagacuccgucucaaaagaaaaggaagaaauucaugguaaugccauccucuagguaauuaaguagcaccauuuuuaaucgauaaaagaguauauauaguaaugcuauauguguuuuguauuuucuuauauaaugauagaagcugcgcacugcagccauucagugaugugaauggcagucccuagguugugcaaccugaugguacugaccaccaauagcuguggaacccaaaccaaguucaugaugaauuuguauccucaugagccuaguuuucuguuuuuguuauuguucuuaaauuacaaucagggcaaccaaaauaauuugcuuuaaauucuguagaaacuaaaagaugacaaauuauguagcuguuucuaugauuuuuguagugauaguguuuaucucuguaauaguaucuuguagcuuucacaaauacucauuuuuacaucuguucaacuuuauuaaacacauauacacaacacugacaaaggauuaaaacaucccuguucuuuugucuucgguuuuggaauucuuuuuacuuguauaauucuguuuuccaucuucaucuguauccuugcagguugccugaaagguuugaagaccaugugguauuauauauauuuuaacaggucaugucauuucucuaaugcuguggcccugagguuagugauauauuaggaaacuguaucaugaaaguccguuugaggauagaaacauaugcauggacuuuucccaaaguuuguaaccuguccauaucuguuagcuuuugcuguauuaaauguauaaacaaaagccucaaaacuuagugacuugaaaaaagguuucauuuaucacaguucuuugggcuugcuggacaguucuuguggucucugcuaacuuagcuggggcuauauggcuucauucuuaugucugaugauuggcagaccaguugggucuugggacaccucacuuauaugguuggugguugauguauguuagcuggguugauggccacauuuuucucaucaucccacagguuagccugggcucauuugcaugguggugguuacaggguuccauugaguagaaagaggguaagccccaguguacaagcuucugcuuguguuguguuugcuaaugucccauugacaaagggaagucacauggugaaacccagauucguguggaaaaauagacuccacuucuuuuagguuauuuauucauuuuacuuuaauuuuuuuucuugugacagagucucacuguacuccagccuggacgacagagugagacuccaucucaaaaaaaaagaaagaaauucaugauaaugcuauccucuagguaauuaaguagcacuguuuuuaaucgauaaaagaguauauauaguaauguuauauguguuuuguauuuucuuauaugaugguagaaguugugaauuauauauauuuuaacaggucauuguccaggauggagugcaguggugcgaucucggcucacugcaacuucccagguucaagugauucuugugccucagucacccaaauagcugggauuaggcaugugccaccuuggccucccaaagugcucggccuauuuaaaaaauccuuuaaauuuuuaauauuuguggguacauaguagauguauauauuuaugggguacauaagaugucuugauacaagcaugcaauaugaaauaagugcaucauggagaaugagguguccaucuccacaagcauuuauccuuugaguuacaaacaauccaguuaacaacacucuuuuaguuaaaaugugcaauuauuacugacuauagucacccuguugugcagugaaaucguaggcuuuauucauucuuucuuuuuuugugugugcgcauuaauagacuccacuucuugaugacaggaguggcaaaaucacauugcacaggagugagcauacaggccugggaagaauuuggggccauuugcaguugaccacguucguuuuagguuuucuagcaucuguauuucauucaaauauucacucagacauuuauugugcuccuguguucuaccguagggauagaaaaaggcaaauaaaauaggaauuuucucugucaagaaauaaauuagauuucugucuugucacuauguuuaaucaguguacauacucuggaacccuguacuaagaacugugagaaugugaaaacuggaguaguuguuuucuaaccacccuuccuccacuuccaaacucuaaaucuuauuuuuauuguauugugguucuaaguuauuucucagguaacuuaugucaaaguguuaacugaugauuaaaagucuauuauuuuaauaaugaaacuuauuaaaucugaucugacuguuagaccugcuucacuguagaguuggggcagaacacuagcauuuguugaauuugugcuggggccauucacuguguuaggcuacuaaaagcaauuugauguuucaucuuugaaacauugcuugccuuuguacuaaauuuucauuuugaccaauugugccugccccaugcuccccaaauacuuaagaacugaucuauacaaaauaucgugucagggaccagaugcucuaauaauaaucaaaaagcuuucccccuuuauuuuacuaauuuuaaaauggauaauacuuucguucuuauuuuaguugccguuauauggguauuuuugaaauaaaauguugguuaaauauugccuauuuugauuagaaaccaucugccagaagugauggauaauggcucccccuuguggcacagucauuuaugacauguuuagauugccucagaauguccugagcaggccuuguuuuuaaaaauaagggacucuccuccccacccgcuaaaaaaaaccucagcagaauugaaucaacagcuucugcucccaccccccucaauucuuuggcucuaauaaugauccuguuuuuguauuuucuucacauuggugcugauacaagcuaaaaauaucuguaucuccauauuuaugguggaucacuaugaagguauucugaggaacuuuuaauaucuuggaauguugauagguauacuaaaacaaguacaaaaaaaacagguuuugaaguccaaaauaguguaaugcuggaccaaauaaguaauauuuguuugcagugagacuccucagaaacuuuaauagccagugugcguggugagccuccuaaacaagaaggguuuuccaaacuuaguggacuguagagcucucucuucagggaacauguuuugggaaacagcagguuguuucaagugagucguucuuugggguuuuuuaaaaaauuacuuguuauuacuauauuugccuuuucccccuugcagcaguuuucguaauuacauaagagaaaacagcaauaaguaaaaaaucuuauagauuuguuuuuggcaacauauuuccuguuaagaauaggcuacuuuuuucccuuuguagcaagcccaccucagaauccuaaaguguuuuuuuuaaagauuacauuauauaagucgaauauuaguuuaaacaauuauuucauuuuauguuaaccaaagcuucucagauuuugguauugacacuuacuggcaauggguacaauaggucuccuacuucugcuuucuuuuuucccuucauaauauuuauagagaauauacaaggggaaaagugaaaauguggccaugauggucaugggguuuuguggggagggggaggagauuuagauuaaauauguuauauuucuucugaaggccacuauuuaaauauaagcuuuuccacaaauacauaauuaucaugccugucuuuuauuguguucugacacaucuauauaccuaaaucaagaggaacuauauguauaaucuuuguaauucagugcauuucuuuuuuuagaaagcaaguauauucuauuauuauuuuuuauuuaguuaacuuauuuuuugagacugaguuucacuuuuaucacccaggcuggagugcaguggugcgaucucgcuggcugcaaccuccgccuccuggguucaagcauucucgugccucacucagccuccugaguagcugggauuacaggcaccugccaccaugccuggcuaauuuuuguauuuuuaguagagacgggguuuugucauguuggccaggcugguaucaaacucuugaucucaaaugauccucccgccuuggccucccaaaaugcugggauuacaggcgugacgccuggcguauauuuuaaagcagugacauguuuugacuuuuuuucagguuaauuuuuuaacuacaccagaaaacugguuugauuaauguuuacuggagugaauaaaagcaaauauaguaagcucacauugagcgucaucaggaugugagguuuuccagauaggcuauuuuuuuaguuaauggaaacguaguuuuaaguauuaagauuuuauaaaaauaucuucauugcugaacauaugcaacauaaugucacuuuauuuucaguauugguuugucauuaugauacaauacugaugccuuagggcagcugcagcugugcuuacccuuuuuccuuccuuccccuucuaaauaugugguuucuuguccuuuaugauuuuagagaguaguuacgauugugccuaauauaggaacugauagguaagaagaagaacuuuuaugagccauggucuuugugacauuuacugugauuauuuagagauucuuuuaauccuuaucuguuaccucuuccaccucaccgcccuugaguucuucgcagucuggcauagucuggauaggugauuuuuagagaaaugaggcuugauuuuuuuguaauaggugaauucugcauauuugguauauaguuuugcaacaaaagaggugucaccaaaaucaagaaguauuuacauuuuugugaaaagcguguggauuuuauucuuacauuuuauuuuaacaacuuaaguaccaucauguauuuuaucaagcaguauauacuuuuuaaauuggaaacauuguuguguguaacuugccauguuuauaacauuuaaguuaaugguuacaacugauggauuugaaauauuguguuauuaaacuagaaauuuguaugaaaugauauauaguuaaagguuauauuacaauauauuuuaaaauuuaauacuuuuacagauuaagauuuugaugacuucaauuuaauuuuuuaaauuuggucuaaguuuaaauauguuuauucaggugggugaucaucauuuuaucuuuacuguuggagaauaaagguuuuggaagaucauugccguuuuguuuuaaacaugugagagcuaagcaguuuuuauaaaggccaauuuccuaauaggauuuauuuuugguuuuauuagugggcaaauggcaucuaccuguacauucugguuacaagggagagacuuauacuuuuguuauaauaaguuaugugugaaagugaauuuuacauaucuauauguuuuauauguauuuuggcaugaggugggaagaacuaacuaaaaauucaauuaagauauuuagcaauauaaucggaguagagucuguauuacuuuacuuuaaaaauucagggucucuaaaaaauccuuugaaauaguuaugaauuuuaauaggaccauacuuaaaaauaaucagcaaaagauaaagccucuucuuagguagugcccaaacuagacagagaaugggggaaaaaucgguuuuugauuuauucagucuauuauguuaaacauuuuaauguuuaggucuauacuaauuuagacguguuuuguuuuauuuugaaauaaaaagcauuauuuguaaacuuggaaauuaauguaaauguauaauuugaaagaaaugagauggcuaggucaguaauacuucuucagucaaugaaauaauuauucuaaccugaaauagcaacaucuggucaaagcaaaauuaguaaauaaaguucuugagucaugacacaacauaugaugugucuguaauauuaccacccaaguuuuacccaauuuuuuccuguuacucaaugauacauguuuuuacucacauuuaaauacauaaauuuuacucuacaaggacuguguuaacaauugguuccgguuuucugauuauuauauuaucuccuacucucuauaauuuaauaauguuauaguuuuuugguuuuauuucauguauaauaugacuuuuuaaaacuacuagauaaauugaaaguuuaguugugcuucguauuuuagaagaauucacuuaaugaaaauucuuuccuaacagucauccccuccgcacaagauaaacugcccaaauuauuuaggugaucauuguugguacugugaugucauagaaugaaccaacucaguggcaaggacuugauuauggcuuuguuagaacuaaauguuguagguaucuaauuuaaacaagauaaggaaauuuaugcacagaaaauguacuuauuuguaugagguggaaauauauauaauuugacuuuuuuuuuuuuuuuuuuuuggucucgcuguguugcucaggcagaucuugaacuccugggcucaagugauccucuugccucugccuucuggguagcugggauuacaguuucgugucaccaccccuaacucuaauuugacuuuuuagauauauuucaaagcacuuggaaaauuuguguuuuacaauaucaguuguuugauuucacuuucuaaaugguuaucgucucucaaaaccccuuauggucauuugcagacacaaaacucagaaucucagaaucacuuaacagacuugauguguucuauucugguaaaugugcuagaguugagauugauacccuuagcuucuuugauagacugcauuacagaggugcauagacugaauuucuuacugugcugcuauuaaugcaucuagagccugaagacuguuguagaguuaggcuuuaacuguuagcucucuugauauuggagaugauaggaauuuuuaggcgacaggaaaaagaugagacaaugagcauacaaugggggcauaagccccagcuguucuuauauuuguuuguuuuuuugagacaggaucucgcucuguugcccaggcuggagugcaguggccugaugacagcucacugcagccuggaccugccaggcuggagauauccucccacuucucaaagugcugggcuuacaggcccuuaauuuucuaacuuguaggaaugguuugugguucugagaagucaauuuguaacaguuuaggaaaauuuaggcuuagaaaucuggugaauuuauuaaagaauuaaugucauuauuaaacugcuuugcugauuauaauaacaaaugagauucucuuccuuaaaugauuuuguaugaaaacauguggguugggguuuacuuuguuacguugugauacucuuaccagcuaugauuguaaggauucaacuuuugaugugacuaucuuuuauaaucugugucugugaugugauaaaaguugaccauccauguuugccugaaauacaagacuuucaguuuuaagacugauaguccugggcaaacugggacaaauuggucuccuaaauuuguuguccacaaaggcuaauccagagaaagagacaauuacaguuuugcuuauaauuugguuaucaaaacgaguuguuucgcuugaagacagacucagcuuguuuacuaguguuaguauaugaaaacacauagguuucuuugucaggauuuaaauaugcuggcaagaaauguaguuaccaaucaaucuugaggugcacauggcuuuguuuuggcucuuugaaugccacccauuugcuagcauuauggcaggugaguuuauaucauuaucaaauuuucuucagcaaucugcuguaaaacauuccaguuaaggaaaccacagcucaaggaacgcaaaugauuucugaaggucauguaacugguagauagcaaaggcagauuuggauuuuaggauuccugauucuuaauuucuuucuuucuuuuuuuuuuuuugagacauagucucgcucugucgcccaggcuggagugcaguggcacaaucucggcucauugcaagcuccgccacccagguucacgccauucuccugccucagccucccaaguagcugggacuacaggcgcgcgccggccaccacacucggcugauuuuuuuguauuauuaguagagacgggguuucaccauguuggccaggauggucuugaucuccugaccucaugauccgccugccuuggccucccaaagugcugggauuacaggugugagccacugcgcccggcugugauucuuaauuucuaguaguuucucaugagaguuaauaauagguauauaaacugguuucuaguuaauaugguaagaucaaaaaagaagagcaucccugguggccuuuuagucauauaagccacuguugaugguuaaauguuuucagagggucuaauuuugaaaauguugaugaaaagauaugaacuucauuucacuuuagaaaaaugcagguacaccaacuuuugaauacucagauaaugaguuccucuguucuaaggagauguuaguugucuagaauuaaugcuuauuugucuuaacucuguuuucauaagcaguguguaggaauaguuagagaaaguaaaauagcuugauuuagugcaaguuuuauuuuuaaaaugccuuaucuguuacuguuaguaaaguuuuguuuugcuugccucauuaugauauaauauucugagauaauaauuuauugcuacaaaaugauagcaagcauuaucuuauguguaacuuuuaauuaaauccauauucuucagguaaaaagaacguauuuaacuuuuaauuaaauccauguuucuucagguaaaaagaacguauucucaugguacuuacagagcuggcccaaugagacaaauaagcuuggugggagcaguugaugaagaaguaggagauuauuucccugaguuccuugacauguuggaagagucaccauuuuuaaaaguaagagacaaucugucaugggauuagaguuuuuuuuuuaaaaaagggaagaaaaaccaauaugaguaaucuaaauugugauuguuucuuucaugcuacaugcaauauaaaugaauggcuguuucagaaauagaaacguuuugguuuuauuugaacuggagggaaggagagcaagagaugggaaacugacauaauucuuguguaguguguacaugcgacaucucagguucuaauuguaauggcaaagcuaaguggugggccaugaaauaacaccucuuaacacuuuaggaaauuagguuccauguguuuaucagcucuuuguaaacuaaguacuaaaggacuuaagaaguacaggaaggauucuacuacaaauguuuaagacaaaggaauggcaguuuagcauuccuaaacuaaauuccaggaaaacucgccugggaaauuacacacccauauuuuagccauggcuguacuuaucuggguugggcaagcccuuuaaacuuucugggcuucaguuucaucauccauaaaauaacauguuuagacaauguagccaaaggccccucuauuuaauuuauuuuuuugagacagccucacucucugcccaggcuggaguguagugguguaauguggagcccugaccuccgugggcuuggaugauccucccacgucagccucccaaguaccucggauuacaggcacaugccaucaugcccagcuaacuuuuguauuuuuuguggaaaugggguuucaccauguugcucaggcuggucuugaacucuuggacucaagugauccuccugucuuggccuuccaaagugcugggauuacaggugugagccacugugcccaccaccacaggccccuuuaaauaguuuguagccagauuccuuuuuuuuuuuuuuaaagccucuugauuuucaaaaaguauuucuuauugugaggugcuagggcuaucccacugagagaggaaucucugagcugugugguuagguuaauuauuuaaucaguaacucaaaggucaaugcugcaaaccuacacugaaauucaggguccagguaagcuguggaaugugacaagauuucugauaccacauaaucuauaggacaucucuucuuuuauuacuucuguuugcuugguguuuuuacccuauauguacauauaucuuuuucuucccuuucucuuuaaccuuguuccauuccuuuuucucuuuuccuuuuaaacuuuuuguuccuuuucuacuucucucuaguaguuacaucauggaauuagguugcauuuauuauuggacuauauuuaaaaauuaccaaauauuacuuaaaugguugcuucaaguuuaauuuucaaagcacaugaacuaaaugcauuauuucuccuuuccuuuccuuccccuuccccuucccuuuccccuucccuuccccuuccccuucccuuuccccuucccuuccccuuccccuucccuuucccuuucccuuccuuucuuucgaugggguccugcuauguugcccaggcuagcuuugaaguccugggcucaagcaguccuccugcuucagccucccaaagugcugugauuacagacgugagccacccacacccaaccuaaaugcauuguuucuaaagaaauuugacaagccuuuuugaaaaggggguguguggugaaauuuuuuuuuuuuuuaauuuuguucucaacauuccauggacaguggcccucaguuuccuucuucccucucucugucuuuuuuuguuuguuuguuuuugguuucagauggagucucgcugugucauccaggcuggagggcaguggugcgaucucggcucacugcaaccucugccucucagguucaagcaauucucaugccucagccuuucgaguagcugggauuacagacacacacuaccaugcuaggcuaauuuuuuguaucuuuaguagagaugagguuucuccauguugcccagucuggucucaaacuccugagcucaggugaucugccugccucagccuccugaaguguugggauuacaggccugagccaccgugcccggccaccgucuucucuuuucucuuccccuuccccuucaccucugucucucgccucgccuccccuccccuccccuccccccuuuuucccucccccuuccccuccucuccccccucccccuucucccucccccuucccuuccucugcccccuccccccuucucccuccccccuucucccuccccccucccucuccuuucauucuuuggagucucguucugucaccaggcuggagugcaguggcgugauuucggcucacugcaaccuccgccuccgagguucaagcgauucuccugccucaaccuccugaguagcugggacuacaggugcgcgccaccaugcccagcuaauuuuuguauuuuguagagacgggguuucaccgugcuggccaggacggucucgauaucuugauaucuugaccuugugauccgcccgccucggccucccaaagugcucggauuacaggcgugagccacugcgcgcccagccuuguucuuucauuuuaaaauacuuuagucucugguuuaagccaacaaccucuucaagaaacugcugaacagaaauauguuuugauuuuguuuuguuuuguuuuuaauuaucauuaaucaaagagguauccaguuuuuaaacuuaaauuuaauuguucauuuuuauagauucuuaugagagcacuugcuuauuuaguccguuaacaucauaugaucuauaugguagaaggaagaauaacaaaugaugaauauagugaaucauaccucuagcaggguauagggacagaaccauccaagcauaauuauuuucuugguguguuugaaacaguuuuuugaagcaaaguauaucaauauauagggauauauucaauauuauguauuucagaugcuuaaguauaaagcuguguaugaaaguguguuugucaggggaacaauauuauuauuaacauacacuugaagauacauuuugaaaauaauugcaaucugcauaauuauuuaucuccaguguacacugccaugggggacgcuaucuagucuaaaauuacagagucgaaaagauagugaugauggucccaucauguggguucguccaggagaacaaaugaucccuguggcugauaugccaaagucaccuuucaaaaggaaaagguauguuguauacacauuuuuauuggaggggaugaguguuuguauguugggguguguauguuaguugaaaauuggaggaaggaggaaugcaaaguuuagagcauaauuggaauauaaauuuaaaaauagcgauacaugcuaauacaauuuguuauaaaaccuaaaauguaaauaaagcaugagaaauguaggcaaaugacaagaaauuguaaugauggauggaaaaaaugucauaagauauaaacuauuuuagaauaaauguaauauucagaaccuauacuaagaagacuaaaauguuuuguggaggauauaaaguaagaucagaacaaauggaaagcccugcuguguucuggauuggauaaaaaugauaguucuuuaaaauuuucugcauuucaauuggacuaacacuuccaguccuggauaaaauuauuuuaaaauucauaaggaaguaaacuuuucagugaaagagaagauuagugagaggcagcuuaugauacaggauauuaaaaauuacuauaaaguucaaauagaucauuggaauaagaguccagaaauagaucuaaguauauugggaacuuaauauaugagauaggugggaagaggaagauguauuuaaugaauaaugcuggcauauuuggcucucauaaaaacaaaggcagagccccuaccucauacaagaaguaaauuagagaauuaagcaucacagauaaaacaguuaaaauauuagaauaaaauuguuuaagccuggaggagaccuuccuaagcaagaccaaacaaugcaguggcaauaguauuugggggggaagcgacaucaacaaugagguucaaaauuaugauagacuggacuaagacauuuggaacucaugacacaccaaaguuaauguacaaagagcauucucaaguguaaacaacccaguagaaaaauaaccucagguaguuaaguuuauuuuaaaagaacuaugagauauuuuuauucauuauauuggcaaaaauuaugaauauagcauuaauauuauaggcugguagguaugugaagaaacaauuuuuuauauauuguugacuggaggaugagcugcuguaauuuugugaaaguaaucuggcaguagaucauaaaauuuaacauaaaacucuuugaucuagcacuccuacuuuugggaaucccaaggaauaaaaacacgaaagguaaauaaauuugugguaagaaaaacauuuuaaaauggucugaaugccugucaguaggggaaugguugaauagauuucauacauucuuauugaagaguauaguuaggccgggugcaguggcucacgccuguaaucccagcacuuugggaggcugaggcggguggauuaccugaagucaggaguuugaagaucagccuggccaacaugaggaaaccccgucucuacuaaaaauagaacaaauuagcccagcguggugggacaugacuguaaucccagcuauucaggaggcugaggcaggagaauugcuugagccugggagauagagguugcagugaacccagaucgcuucacugcacuccagccuggccgauagagcgagacucuguuucaaaaaaaagaguauagugaaauacgccaggugcaguggcucuuucauguaauccuagcacuuuggguggccgaggugggaggauaacuugaaucccaagaguucaggagcagccugagcaacauagugagaugccgccucuacaaaauaaauuuaaaaauuuagccaauguggugguacaugcccguagcccuagcuacucggaaggcugagucaagggcugcuugagcccaggaguuugaggcugcaguaagcuaugaguacaucacugcacuccagccugggugacagaaccagaaccuaucucuuaaaaaaaaaauggugaaauaguuaaaguuuuaaaaaaugucuugaucuggauggauauucaugacauuugaaaacagccaaauguagaguaauguaucuaauaugauuuuguuuuuauccaaagaaauaacaaaacccuacuaugugugauuguguacuuaugugagcacagagaaaaguguggagaaaauguacauuagguuaacguggauuggaauggauggagaugaugcuaggagagauuauagccuuuuguuuuguuuuguuuguuuguuuuugagacugagucuugcucugucgccaggcuggagugcaguggugcaaucucggcucacugcaaccuccaccucccgguuucaagcgauucuccugccucagccucccgaguagcugggacuacaggcgcacgccaccacacccggcuaauuuuuguauuuucaguagagaugguguuucaccauguuggccaggauggucuugaucucuugaucucgugauccuccugccucggccacccaaagugccuaggcaugagccacugugcccguccugauuauagcuuuuuagauuaccuaaagacgguuuuagcuguuacagugauuauuaaguuuacugguuacggugauuauuaaguuaaaaagaaaacagggaaaaagucauugaguaaacucuggguugcaugauggcagggacuuuguuggguuuguuacuaauguuucucuagcaccuaaacacagugucuggugcuuaauauuggaugaauaaaauuuuacagguuaauuuguaaguuaguaguaaaugguaaaauugauguguuccucagcgacucuuuuuuuuuuuuuuuugagauagagucuagcucugucacccaggcuggagugcaguggcacaaucucggcucacugcaaccucugccuccuggguucaagugauucuccugccucagccuccucaguagcugggauuaaaggcgugaaccaccauucccagcucauuuuuguauuuuuaagagagacgggauuucgccguuuuggccaggcuggucucaaacuccugaccucaggugauccaccugccuuggccucccaaagugcuaggauuacaagcgugagccacugugcccggccuccucagugauucuuaauuuuuuuuucuuuuuuuuagaauguauggaucauuuugagaaucugaaagucucuucucagaacaauacagauaaauacaaacuuuuagauguacuuuaaggggguucaccacuaccuugaggaacuuccauucacuucaggguauacaacccaugguauauaugauaauaauagucuaacaaaaacagugucaggcauugugucaagugcuguacagucuuaauucauuagaaugugguauuuaugcagcuaaauuuguggguuugagaaccuguuagguuuccagaggaagcaacaccaucuggcauugugacacauguagaacauuauucacaaagaaccaaaaaaaaauuauuauguauauguguaauaagacuguaaugcaggggugcacaaagaguaguuaaauaauagagauuaagggugggaaaguagagaaccaguaaggaagagugaucccugggaagauagacaaggaugagaggagacaauuauggggguaauacagaguugcaucuggaagaaacaaaaaccguagaggaagauaaaaugaugacucucugccaaagaaauucuuacccuuuuccuugccuacagcaaaacuggagagguuucugcaaugagugaggcuaaguaggcagcaacuucugcguguauaugcauucuagaaggaaagugguggaggagagggccagugggaaauagcugucuuccaagacagagcuaagguuuuccuuucuaccuccaauaaagcaugcauguuuuguggaagcacuuacugcuggguguuuacugcuaaaucuguuuuuugauucuucccucacuagacagacuauaaacucccacgagagugggguccucuucugucuuauuugcuauugucucauucacuggccccaguucuuagauaguaccuagcacauaguauguguccuaucaauauugaauuaaugcauuuuuaaaaguuacccauuuguuucagauauauaucuaucuuguguuacccaagagaucugagugggggcaugguacccaaaccccagguaaagauucuguguauagggaaacuuggguaaacaacaccauuuguaauuuaauuuuuuauccauguguuuccuuacaacuguuccuguugugaagguauauuagaaaaaugaggguaucguauuuguguuuuuguuuguucguguucauuuuaaagauagaauuugauuugagagcaaauuucauauauuuuugucugaauuaugugauuauugaauguuugauagcaauuaagugucacuauauaaauguaauuuucuuuuuuuaaaaaacagaacuaccaaugaaauaaaaaaucuucaguaccuaccucgaacaagugagccccgugagaugcucuuugaagacaggacaagagcucaugcagaucauauaggacaagguuuugaacgacagacuacagcugcuguuggagugcugaaggcugugcacuguggagagugguauauauaacuaccgcuauuuuaaugaaagaauuucuuggcuucuacaauuuuucuuggaaaaucuuaguaauuccuccuuacugugggaaaaaaguuucauuuuuuacccguauuuggauaucuuaauuguauaauuguacuaaagauuuuaaauugcuagaaucuggcugggugggguggcucacaccuguaaucgcagcacuuugggaggccgagguggguggaucacaaggucaggagaucaagaccagccuagccaauauggggaaaccccgucuguacuaaaaauacaaaaguuagccgggcgugguggcgcacgccuguaguccuagcuauucaggagccugaggcaggagaauugcuugaacccgggaggcugagggugcagugagccgagaucgcgccacugcacuccagccugggugacagagcaagacuccaucucgaacaaaaacaaaaacaaauaaauugcuaaaaucuagguuucaucauuuggguuaacugaaauaauuaauuucauguucuaagugacuagauguaaaaaaaauuaaaaggaaagcuaaggcuuaccuggugcauacuguaugccuguuuacaaaugucauuuaauuuuucucaacugcuuuuugcuccguauuuaucacauaaggaaacugaggcucagggcugucaaauaauuuuuuuuacagucauauaguuaauaaaugguagagcugagacugauuucaaucugauuccauacucuucuguuuucucuuccuccugcuuugcuguacccuuucugagguuugguuucucuuuguuauguauuugcuuuucuguauucuuuuuuuuccagcuuugcuuacaaguuucacuuugaauauuuugacagauuaaaaaauagauuauucuuuuuaauauacuugaggugucaucucauacauuaaauaccuuuccauuuauuaaauugauaaaacauauaaagcaaaguuauuguaauuuugcggccaggugugauggcucacgccuguaauuccagcacuuugggaggccgaggugggugggaucaccugaggucaggaguucgagaccagccuggacaacauggugaaaccucaucucuauuaaaaauacaaaaauuagcuggggccaggugcgguggcucacaacuguaaucccagcacuuucggaggcugaggugggcagaucaugaggucaggaguucaacaccagccugaccaacaugguaaaaccccaucucuacuaaaaauacacacauacacaaaaauuagcuggccgugguggcacgugccuguaaucccagcuacucaggaggcugaggcaggagaagugcuugaacccaggaggcagagguugcagugagccaagaucgugccacugcacuucagccuggggcgacaagagcaaaacuccgucccaccaccaacaacaacaaaaaaagauaauuuugcuugcuuagauuuuuguuuuccaaaauugaguauuguuuggguaugaaaugugaguuggaauaugcuauuuugcuuauuagagccauuaaaaauuuuuuuuuucuuuaagagauagggccucacucuguugcccaggcuauaguucaguggugcugucauggcucacagcagccuugaccacccaucuucaagcaagccuccugccucagccuccugaguagcuaggacuacagucacacaccaccacauccagugaauauuuauuuauuuuuacauucuguuuauuuguauuacuguuccuugcagagcaggacuaacucauaggcaguauguccagaguuggccuauuuuaaaauuuuuuguagagacacggucuugcucuguugcccaggcugggagcucaaagugcuaggauuacaggugcgaaacacugcaccuggccuuauuagagcaguuuaauuuuuuaaaaaaaggagaaacaggccaggugcaguggcucaugcuaguaaucccagcacuuuuggaggccgagguggguagaucacuugaaguuaggaguucaagaccagccuggccaacauggugaaaccuugccucuccuaaaaauacaaaaauuagcugggcaugcaugccuauaacgccagcuauuugggaggcugaggcacaagaauugcuugaaccugggagguggagguugcagugagccgagaucgugcuguguuucacaaauuuuucuauugcauuuucauuucaguucaggauaucucuaauuccuguuugauuucuuuuuuaacccauggguuaucaagaaguguuguuuaguuuccaauauuugaggauuuuuuuccagauuuuuguuuugguguuuuucauuucuaauuuaauuucuuguggucagagaacauauucuguaugauuuuagugcuucuaaauuucuugggguuuguuuuauggaccaucuugaugaauuuuuauauguccacuuuaaaaaauguguauuuuggcuaggcgcgguggcucacaacuguaaucucagcauuuugggaggccaaggcgggcggaucaccugaggucaggaguuccagaccagccugggcaacauggugaaaccccauauguacuaaaaauacaaaaauuagcugggcgugguggcacacaccuguaaucccagcuccucgcuaggcugaggcacaagaaucgcuugaaccuaggaggugaagguugcagugagcuuagauggcaccacugcacuccagccugggcgauugacgugagacuccgucucaaaaaaaaaaguguauuuugcuguuguuagggauauagugcucuauaaauuaagagcaauuaagucaacuuuguugauagugaaugugguucacuuuuuuuauauucucacuuauuuuugucugcuuguuaauuugcaacuuuaauauuggauuugccuguuuuuccugucaguuuuucuagguuuugcucuauuuuugugacagcuuuaucaagcuaugaucacguaucauacaguucacccauuuaaaguguacaguugaauaguuuuuaguauauucacagaguuaugcaaccaccaccaaaacgauagaacauuuucaucaccucagaaaggaacuacaccuuuuagacaucaccuccccaauucuccaucuuccauccugccagcccuaggcaagcacuaauuuacuuucugucuguagguauaugucuauucuuaacaucuaauauaaauggaaucaaauaacguggucuuuugugauuagcuucuuucacuuagcguaguguuuugaagguuauuccauauaguuugaagcuguguucuuaggcaaguacacauuuagaauuguuauucuugaugaauuggccccuuuuuucauuauaaagugcccuuuuuauccuugguaauauuccuuguccugaaacuuuguuaauauagccaauucagccuucuucuuauuuguauuuacaugcucuaucuuuucccauucuuuuucuuuuaacuuaucuguaugucuauauuauuguuacauguagauagauaucauauaguugggucuuaccuuuuuuuuaauccagugacaaucucugucuuuuaauuggaguauuuagauuauuuauauuuaauagaaauauuaguaaauuugguuuuaaauuuaccauuuugcuuuuuccaauuugcuucuuuauucuuuauucuuuuguuuccccuuuucuugucauuuuuaagcauuccauuuuaccuccaugauuugguuaguagcuuguagcucuguggguuuuuuuuuuauuucaguauugucaacuuaccacaaucuaccuucaaauaauaugagacuucuuuauguaauguguaagaaccuuucaauaguauacuuccauuuauucccuccccccucacauuucuggccuuugugcuaauugucauguauuuuacuuuacauaugccauaaaccccaugauguauguuauuuugcuuuaaagaaucauuucuaaagagauuucuuuaaauuuaaagagaauaaaaccucuuucauauuuaucauuaggugugcuguacauuccuuuucauagaucuacauuuucauuuaaguaucauuuuccuucagccugaagaaauuccuuuagcagucuuuguuaugcuguuuucucggugacagauucagcuuuuguuuauuugaacauguuuuuauuucacauuuuuuggaggauauuuuuugguggauauagaauucuagauugacuuuuucuucuaauacuuuaaaaguaguccauucucuucaggcuugcauugucuuugauaagucuauggucagucuuauccuucuuucucuguauauaauguauuacaugauucucagauuuucucuuuuaucacugguuuuuagaaauuuaguuaugauuugccuucauaugauuuucuuuauguuguuuggaauuuuauuccaaaauccauuuuuuagcaucucuuuaaaaauguauuuauauauuccuaauuaauugaagaauuugagaguuuuuuagaauuauauuuaaaggcaugaguaaccucagcaaauaccaaguuuauuguauuaguacuuuuccaaugaagucucuuaauuuauaaaguuauuuaagaguuuuaugcaucaguauaguuauauguaucuucuauggaaauaaaauacucccuuuuccucauauuuacuucuaauuuuuauguaguguuuucaacuuuagcacuuaaauuuaugaagcauugaucuuauucuucaaauagaacacuuaauuuucuugguuuguauaauuuaccaauucagaucauuucaauuuuccaaacucuugugacaaauguuuauauaaaaacgaagucaguuuuuaaucugugucuagguugaaagucaugguguuggcccuuucuuuaaauaugugaaauggcuuuccaauuaacaguuuaacuuuauuuguaagacaguacuaugguauugaccauaaaguauuuuugcuuugaguuuaauaaggacucaaaagagugaagcauuuauggcagauucuuguuaucucguuuucuuuuuuaggccugaucaaccccguauaaccaaagauguaauuuguuuucaugcugaagauuucuuagaaguaguucaacgaaugcaguuagauuuacaugaaccuccacugucccagguauuuuuaauacacuuacugucuuugguuuaguuuuuauuaugaagagaguuauuuguauuucuuguuuuauuauuuuuuaguguguccaauggguugaugaugcaaaacugaaucaacugaggagggaaggcauucgcuaugccaggauucagcuauaugauaaugacauuuauuuuauuccaaggaauguuguucaucaguucaagacaguuucagcuguaugcaguuuagcauggcauauucggcucaaauuauaucacucagaggaggacacuucucagaauacagcuacucaugaaacaggcacaucaucagauuccacaucaucuguucuuggaccucacacugacaacaugauuugugcuguaagcaaagccuccuuggauucuguuuuuucagauaaacuucauucuaaauaugaauuacagcagauuaaacaugaaccuauugcaucuguaagaaucaaggaagaaccugugaauguuaauauuccugaaaagacuacagcacugaauaauauggauggcaagaauguuaaagcaaaauuggaucauguucaauuugcagaauuuaagauugacauggauucuaaauuugaaaauagcaacaaagauuuaaaggaagaauugugcccuggaaaucuaagucuaguugauacaaggcaacacaguucagcacauucaaaucaagauaaaaaagacgaugacauuuugugcuaaauuugcauauaccaucuaaaauccuuuuuuaaaaaaauuuaauguaauaaagauucaugaauucugaaagcaagccaaggacuugcuccuaugucuguuacaaaacauaguuuauguagcuuuguaacauuccucagugccuguccauaacugugaaguauuaagcacuuagggccagaugcacuguaaacauugcagguuuaaacauaaaggagucuuuaaaaaaaaaucauuuacguuggaauuuuagguuuuagaauagagcugacauuaacauauauauauauauauaaauauauauauauauuuuguaauaugagccagaauucuuuuucaacaauuuaaagcuuuuccauagagcuuauuuauauccuuuuuuuucauuuuaaaugugucagcacuguaguguaaauagcuuuuaaauaucuuuuuagugugauuuauacugaaaugugagccacuuaauaaagguucauauguucauauuaauaaauauguuuucuguugagucuguaaagacaaacugacaauucauuuaagucauuugauaaugauucucugcugguauaucuauuuagugugguauuguagugcaaauguacguaauucaaaucuaguaaauauuuaaguuccuc

SEQ ID NO: 191450 - RNA, 102037 nt, Homo sapiens
gucgaggcaagguaucuggcugugaccgggaggagugcagaucguggcugacagaggaacggggguauugagguuggcacuaacuccugggaucccuuugcucuagcuggucucaaagcgggcaggguaggacuuaggccguuucuggggucgcagucaugaucuccaacgcuugggaaaggauugcccauaaggaaucucauggguuuaccuaauuuccauuuacccgcgucccgcuucuccucuccugaggcccagguuugagguggucuugggguccgugugacuauagguucaggggauaagugugggugggggaauuauccugaaggaagccagccgacuucggacuccccaggggauauugccgaaggcggaggggaugugacuaucacuuccuauccgggguggggguggggaacuugggaacaauaguccugguggggcggaggcgacgcuacgggccgaagcccugaacugggagauaaccuucccagcgcccccccgccuccgccacccccuacuuuccgcccucugcuugugcaggcagucuugagaggaggugaagguuaaaagucuuguucaugaaauugcucuagauacacuauugcuuuagcacacugugagggggucagauccgaaggcgugagaccagaagucgacuuccuacguuacccacccccccaacccccgcccuuuuuauuuuucugcuggacaauguucccucuaggguuguuucccggcuuaggaggcggugguugcggcugcugcuccuacggauauugcgcaagacuggggcguuggaaacccuguaggucuggggaaugaaaaaggaagugggacuuugggaagugguugcuccuuagucuuggcggggguugggaaugggaaauaagcuggggaaaauuuuuaucuuggguaagguacaccucgaagaauaaucacuuaauucugaaaucugauuaugagaaggauacacaguuaaugccuguaaaaugaaugggcagcaaacauuggcuaguuuuuauuuuuuguuuaaaaaguacaguaguuuuuaugguggaggugauaugacuuaguagugaauacuuuuucacguuuuaaagagacuggucuaguaaagcuuuagcguuaaauuuuuaacagcuuauaaaauaggcccuugaccauacacaguauuauacuagcaucguugagcuuugugauucccgccuccccagaccaauaauagaggacggaaguaaaguuuucucaguaucuuuugaagauugaaaauauaaguuaaauaaucuaacuuauuccuuauuaaaaauaaaaauauugcuuauauuuaaacauuugcucuugauauuuagccuauguauuuuugaaaaauuacuuuuugaucugaaaggguuaaggaaaacggcauuuucccuuuuuacuauugagaguuuuuauugucuugguaucuuuugaauggugucauuuacagcaauuggauggagucccuuuuuuacuacuuucuagcaaaaguagaagaaaauacuuugaauauuuaagauguuuaaaacuaguuuuuuuggguuuuguuguuugguugguugguugguugguuuuuuuuuugagacggagucucgcucuacgcucugucgccccggcuggagugcagcggcgcaaucucagcucacugcaaccucugccucccagauucaagcgaugcuccugccucagccuccugaguagcugagauuauaggcacgugccaccacgcccggcuaauuuuuguccgaaguagccgggacuacaggcgcaagcuaccacgcccugcuaauuuuguauuuuuaguagagaugggguuucgccauauuugcaggcugcucucgaacuccucaucucaagugauccaucugcuuuggccucccaaagugcugggauuacaggcgugagccaccaugcccggccuaaaacuaguuuuuuaccgucuuacuuugguuauggaagaagagaugguguggucccuggucauuucuuguuugcaugcuagucaccuuguuaucccuaggcauauaccgucaggaaggagcauuguuuggugaugcgggccaucaggacagguugcccagccucugaacuccuguacuggagaaguggccuuaggguucaugcuuuggggaugagucagggauuccuauuggagaguucauuucuuucuuucuuucuuucuuucuuuuuuuuuugagauguaacaccucgcugugucgcccagguuggagugcaguggcucaaucucggcucacugcauccuccaccucccagguucaagcgauucuccugccucagccuccugaguagcugagauuacaggcgcaugccaccacgccuggcuaauuuuuguauuuuuaguagagaugggauuucaccauauuggccagacuggucuugaacuuucaucugacugacuuugugaucugcccgccucagccucccaaagugcuaggauuacaggcaugagccaccgagaguucauuucuccaagaguaaaugaguuuccuuuuucuuccaugauaccuagguauagcuaggugauucuacauuagagauuugaugacuaaggcuauucuuuuauagggcuuuuuuuuuuuuuaauuuccugacuugauaagcaauagcuguaauuaagacagccgguaguuggugcugcuuuuuccccugacuggaaggcuggagaggaacuauguucuccuggcauggaaagagaaaaaaaagauuagcuuauagauucuauuauuuuuaaauucugaugucgauuaaaaaugcauuuuaaauucuuaacauuuuaugacugagccuuagagauaauguagcugauauaacuguuccaucauaaaauaauguuuauuccaaauuuggaaauuaauagaauaauaauaaugccuuacacuuagaccacaguucaaaugaacacuccacuugccugacuggugaugaugcucuuuucgcucuauccagcuguccuacaguccugucauuuaaaggcuaccucuguuaauauuuuuugguuuuguuuuguuuuguuguuuuguucuguuuuugagacagggucucacucugucacccaggcuggagugcaugguugcgauccuggcucacggcagcgucggucucccugggcucaggugauccucccacuucagccuccagaguagcuggggcuaugggcccaccccaccaagcccugcugauuuuuguauuuuuuguagagacaggguuuccccauguugcccaggcuggucucaaacuccugggcucaagcaauccaccugccucagccucaaagugcugggguuacaggugugagccaccguagccggccuacuacuugguaacuaucuuauaucuuaauuuuguuucuuuauguuugaguauuuaggucauucuacuuucugcuguuacauauaguaauucugugauuaacauuuuugcugaaacugacauuuuucacuguugcauaagauagcuucccaggaguacuagguagacguauauaaacauuuaauacauguucauaaacuugaaaaaguuuugucaguuuauacaacugucauaauguaugaguguucauauuauaauuuucuugaucuuuauuugaugguugaaaacugauaucuuguuuuaacuugaauuucuugauuacuauugaggauagaaauuuuccaccugucauuacuauucuaugagugucuauuccuggccuugguugugccccauacuguuaaagaggagacagcuaagguacccagacugugcagaacuauguugccuagaugguuauuugcauguugaaaacaugcuaauuuugcuaauaaauuagcaaauagcuaauuuguggcugauccagaauuugaucucaauuaucucuacuuuuaauauuuacaaaaugagagauaaauguauaaaguaggguggugcacauucauguuugacagaccuagguuuuaacuccacacagacucccucugauggcuggggguuggggaggugguccuggaccauacuuugagaaccagugagcuaauacaugguaaaugauaaagguaaugcugggaaaguuagguagaggucuuuuugugaaggaucuuacaucuaugcuauacuuagauuuuauucuacagaccgauaauagcaauucuggacagucugcauuguaacuccuagagacauggagaaaguagggagguguuaagaaaauagacaugcugguccacuccagcgucauucccccaucucaccuucuccagccugcuccuugaguuguacucugaaccuucacuuacuuagauagguucugguagaaaaggugagaaucauuagucuggguuucuggagcacuacugagucuuuuaagaaagguaaacagucauuuguguuuuacaaaguugaaucugauagcaguaugaaggguggcauuuuggaagcuguugaaauauaagaagugagaugugagggccugaagugaacugagauggggaaauagaguguauacaacacaucugauaagaauuaagaaaggagucucaaugauucauuagauguagguaguaaagaagaaaagaguauaguguuaugacucgcaaaauaucuagcuugguaucugucacccaagcuagagaauaccauuugguagaguaaggagugagggaggagaaacaaguagaggagaccaaacaacauuguaggaggaaguuucagggggagaagaggauaaauuuaauuuucaacauguuaaaacugcggugccucugagacauccaguagaaauguagagcucaagauuucugacaggacggaguuaaagauguaggcaucauaauauaagcauguaggagauagucgacagcaugggagugaaugagcuuauuccaacaaacuuauagagugaccagcuuuagguugaagaacaucagucuuaaaauaacagccaaaagaaggauauacuagugauuguuccugagaagguguggucaaggaggagggaggagaaccagagaugucagaaaagccagggagaguuucaagaaaggaguuauuaccagagucaaauaaugcugggaggaccgguaaggugagguugagaaaguaccuauuccauuuggcacauaggagugcuuuggugacuagaaaaaacaguuuggguugggguaugggaagaagcuagauuauagggugaaggguggguuuagugucuuuccauuuuuuuuaacauuuugaaaguagaugguaggagcuagaggaagauugguugaaggagagugugccccuuccacugccuuuuuuuuuuuuuuuuaaagagagaacuagagaauauuuuucuuauuauuucuugucuauguguauauccucuuuagccugggaagaucuuauguugcagucuugauaaauauaaaaauuuuaaucauuuguuuauucaguguuguagcuuauagguuuaaaaaaacuaauaauagcuuuauugagauauaaguaccuaccauaagauuuauucauuuaaagucuaugauucacuaguuuuuuauuacauugaugaaguuaugcaacaauaaccauaaucaauuuuaggacauuuucuucacuuucuguacccauuagcagucacuccccgccuucccauaagccccaggcaaccacaaaucuaccuucuguuuccauagauuuaaguauucuggacauuuuauauaaauggaaucauacaauaugugguguuuugugacugacuccaccuaacaugaugauuucaaguuucauccauguuauaguauugauccguaguacuuuuggccuuuuuauggcugaauaauauucuauuguauagauaccacauuuuguuuauccauucaucguguugauggguauuugaauuguuuccacuuuuuggcuaaugugaauaaugcagcuaugaacauuuguguacaaguuucuguguggacacauuuucaggucucuuggguauauaucuaaguguggaauugcucagucacgugguaacacuauguuuaacauuuugcggaacugccagacuguuauccaaagcugcugcacauauuacauuccaaucaggaauauaugaggguuccaguuccucuacaucuucaccgauacuuguugcugucuuuuugauuauaggcauccuacugggugugaagugguaucuucuugugguuagcuuguaagauuuugugugucuuaauuugucuuucaaagcuagagugauaggaaauauuuuccaguccuugcauuugagcuaaucuuagugcuuacccagugccacugguuuaguuaugguuuucuuauccauccuuugaugaguauucaccuaaacauauuuacaucaacuaacuucagaaguggaagugaacuuuuaaguaacucuccagacaugguucacugagacaguaaacuaaaaauuuacuuuaagcauucucaagaauguuuuacuuuauuuacuuucaaaauauauuaacuuuuuuccaucaauauuugauauuuaacuuggaaaaaggauuuuuaaaggaugaaacugaaaguaagacauuaacauuuagguggcuguagguuuuuuguucauauguuaaauacuucuguguuucuguagcacugaguucauuagauucauaaauauuuacauuucugucuuccccagacugaacgccucccaggcuagagacugggacuuaauuaucccuguauccccauugcuuaauauagugcuuggcauuuaauaggcacuaauguccauugcaugugcagacauuguagacaaacuuaaugcuguaagacagauuuauucuucaggugaauucuucagugguccaaggguuugucuucuagacgaucaugagaacugcuucuuccccuccuacacagaugugcucacauaacucguuguauuuucaguauccacugaaaaagaaaauacaagauaagagcuacauugaauucaaauauuuuaaauaaauaugauuuuauuagcugcaguuucuuaagguaacuucuguauuugugcaucccacacccaauggaucauacuuuguugacauugucuuagaguauuaauaaaaugucuuuuaaacuuuuggcuuuggacuuaauaaaaucaagauaucaugucaucgguaucucuucaaaaauagugaauuuguggguauuuagagagugauuacaagugauaucuguuguucucuacuugccucuaguuucuuuccucauccaguccauucaacacaucauacucacuuucaaguggcagcaucuguaggcuaauggaaaccauacugguuguacaaucaggagaugugggcugcacuggaagcaugguuuaauuuuuauuauuaaaaauauaaguuaaaaaaacucauugcucccuuugaugaccauuacaauuauuggaaauuuuaaauguguauuuugaaagucaauucaaaacauaugauccaagugcugcuccuuuuucaaacuguaauuaugucugucucucuuuccagagagauuugauucccugauuuuucccuucucagcucccuccaauuuuaaauauauauauauaguuuuuuuuaauaauuaaaaaaaaauacuucaccuggaaguuuucauccaauuuuguaacuuugguccuaguugagaaucacaggccuauaggauaaagucuguacuucuuagccuggcauuccagaaccuucuuaacauaaugucacaguaccuuuccaguguuaaacuucuauacucugguauguauccucucuucuuuuugaaggaagcuauuccugguccuugagcauaccuacuaaaugaaugaaaucuugcuuaucugugguuguacuguugaacauacuuuuucccucagaaagcuucccuuuuauuuuauuuuauuuuauuuuuuugagacaaagucuugcuuuguugccaggcuggagugcaguggcaccaucucagcucacugcaaccuccgccuccuggguucaagcaauucugcugccucggucuccugaguagcugggauuacgggcgcccgugaccacacacagcuacuuuuuuuauuuuuaguagagaugggguuucaccauguuggccaggauggucuccccuuuuauuuuauaaaccaguacuuggaagaugagaaagcuaaaaauuuaaaaugacuucaccauguucaccaaaaacucagaagcaaaaaugugauuaauucucaccuucuagaauaaauauuuuagcacaguuaaucuuaaagcacuuuuucuccuuuguaaaguuugaucuuuaauaucacaagaaaaaaagccuuucauuagauuugaguugaaaacuugauaagguaaaucaggugauaugcaauuucuaaaccacuagucuuuuccaaauaugaguugaacuccucuuccagcauuuuauauuuccuguaguauuuaaguuucuuuagauucaugcagucaaaccuugacaauuaucuccuuccuucugaaaucacacaaaaaucuuguuugcauuuguacaguauuguagggucuguagcuggccuauggcagauauaagaagcaaacaguaguugcucccuaaaaguuuuuuuuggagaaaguggaguguggacuguauuaguccauuuucacacugcuaugaagaacugcccgagacuggguaauuuauaaaggaaagagguuuaauugacucacaguucagcauggcuggggaggccucaggaaacuuacgauugugguggaaggugaaggggaagcaaggcaccuucuucacaagguggcaggaaggagaaugaacaugggaggaacuaccaaacauuuguaaaaccaucagaucuugugagaacucacuaucaggagaauagcaugggggauuauaauuacauagggauuauaauucaagaugagauuugguggggacacaaagccuagucauaucguggaccaugauaaucucagaggcuuugggaagugugcuaauaucuacauuuccuguaauaacuuuuauaucuaaucggcauuuaaaaagcuauuuuaacaacauuugagugacuguccugauaggcucugaaggaaugcaaagauuugucucugucauccauccauggucucugucauccauccauggucucuaucauuuauccauucauacagaagguauuuauggagauaccugagugcccacuaugcccuagguacuguguuuuugaauugacaguugaaaacauggcaguacucuguucaggaaguuuacuaacugaacagaccugugagaagcagcgggacuuuuccugggggcagugggugggcuucaggggaaucuuugaacccuuuuaaauuauauauaauauuuuuuguguguaagcccauuuuagggggaagaaaguucauagcucuuaguuucucaaggaguuugggucccuuagacuaguggaaagauaaggaguuuaggagcuauacagucauuaauuucuauccuggcccugcugugauucugagcagauuaucuagagaaguuggggcucuaauaccuaccuggaaagaacaagauaauauauguaaaguuucuaacauaguauauagaagguagucaaaggaauuugagaugacauacugcuccaguggaaguauauucggaauauaagccagagagacaggagagccuaaaucugucugaauagaucauggacaguuuccacaaagaugcuacauuugagcugguuuuugaaggaagaguuugucaggugaacuaggugaguaaaaggcaacaacacuuucaaagacuuggagauaaacagagauagaacuguggguuuuagaugggaagaacagggucaguguguauaaaauaagaaaaucuuauguacccaaauaauaggauuuccaaaggaauaucagcuuaaaugcuauuaugaaauuggccuguguuccugaguguuuugaugaggaguguuuugauguuccauuauuauggcauaguuguuugaucuuacaguaggaccuuuuaaaaauugaguccuugucacaugguaaauguucuuaaaucugguaauuuuacuuuaucucagguauauaaaguaguacucucucuguuuacacaguucuuagaugacuagauuaguguuucucauuggcaucuaucagauauguuuaaagugcccuguagaaagaaauuacauuuaaaaagccuucaggacuaaggcagcuuauuuauaauggugggucucuugcuuaguuuggauuccucagcgaauugaguuuuccauaagaugacucugaagagguuuugagacugcauuugugaccagaaccaacgugagaaaggaagggaguucuaggucacaugcuacaaaaccaugaagaauaacuucucuagacaccuucuuccccauuguguauguugguuuuacuccugacgucauaaacucuuuaguguuagaaggaacauaaaaacuguuuagaaauuaaggagcuuguuacaggucuugccauagaaaggugguggaacuggguuagacccaaguuaggaaagcagaugcuuuuuauaugacaugaugcugcuuaggccaacauuuucagucuuagggaaaaagucaauaaagccccacuuccuaccccccuagaguagagcauaaauauccucaaaauuacaaaaaaaguuuucugucaguauagauuuuugguugcagccuacuuccaaaaaguagcuuaagugaagaaagaauuuauugcaauggaauacugcccuugagcagguugaagcaucagaaccaagaaauagagagccugggugacuccucucuccaugccagccucuuugucuuucuaugguuuucaaguuuccaugucucuggggcugcuuggauacuucucuuugcuucucugcacaccugcuuuacuauuaccucucucugcauuuugacuuucacuguuuuggccugcaugugcugaauaaagacaucccuuaugguaaucuaaccugucucauucacuuuuaucucaaauuauggaaagagcucagaaugacuagaauugcuacaucuuguuuucaauuuccugaagaaaauaaccaacuugccagugagauggguguuguauaagguggugagcuuauucauauguguauggaaggaaggaacuuuuuuuagagaaaggaagggauggcuugauaacuaggcgggcaguccaaagagugucuaguagagaauccuugaagcaaaauugaaaaaaaauuuacuauuuuaagguuucagcuccauaugaacuccacccaccuucuuucagagauggaaaaagcacaaagaguccuugugacuugagagaacaauuuguuggcucuggcagagcauuauuucacauuuacaguuagacauuaaacaucaggcaaaauuuuaagguuucuguguagcaaacuaaaauuaagauuaucuauaagcugcuuauuuaugguaccuaaauuuaaauuauaauuuuucaacauuaaaauauggaaccuucuugcaaggaaauccuguuuuaaaguuuggguuuuuguuuguuuguuuuuuuuuuuuuuaagagauaggguccugcuuugucacacaggcuggagugcagugguguaaucauagcucacugcagcccugaccuccugggcucaagugauccucucaccucacuccugaguagcuaggacuacaagcauguugccaccauguccuacuaauuuuuuuaccuuuuuuguagagacgaggucuuacuauguugcccagcuggucucagacuccuggccuaaagcaauccuuccaucuuggcuccccaagugcugggauuauaggugugagcgacugugccuggcccuaaggaucacuuuuaucaaaguagucacuaugauuuacucccugaucauaugucagaaauauaucacuaucugaaaaacuaacauauuuucuucacaauagguuuugcauuguuaaaauuauccuaacuauaguucuuuuaguucaugaaucaucuaaaauuuauguguuacuauauucauuguguuugccuggcuauuagugugccugucuuugugccugugugucugccugccugccuuugugccucccuuugaaauucuauuugccuacucaccuuucucuaccuacucagucaguugguugucugugcccaagauuuauuaauguguguuaacguguggguaguagagauagacuggaagguacuuuguaguuuagaaaugucuguaauuuacaccuaguuguuuguaauucaucuaauacgguaaauagauuauacaaggggacuucaaaaagcucauggaaaaauggaauuaaguaaauaaauguuauuuauuaauaaauuuauaaauagacuaaaauuaaaauauaaaguuaauuucugaacauaaacuccaucaguuuacuuuuauaagugaugauacaccaaccauuuuguuuaucccuaagaacugaggguccuagaaauuuaaccauuucaaugcaguuuuuuuacauuauuaacugaagaguaaugaaugcccuuuaaagauuuuuuugagauuaggaaacaaaacgaaggcagaaggagccaaaucaggacuguaagguggaugccuaauggcuucccaucugaacucucacaaaauugcccuuguuugaugagaggaaugagcaagaggcauuuuuguggguagaaaaggacucuggugacgcuuucuuggauguuuuucugcuaaagauuuggcugacuuucucgaaacacucucauaauaagcagauguugucuuuccuuggcccuccagaaaaaucaacaugcauaaugccuugagcauccccagaaacuguugccaugagcuuugcucuugacugguccacuuuugccuugacuggaccacugccaccucuugguagauugcuuugauugacuuugucuucaggaucauacugguaaagccauguuucaucuccuauuacaguccuuuuaagaaaugcuucaggaucuugaucccacuuguuuauuuauuuauuuauuuauuauuuuucauuuuguuuuugagauggagucucgcucugucacccaggcuggggugcaggggcaugaucucugcucacugcagucuccgccuccuggguucaagcgauucuccagccucagccucccaaguagcugggauuacaggugugcgccaccacacccagcuaauuuuuguauuuuuaguauagacaagguuuugccauguuguccaggcuggucuuggacuccuuaccucagguaauccacccgccuuggccucccaaagugcugagauuacaggcaugacaguuuaacauuuccauugaaagcucugcucuugucuguagcuaucugggugcaaucauuuuggcaccaacugaguggcaauuuguucagcuuuaauuuuucagucagaauuguguaagcugagcaacuuaagaugucugugguguuggcuauuguuuaugcuguuaauugcagguucucuucaguuagggcaagugacaagaugaauuuuuuucucaaaaaucaauguggauggucugcugcuacagguuucuucaacaucacguuguccuuucuuaaaaagaggcauccauuuguaagcugcugauauuuggggcauuguccccauaaacuuugcuucaccauucuuccauccaagcuuugccauaaauuugauguuuuguucuugcuucaguuuuuuagcagaauucauguuguucugauaggggcucuuuucaaacugauaucuuauacuucuuagugcuucaaaugagauccuguucaucagacauguuauaagaaguuaguaugaguuuauuuuggugcaaaacaaaauugaaauccaugcauaguuuuuuccaugguacauauuuuccaugaacuuucugaagaccccuuguaugaaugccaaggagaaacauagggugggugguuauuaguaauaggauuuugcaacugaaauaauuaaacauguucagauauuuaucuccacacccauucacugacauuauuagauggugcacaaaaguaaaaaguuuauuuuaaaauuacuuuauaauuuagauagaagauuauuaaaauucauuuuuaagaaacagagucugucucuguugcucaagcuugagugcaguggcacaaucacagcucacuguagccucaaacuccuggacucaacagauccgccugccuuagccuccuaaguagauaggacuacaggcaugagccacugcucccugguggauuacuuuuaaaguauguuuuuuuuuuuuugaaaaugcaacuuaaacuagaaguacaggaugaauauuuaaccaauacauuuaauuucuugucauugcuuuauuagaugcuguuuuuguauuguuuauaaggucucagcaucauauguaugauauuuucaaauauguucuaaaaugaccucaucauuuauuucucuaguuguuaaagaagguauagagguuuuaucauuuuuuaaaauaggauguagguuggauuagaucuauaaauuauuauuuugccuuuaaaacagguuauagauaaaagagggaaagguaaucuggugauacuacugggcaggaaucuuuaaauuauuuaaagaggguguaaacgaaggaauguacaaaaguaaaaauaggcagggaagaaaagaccugauggaaguaacauaucuuuguuaggaauuugagugucuagcauuauaguggacaguccaaugauaugguuuacaacaguuauauagguauuagaccuggccauuacuuacuauguaauguugaguacaugauuugaaccacucucaaucuuagcuucuuuaucguuaaaacagaaauaguuuguaauguuugaauuaguaagaauaaaggacacagugucagaugugucagaaggaagcaugauuagggcauuaagugagaaguuaaauaaauaggaggggaaaaaggccaccccuugcucuuuuucucuuuuggaccuuuuuggugacagagacagaaagaauguguauaguauauuuaauuaucugaaaauacagagcugagcaucccuaaucugaaguuuaaaaugccccuacauccaaaauuuuuugagugccauuauggucugagagcagacauuguguaugauugcuguuuuaaauuuguugagguguguuuaauggcccagaauuuggucugucuuguugaauguuucauguaaacuugagaagaauguguauucuguaguuguugucuuagguagucuauagacgugcauuauauauccaguugauugaugaugcuguuaaguucaucuguguccuuacucauuuccugcuugcuugaucuguccauuucugauagaggaguacggaagucuucaacuauaauaguggauucaaauauuucuccuugcaguucuaucaguuuuggcucacauauuuuuaugcacaauuguuagacacauauggauuaaggauuaugcugucuucuuggagaacugaccccuuuaucaugauguaaagccacccuaucccugauaacuuuacuugccaugaaaucugcuuuaucugaaauuaauaacuagucucauuuuauuuuuguguuagcugauauauuuuuuuccauccauuugcuuuuaaucuguguguguuuguauauuuaaaguggaucucuuguagacagcauauaguuaggucuugguuuuuaauccacucugacaaucuuuuaauugguacauuuagaccauucacguucagagugauuacugauagcauuggauuaaugucuaccauauuugccacuauuuucuguugucauuguucuuuguuccuauuuuuuuuuuugucuuccacuguuuuucugccuuuugcaguuuuaauucaaaauaucauaugacuguccuuucuuagcaugucaguuuuacuucuuuuuuuuuuuacuuuuuuuguuuuuggucuuuucuaaagagacaaggugucgcuuaguugcuuaggcuggaaugcaguggcaugucauagcucacuguaaccucaaacuucugggcucacgugauccuccugccucagccuccugaguagcuaggacuacaagugugugccaccaacccucaaguaauguuuuuuauuuuuuguagagagaaggucuuaccauguugcccaggcugucaaacuccuggccucaagcaauccuccugccuuggcuucccaaaguauugggauuauaggcaugagccacugugcccagcuggguguuuucacuuuuuuaagugguugcucuggcauuugcaauguauauuuccagcaaauccaaguccauuuucagguaacacuguaccacuuuauggauggugagauuacuuuauaaugacaaaguaacccuaauucuaucccuuguaucauugcuggcauuaucucacuuacaaauaaacauacacacacaagcauauauaaccaaauacauguuugcugcuauucugaauaaacguaucagaucaauuaauaagaaaaauaaaaguuuuaauuuuacuuucauuuauucuuucucucauuucuucuuccuuucuuuauguagaugugaauuccagacuagaauaauuugucuucucucuaaaaaauuuauuuuaacauuucucacaagguaggucuguggcaacagauucucuuaaucuuuucugggggacagggucuugcucugucugucauccaggcuauaaugcgguggcaugaucauggcacacugcagccuugaccugcugggcucaaccaguccuuuugcccuagccuccggaguagcagagacuacaggcaugcaccgccauacucacuuaaguuuuuuuuuguuucuguuuuuguagaaacgaggucucacuguguugcccagguuggucuugaacuccugggcucaaaccauccacccaccucagccucccaaagcauuaggacuacaggcaugaaccaccuugcccagccuuaauuuuuguuuguugagaaaguuuuuauuucucuuugguuuuugaaggauaauuuugcaagguucaggauucuaaguugguggguuuuuucuucucaauaugauauuuugucacucucuucuugcuugccuaguuucugaaacagagucagauguaauucuuauuauacuugcuccucuuuagguaagaugauuuuuuuuccucuggcuuuuuaaacgauuuguuuaucuuuuuuuuuuuuuuguaguuugaaagugauaugccuacauaaguuauuucuggcauuuauucugaucaguguucucugagcugcuuggaucugugguuugguuucugacauuaauuuggggaaauuuucaaucauuauuucaaauauuucuucuguucccuucuucucuuucuguuauuacccuuaugcauauuuacaucucuuguaguuguccccacaguuuuugcauauuccauucuguuguuucaguuuuuuucuagucuuuuuaaucucuuuucaguuuuggaagcuuuuauugagauauccucaaguugagagauucuuuccucagccaugucuagucuacuaguaagcccaccaacaacauucuucauuuuuguuacaguuuuuuaaaaaaaucucuagcguuucuuaggccgggcacgguggcucacgccuguaaucccaggacuuugggaggcagagguggguggaucgugaggucaugagaucgagaccauccuggcuaacacggugaaaccccaucucuacuaaaaauacaaaaaaauuagcugggcgugguggugggcgccuguagucccagcuacuggggaggcugaggcaggagaaugucgugaacccaggaggcggagcuugcagugagccgagaucacaccauugcacuccagccugggcgacagggcgagacuccgucucaaaaaaaaaaaaucucuaguguuucuuuuugguuauuucuuugaauuucugucucuuugcuuauauugauugcccaucuauucuggcauacugucuacuuuaucuguuagaguucuuaggauauuaaucauaggguguuuguuuguuuguuuguuuguuugugugaaacaggguuuugcuuugucucccaggcuggagugcagugauacaaucauagcuaacugcaaccuccgccuccugggcucaagcaauccucccaccucagccuccccaguagcugggaucacaggcaugugugaacaugccuggcuaaguuuucauauuuuuuuguagagaagggguuucgucauguugcccaggcuggucucgaacuccugggcugaagagaccugccuaccucugccucccaaagugcugggauuacaggcaugagccacccagagccaaggucucagucuuuuagugagcuuguuuauggauuuugaacuauauccuguuucucagcgccucacccccaggauggcuugaaugaccuguaguuggguauuucccuuaccucauguaaauaaggcucuguuaaaaccccagcagguuaggcucagguuaaaucauuucuccgcagggcagaccuuguuaagaagaauggaauauucggccaggcacaguggcucacaccuguaaucccagcacuuugggaggcugaggcugguggaucacaaggucaagagauagagaccauccuggccaacauggugaaaccccgucucuaauaaaaauuagcugaguguuccuguagucccagcuacucgggaggcugaggcaggagaaucacuugaacccgggagguggagguugcagugauccgagaccgcaccacugcacuccagccuggugacagagcaagacuccaucucaaaaauaaaaaauaaaaauacaaaaaaagggauuuucucuaauacuuacuaugagaaccugguagagcuccuggagguaaaacaaaaaugugggguccccuuuggauuggguacaccaggaguuuuuguuuguuuguuuguuuuuguuuguuuuuuuuuuagagcggucucgcuguuguccaggcuggagugcaacggcacagccuuggcacacugcagccucaaccucguggccucaugugauccucccaccucagccucccuaguagcugggacuacagauguaugcaaccacacuuaucuauuuuuaaauuuuuuguagagguggggucucacuguguuugccuaggcuggucucgaaccccugggcucaagagguccucccgcuuccaccucccagaguacuuggauuacaaguaugagccacugcauccagccuccccuggagauuuuaacccucauaguuguucacacugagccucuagcaguucaucaauuacaguucagguuucuuauggaaguuugcugugugaguguuucugcucugauuacucgugauucuccguauucaccuucugucucuccaguuugggggcagcuguuugaccugugacuuaacuucucuuacagaucuaagaaaaguuguugauuuuucaguuuguuuagcuuuuuacuugcucuuaagauugagugacagauuuuuuuuugcauuuuuuuauugugauaaaauguauuaauacaaaacauuuaucauuuaaguguacaguucuguggcauuagauacauucacacugugcaauuaggacucuuaaaaggaaaaagucacauacuguuagaagggucauacaaggcuuuauagaaaggauuuuuaagaugagcuucuauauaucaauuaaaagaacauuucaguagaaacaugggcguaugguaugauaauuaccagaagacaaaugcaaauaagugcugaacacaggaaaaaaauaaucaaccucuccaauaaucagaaaaauugaaguuaaucaucauuaacuguugggggaguagcuaccaaauuugauaaaaacucaaaaauucguaauaauucagaaauugagaauagcggccgggcgugguggcucacaccuguaauucuagcacuuugggaggcugaggcgggcagaucacgugagcucagaaguucgagaccagccuggccaacauggcgaaaccccaucucuacuaaaaauagaaaaauuagcugggccugguggugggcgcguguaaucccagcuauucgggaggcugaggcaggagaaucgcuugaacccaugagguggagguugcagucagccaagaucacgccacugcacuccagccugggcaauagagcaagacuccaucucaaaaaaaaaaaaaaaaagaaaaagaaaaaagaaagaaaaagaaaaugguaaggauauagaaaacuaguguuucuagguccauuaaggggaggguaaacuggugaagccuguuuuggaaggcaguuuggccacuucuaauagaauugauaaauguacauacucuuugauccagcaugucaacuuuagggaucuuuccguaaaaauacuugcauaugugcauaaaauaguauguccaaguaugcaacaauuuuugugaaacaaccuaaaauagcuauuaguaaggagacuuugcauaacugguuaccuaaaaggaaacagauguggaggggagagaguuuggcuuuuucauuuuauaccuguaugcagaaaagaguaacauagcaggccuaagacuacuauccuuagaaaggccugcuuacaauguuaucccuuggcuggugucugggaacuuagacuuuugggagaauuuccauuauccccugauaagagugguucacugugcccaaacuguacaaacaaugugguuuaugagcugggcccaguggcucaauuguguaaucucagugcuuugggaggccgaggcaggaggauuccuugaggccagcuugggccacauaguaagaccucaucucuacaaaacauuuuuaaaaauuagccagaugucauggugugcaccuguguagucuuagcuacuuugggaagcugaggcaggcagauaacuugaguccaguaguucaaaguugcagugagccuuaaucaugccacugcacuccagcauggguagcagaacaagacucucucucugaaaaacaaaaauaaaaaauaauaugguuuauguugaacaucuacuuuuuuucugggagucuggaauuuugguauauucuuaggcagagugccuguguaaccagccuccaauaaaagccuugggcacuuuauuucuaaugcgcuucccuuguggacaacguuucacacauguugucacaacuuauuucugcaggaauuagaggaucguguguaauuucauuagaagaggauuuuugaaagcuugugccuaguuucuucuggacuuugccucuugugccuuuuucuuugcugcuuuuacuuuguaucuuuuagcugugauaaauuauagcucugaguaugguuauauucagugauauguuggaucaguugauaugcugaguuuuuuacauguguguauuaucuaaccccuuuauugugcacauuuucccuugaugguaaaacagugaaagcuuuccuugguaacauuguaggugauauaauaaagaagugaaucaaaaagugagugucuuuagguauguuauuuaggacaaggagauacuacuuuagguaaauuauuuuaaauuacacuuccaguuuuuauuaccuucauaugucaauaggaugcuaaaccacagauguuaaauuucaaauagcauuuuaaguuuugcucucuaguuuuauaaaucauauuacauaaacuuacugaacuaaaugugaaaauagggugccaauucacugacuaugugauguuccgaauggguuaucaaugucuauuacgucuagcagacuugcccugcuuuguugaauguguauuuggaagacacuaggcucugugggggaagaaaaagaaauagguuauuaucugugaggcagugaauuauaaucuugggugauggcggcauugguagugaugggauaaaauguguaaacaugauggauauuaaaggcaagaaugacaaguacuauaugacuaggacauguuuuuggaauauaugccucauuagagcagggauuuuguccuguucaucucuuaucacuagcaccuaaaacagucccugggcauaggauagguuagguggaguuaaugugaagccagucgucgucauaaaagugauaauugaguuugaagaggaaguucuuuuuauuauaaaucucugaauccaguaugucagcaaacuuaaaaauauuuuuugggaauaucauaacaguuaauucaugaauaggucagaacuuucuaauguuguaugaauauuaugugaccugguaaucugagacacuuuaauggcgcuugccugcaacuagcuguucuuuuugauacuggauaggacauuuaauucuguacaaacaacuacuaaggguuucuuucccuuaaaaaauuuuuuuuaauugugguaaaauacauguaacaugaaaaccuaucaucuaagccauuuuuaaauguacaguucaauagcguuaaguacauucacauuguuguauaaccaaucucuagaacucuucucaucuuagaaagcuaaaacucuguucccauuaaaccacccucuuuauuccaaacucauucuccuccuuccuccaaccuguagcaccauucuauuacacuuucugucuguauggauuugacaauucuaggugccucauauaauuaggauuauaaaauauugucuuuuugugacugguguauuucaguuagcauaauguccucaggguucauccauguuguaguaugugucaaaaucuuccuuuuuaaaggguugaaaaauacugcauuguauguauauacuacauuuuguuuaucuauuugcccauagcaugacacuuagguugcuuccaccuuuuggcuauugugaaugcuccugcugugaacaugguuguacaaauaucuguucgagacccugcuuuccguucuuugggguauauacccaaaaauggaauugcugaaugauaugauaauucuacuuuuacuuuuugaggaaccaccguacuguuuccuauaguaacuguaucauuuuacauuucacaacagagcacaaggguuccaguuucuccauauccuugccaauaccuguuauucuggcuuguuuuguuuuguuuuuuguuuuuuguuuuuuauagaguugagguuuugcuguguugcccagacuggucuugaacuccucaaguggcacaagcgauccuccugccuuggccucccaaagugcuuggguuauaguuaugagccacugugcccagccuauuuugguuuuuugauaguagccaucacaaugguucgaguggauugcuaagucauacagggauguaaaauugugucuguugaaucaucuauaugaaauacuucauaggaauugaagcuauuaagauuuugaugccuguuggagauuauuggugacuugcuaaaaguaauuuuaguaggguaauaaagggaaaaaugaaauuuucagaggguguaggaguuagugguucaccaggaaguguaguuucucuuuagaaaguuuggucagcugaccacagcacuguggcagucuccggccuugcaaaaauaacuuuuuuccauauagcggucaauaaguauugaggucucuuaaacuacacaagugacucuuccugugcuauauuuguuuuugcagagagaagugugaauucugaaucucugcuacuaauuugggagucuuuguuuuauauuuguaaucggagguaaagagaauugauguaauuguggcuuaauauguuaauacuagaacuuaauauucucaauuuuacuguauguuuuuaauuaauuaauuaauuaauuaauuuuauuuauuuauuuauuuauuuuugagacagagucuugcucugucgcccaggcuggaaugcaguggcacgaucucggcucacugcaagcuccgccuccuggguucaugccauucuccugccucagccucccaaguagcugggacuacaagugcccaucaccacgcccaacuaauuuuuguauuuuuaguagagacgggguuucaccguguuagccaggauggucucggucuccugaccucaugaucugcccgccucggccuaccaaaguguauuuauuuauuuuuugagacagagucucacucuguugcccaggcuggagugcaguggugcagucucggcucacugcaaccucugccuccuggguucaagcgauucuccugccccagccucccgaguagcuggcauuacaggcgcaugccaccacgcccagcuaauuuuuguauuuuuuaguagagaugggguuucaccaccuuggccaagcuggucucaaacucccaaccucaggugauccacccaccucggccccaaagugcugggauuacaggagugagccacugcuuccggccugcuguauguuuuuauuauauacuaugagauaaugagauuagugauggauugcuuuguaauacuuugggagucuggguuuggcagagugugccccuaugaagacuaagugggacuauaaugauuguguuuucuuaaaucagaaucaggaugcauaaccagaugaaggaagacauagucgggagccauaguuuuaauaucuagauuuuggaauuuuagggugauuuacuauagggacaaaguauuugaaauugggauuggcggaacaucaguggaaccagcgauugcuaaguuaaauauauacagggacauuagauaauggaugaugaggaaauggguaaaagaaagugagggccuugugaguugaaacaaaaauaaucaaaccuggaacacuuuccauuuauuguauuagauaucuucauuucaauaaaauuaauguauaugacaaaauuuuauuguccuccuaguucaagugguauucuacuuuuauuuccauaaaaauauacuuucaggauagggaaaggguaaacuugcauuauaaguuuguauuuucucacgaagggacaggagagaagaaaaaaaucauuugcuuauugucuaggcuaugcaaaaaaaaaaaaagaacagccuuguuuuuuuauuacauuuuuucauuuaguuuaugauuugccauauuuauuauuuuaaaacaugaagucuguaguacaagguuuuauuuaaaaacauucucaaaaucaaggacuauuacuacaugcauucagggaagauuaucuagcuauauuggagagaucuccuucgcuaguaauugaugaaaccuaggaauugaaccccagcuucucugacuuaaagcugcccuauugugaaguagaaaugaaguguaagcaauauauucuuaaguauacuggucaauucugauuuacauagaagaccuaacaguuuauuuacucccuacuauuuguuaugggauuaugcugauaguagcuauuacuaauagaagauacggucuaaaucagggaauucguguucuaucagggauggcauaugugcauaucuaaauaauuacuguacacugggauauguucuagauaagagguguauauaaaguagauagagaugaggaaguggaugaugggccuguaugccaguacuacuaucaggaaaaauuucaugaagaugauuucuguauugggcuaguaaaaagcagggaguuucuuggcagacaauuaggggaauaagugaagcauacauuuugacaugagcaaagcacagaaucauuuuauuacuccaagacucauaagacuggcccuguuuacuucaaaguuacuuucuuuauuaucaauccugaguuggcuucaaaugaggaggcauagccaugcauuucugaaaaaaaagggagagaauuagucuguuaggcagcagugggugaacagugagcaaagauaggaagaugaauuuugauaggcagaguugcauauuuugcaacuaaagguagacauugcaguuguauaguugaaagacccuuugguuauuuuagcugcuuauaaccauuaucguuagugaugugcauuuuuucuuuuuuuuugagauggagcucugucgcccaggcuggagugcaguggugugaucucggcucacugcaaccucagccuccugaguagcugggacuacgggcacacaccacgaggcuuggcuaauuuuuguauuuuuugguagagauuggguuucaccauguuggccaggcuggucuugagcuccugaccucaagugaucugcccaccuuggccuccuaaagugcugggauuacaggcacaagccaccgugcccagcccauauacauauuuuuauguaaguauguuuguaaaguuagagauaaaauagugauaauacaguguuacuuugagauaguauaguguuacuuuggcugguacucuaauuuuacuguaugcugcuauuaauuuauauuugggguuuuaagaaauuuugguuugguuaucaugcaguuuguaggguuaaauuaauacuauuaagauggugugguuuuucuuacugaggacaguuaaaauuuucaaauauaaagccagaugaauuuauuuauuuaacaaugguuauugaaugugaacuaugucccaaaccugcuaccguuuaaaauucagaugaauucuccaguaauugccucagaaauuuuccggagcaauuagguaaaaggaguaugauuuuauggguuagguagccuuaauauuuugccacaguauaacucuuaagcuuaaaguaauuuccauuuuuauuuacuauacaaaguauaguuuuaauauuuguauauucuuauaugcauauuuacuaaaaguugugccuuaugaaacucauacuguguuuuguuguuguuuuuuguugucguguuuuuuuuuuuuuuuuuuuuuuuuuuuuuugagacggaaucucgcccuugugccaggcuggagugcaguggcacgaucucagcucacugcaaccuccgccuuacugguuuaagugauucuccuaccucagccuuccgaguagcuuggauuacaggcaugcgccaccaugcccagcuaauuuuuguauuuuuaguagagaugggguuucaccauguuggccaggauggucucgaucuccugacuucgugaucuaccagccuuggccucccaaagugcugggauuagaggcaugagccaccgcacccagcugaaacucguacuguguuuuaaguguuauaacauugaggaauuugaggcagugguguguggucuaauaacagagcaugagagagcuucagcuuugauacuuaauuucuauauaucccaucuuauuccgaaaggaauuucaguuagcuuaauuuccauuuuagugcuguuucuuuuuguguuaauuuauuguuuucuuaauugugcugauuuaaaauccagccaacaaauuaauuuaacgcuugucugucuaaauguauuuucacuucaaagucucuucagugaauaugaagacaauuagcuauauuuuugcuaacaagauuugcugauggggagaagagcgagauaaaggaacaaaucaaggaugaguguuagguuuuuggcuugaacuacuguugaaugguggugguuuuuggcuugaacugcuguugaaugguggugcuauuugggcauguuugugaugcccauuacacauccaguggacaggccaauagacagcucuuugacucuggagagauuuaacaaacuuuaaacauucucaggagcuuagaugaacaaugaacuguuccacucuuuuaagaacuugaaucuugacacacaaguggguaucuuaaagucacauugcaugugauuuuggaggcuuuugagaauccauuuauugauuuaggauuaggggaauacaaauuuaguguuuuaggaaauuguuuaaagcaaagugaauauuaaacucgaauuuuguuuguaucaaaaauucuaaguauuaaaaauguuucucugacuugucugagaaggcucaguaaauaauucuucaauuuguaaugagaguuuugcuuugcauuagcuauuggucuauaaaguccaguaagauagucuaaucucugccuucaguuuuauagauuaguggacgagacagacaaguacugaaauacuuaagaaauacuuuucacaaguggcaauagaacaauguguuauggacucauugcagaaggcugaggagcaguaaaggagggaagguucaagaaagccuucaaaaaggaaauaacacuuuagccagagcccuacucaccaguaagagcaaaaauugugcaacuuugauauuuaagaaauggaggguuacugcuagucauagugguggugaguaauucuauaugacuaaagcaucaaacucuaauaagagcauuauaaaaagaggcuagaaaauuggacaggcaacauucaacauaucuuauaauuaaagauuugguaguuuauguuagaggugauagacacauaggagaguuuuuaaaugugggaguaaaauggucagacuugacuuuuuagaacaguaauaaaggagugcaguuauuuuuggaauucauuuaugugacuuuuuaaagacuucugggguaggcuggugcaguggcuuauggcuguaaucccaucacuuugggaggcuaaggugggcagauggcuucaguccaggaguucgagaccagccuggacaacguggcgaaaccccaucucuacaaaaaauacaauuagccaggcguggcggugcgugccuauagucccagcuacucgcuaagggacgcugaggugggagaaucaccugagcccaggaguuuaagacugcagugagcugugauugcaccacugcauuccagccugggcaacagagugagucccugucucaauaaagaucuuuaggguagacuuaauugcaaaugcuuucuuaaaggauuuguuuguuuucuuagcuuuuuuuuaaaaagucacacgauaaagggugugguggguaccuauaacuuaauacggacaucauuuagcuauauuuuugcccaguuaauacaguaaaugauuaaaaauucuuucuugcuuuaggauuauaugaaauaauuaaauuauauaauaaaugaauuauuuuauuaauguuuagugcuauucucauacagucuaugaauaagguuucuuaguauauuauguuucucaauaauacagaauuuuuuuguuucuuucuuaguaauagcuucaucagagacaauagaauaguggucgggaaguuaaaaugaaauuauauguguagauaauucuguuucauagaguuuaaaugaacuuuggugcuacuucuauucaggaacuauuuagacauuaauguugauguguuaaaaaaaaaaaaaaaccugcucuaggccaaaucagaucuuaaucuggugguaauuuuguacccacagaguuuauuguuuaacagggcaaauuagauguauucucuuuauauauuuaucauaagaguaagaaauguaaguguucuaaaaguacauauaaagguaaaacaauucagaggggaagauuaugucuggaggaagggcaucagaaacucuguaggagcuagggcuuaaaauuaaaagauaaguaagcuuuggaggugugcaaguggggagaccaccaacaagcaaagaaaaagcauacacaaagacacagaaaaaugauuaucaugggauuuuuuuuaaaguagaaucuuagcaacuuuuaaaaagacaaauuaucaggcaauuaccaccucagaccuacugaaucagaaacuacugggaugaggcccagcaauguggcccuccaggugauucugaagcacacucaaauuugacaaacugcuuugcaauuucaggcagauaaauugaccuggaauaugcaacucuuucugaucuuugaucuaggaaagguuuuaaagaaauaaaucugaaguaacaacauuuaaagaguuccaguaauuaguucaauaauaauaguuaacauuuauugagccauuuuauguacuagaccuuuugcugaguaaagguuauuaucucaguuuuauagaugagacacagagagguuaaauauguuaauugucacacagcuaagaaaguaccagauccagaauuuuaauuuauguagcuuacuauaaagcugacauuuuuuggugggaaauaaguuccaacuuguagauaccuuuuuaaaguacaaaacaaaguuuuuacuuguuuuauggaccacuuuuguaucucugaugggcaugaaaauugcuaagaacacuauuguagauuuuuauuuuaauagagcauucuccauuuuaaacuuuaauuauagaaagcauuuuaagaaauggcaugcuaggcuuuaagaaaacuggauaaaugaaaauccaaacuuaaauaagauaaauauuuggacgcaaaaguucucaagguucauuaugagaaauguagucauuucacauaaaagcuuuguuuugcacauuucucaauaauguaauuugucauguaaaagaagaaaagucuggagugggccaggcaugguggcuuacacuuguauuccccagcacuuuggaauguugaggcaggaggauugcuggagcccaggaguucgagaccagccuccgcaacauacauggggagaccccagcccuacaaaaaauaguaauaauaauuagcugggcauggugacaugagccugugguuccagccacuuuggaggcugaggcaggaggaucauuugaacaugggaguuugaagcuauggugagccaugaucaugccacugcauuccaguuuagacaacagagugagacuccgucugugaaugagugaaugaaugaaugaaaaagaaaaagcuuagagugauuguaccaggcauuccugagguacauucacauuuuauaauuaaacucaaccacucuuuguacuaaauuuuuucucgcugacauugaccuaagauauauuccuuuccccucuguguuucugcaacuauuuaaguugauauccuucucuaagucagauucaaaauaauauuuugaaaugcacugauacuauaaguaucuaaaaauacaucuuuucagaugcuuaaucuuugagcagagaaaauacaaacauucuaauuaaaugugcaagaugcguauauaaguaaccaugaggaucuuuguuaauauggaguaacgacaucauaaacaaucuuuucuacuguccuuuuuuauuuacguucaauuuuuugaacaggcaauacagucauacaauccaaaagauaugaaaagacauaauaguaaugucucauucucauccguuucccuuagguacccauuucccuuccccacagacacauacuuuguuaauaguuuuucuuccagagaugauauaugcauauguacaagcaaaugcaaauguuuuuauuucuuuuuaacaccaguaguaauauauuacauauauacauacugcacuguguauauaauguacacuauuguuuccugcuuuuuacauuuauacuuaauauguauuuuucagauacugucaucuuacuauauauaaaaagcuaacucauuuguuuuucagcucucucauauuugaugguaugaauaaaacaaauuuagccaguuuuguauuaagagguuucuuugauuguaguuuuuugcuguuacuaacaaugcugcagugguugggcgcguggcucacaccuguaaucucagcacuuuggaaggcugaggcggguggaucaccuaaggucaggaguucaagaccagccuggauaacauagugaaacgcugucucuacuaaaaauaugaaaauuagcuggaccugguggcacgcaucuguaauuccagcuacucaggaggcugaggcacaagaauugcuugaaccugggaagccgagguugcagugggccgagaucgcaccacugcacuccagccugggcaacagagugagauccugucucaaaacaaacaaacaaagugcugugguauguaacuuugaauauaaaucauuucaugugugucccauuuuuaucuggaggacaaaguuguagaaguacaauucagagacagggucuugcauuguuaagcaggcuggucuugaacuccuggcuucaagcaguccucccaaagugcuaggauuacaagugugagccaccaugcucggcccccacuugcuuuugaauacaguuuuuccucugacacauguauauauuuggagaacucuauuaccacaggaaaucacaagaaauagcaucauaaauguggggaauuuuacuuugacauugugccagugcagaauaagauucuaguaaaucuuuaucauaaagaaaaaaauguauuccuguuguaggucucuaguauugugaugauaaaauuuagucguuuuucaaagaaaaagaaagguuuauaggcaguuuuaguuccuuaaauaucaguaucacaaguagcaaaaauuaaugagaaaguuaaauuuuaucagauuuauuuuucauuuuauuuguauuuaauaauuuguugaaugguaaaaccagaaugcuuuuaauaugucuugaggccugaaagaaaguuccuuugaaauuaaauuucagcaauguaguuguguagaauuugaacaauucacaauacugacuuucagugcuucugaaagcaggaaguguauuacugacacgcagaaauauuccagcccaaagaacaucccuacugccauaugugguaagaauuugucacuaacccacaaacuaguucuguaaugcagugaauaagcagaauuggucuuuguuggacauuuccaauucaauaugaaagaacuuuguuuugcagugucuuguaaguaauuauuagcuuaugccuugggagaaagccuggcacaucaugggugcgugcucaugguuuauugagagaagaaaauucuuuuaggcauguuuuuaaaacuugguuauugugacccuuaguuaaaacacugaaauuacucgaauauguuaaagacugaguuaaauauucugacucagcuuauuaaugauaucuuuaaauuauauuacuuuuauucuguuuucccucuuugcugcucaugugaaauaaauaugaaucuuauguuugcacuuaugcuauaaaagaaauuauccuugggguuaauuauuaagggauggggaaauuaagagcuaagagacaggaaaaugaguugugaggaauuggggucaccagauuucauuaaaaauuugaaaauaucacuguuucucuaaacuuuaauuuuuauuuguuguauuuuaagcgguuaagaagauugucuaccaaauauagaacagaaaagauauaucccacagccacuggagaaaaagaagaaaauguuaaaaagaacagauacaaggacauacugccauguaaguuggaaaugcccuugauaaaauacauagaaaugcuaauuagccuuuuguaaccuaacuaguuuuauucuuccugaguuucacuguuaaggaaguaguaauuaaccuaucuuucaaaguacauggaaagauaauaauucauaauugugcuuuuuguuuuuccuucugauccuaauuuuuguuuaauuuuuuuccuguaaguaucacaguugcucuaauacuaaauuacuuuuaaauacuguaaauccaagugaaaauaucuucugucaacucucuguucaaagauguuauuucauuaaaauaauagacaacugaauacauuuuauaaaaugcuaacaauguugauuuuucauauaucuauacauaagaaccuuaauugauuaauuaugcaugagaaaaugaagcauaggaugacucaaacaucugugugucuacuauucucagcagucugaauaugugccucuaaguauaugucuuagacugauugcauuacauucuaaugauauuuuauuuauuuauuuauuuauuuauuuguuuguuuguuuguuuagagguggggguucucacuguguuccccaggcuggucucaaacuccugagcucauacgauccucccaccucagccuccccaaguguugugauuacaggugugagccacugcgcccugucuguauucuuaaauagcacaguuuucuggcaagauaacuuuaacucugaaaguauacuuaaggugugccaucacuuuauccaguaaaagcuauacgucauacuugcuaucuuuuaaagcugccgucguuuuucuuucuucauaaguauuuugaaauaucuacauuccaucacaucauuuccucaauucuuauucagucuuaaagguuguucucucuaaaaugccuuuaaaguucuuggugacuuuuuuuuuuuuuuuugugacagucuugcucuguagcccaggcuggagugcgguggugggaucuuggcucacugcaaccucugccucccagguucaagcgacucuuguaccuuagccuccugagagcugggacagcucuaauacaggugccugccaccauacccagcuaauuuuuuguauuuuaguagagacaggguuucaccauguugcccagggcccaguggcuuuuuaauugccagauuugguggucuuuuuuuacuguuuauucuaacaggaagaauauugauuauucaagaauguugaacuauuuugaugccauugaucaaucccuauuuuugaaauuuucuucuuccaugauaacucuuuuaaaacaccucuucccucucaucucuuucccucuuuucuccacuaacuucuuugccucaauuuaauccuucauccuuuuguuguucuacauuauuaucagcugugggauauguggauagccuguguuggcagaauuaacaaguggcaacauaacauaaugguauaguguucugauucuggaaguugaaauccugacuccaccaguugcuagcuauaugaccuuggacugauccucucugugccuugguuuugucauccuuaaaauggagauuauaauaauacuuuuuaggauuauuugcacaauagguuaauauuaaaugcuuaaaaguguacccaguggccaggcgcgguggcucacgccuauaaucccagcacuuugggaggccgagacugguggaucacgaggucaggaguucgcgaccagccugaccaacauggugaaaccccaucucuaucaaaaauacaaaaauuagccagaugugguggcacgugccuguaauuccagcuacucaggaggcugaggcaggagaauugccugaacccaggagguggagguugccaugagccgagauugcgccauugcauuccagccugggcgacagaguaagacucuaucucaaaaaaaaaaaaaacaaaaaaacaaaaaaaaccaguguaccuagcacauaguaaccaaucauuaagcuuuugcaaaauaaccaguauaccuagcacauaguaaccaaucauuaagcuuuugcaaaauacacuccacuuuucucaccuguugucuuagucuguucaggcuauuacagaaauaccauaaacaggguugcuuauuaauaacagacauuuguaucuucaaauucuagagacugggaaguccaagaugaaggcaccagcagauaugcugucuagugaagggucacucuggcucauagauggugccuucucacugcacuucacaugguggaaggggcaaacaagcucucucgggccucuuuaguaaaagcugguaaucccauucacaaggcauaaucuaaucaucuccuaaaggcccuaccacuuaauacuguugcauuggaauuuauguuuuaacuuaugaauuugggaaggacacaaauauucagaccauagcaccagucugccucagaauaggggaugacauggcuuucuggauacuucguauuaagcaagauaauuuuaaggugauccuacauugcucuggaauuauucaugcacacauucaaagaguuagccuguccacuuucuuuuucugucgucuagccguagguuucucuuuucauaugauguuucauuuucuucuuuguuuuugaaacggugucuugcucuguugcccaggcuggagugcaguggugcgaucuccgcacacuauaaccucugccuaccagcuucaagcuauuuuccugccucagccucccaaguagcugggauuacaggcacccgcugccacauccggcuaauuuuuguauuguuaguagagacgugguuucaccauguuggccaggcugcucucgaacuccuaacgucaggucauccgccucccuuggcauuuacucauuuuacagaaagcuucugaggguguacuguaugcugggaaugcaacaaaaaacaaacuggcaaaaaucccugcccuuguggagcuuauauguuagucaaggugauggacgauacauauuaacauauauggucugucauguggugguaauuaguguuauugagagugugguucgaaugagggauagggagaaagcagagaauagaaggguaaguuuacaguuuuggcugggguagugggaaagguuagugguguaguguuaaacugguccucugaaaguucugauuuguauuguuugcugauuucugugauaaauggauuauuuaccauaaucaucacagcaaaacucugagguaaguacuguuaugugccauuuugcaaacaggaaacugagacagagagguuaaaaagcuugucacacaguuaaauauugugggguaagaauuuaaacacaggcgguuuuaaagccuucacuagggugauuuugccucucaagggacacuuagcaaugucuggagagauuugguugucacaacugggguaugggaguggacaggcugcuaauggcaucuaacaaguagaggcuaggaauacugcuacacauccugcagugcauaggaugcagcccccuuccccaaacaaagacuucucgccaaaauauaugagugucagcguugagagaccuuguccaagagcuugaguucuuaauuacugugcaguaaucagauugacagugccuuuuuuccuuuaaguuauuuaaaguuugauaaguaggucuccaguaaauuucuaguuauuuugacuugggauuuuuuuuucuuuuuuuugagacagaaucucacucuugucgcccuggcuggagugcagugugggaucucggcucacugcaaccucuaucucccggguuuaagcaauucucgugccucagccucccaaguagcugggauuacaagcaccugccaccaugcccagcuaauuuuuugguauuuuuaguagagacaggguuucaccaugucggccaggcuggucucaaacuccugaccucaggugauccacccgcuucagccucccaaaguacuaggauuacuggugugagccacugcaccuggccuggaaauuuauauugaaaguaauuguacugagagauaugugcuuauuuacuguuagauaacuauuuaauucauugcccgggcacaguggcucaugcauguaaucccagcacuuuaggaggccaagcugggcagauuauuugagcucaggaguucaagaccagccugggcaacauagcaaaacucaacacacacacgcacgcacgcacgcacacacacauacucucucuuucucucucucguguguacacuuguggucccagcuacucaguaggcugaugugggaggaucacuugagaccaggaggucaaggcugcagugaacuaugauugcaccacugcacuccagccuggguaacagagcgagacugucucaaaaaauaagauggagaagaauuuaauucacuaacuuccuuugcauguuuuaacaugugcagugcuugcagaaauagaauuuuuaaaacagguuugagguauaauuuacauacccaugaaauuuauccauuuuaauugugcaauucaaugauuuuuuuaaaguaaauuuauagaguuuugcaacaauuaauacaaucuaguuuuaggacauuuccaucaccccuaaaagaucugagucuucagcccugggcagcuguuaaucagcuuucugucuguauagauuuuccuuuucugugaauuuaauauaaauguaaucauacaauauauagucuuuugugucuagcucuuuuaacaguuuuuuuuugagaugaagucucauucuguugcccaggcuggagugcaguggcaugaucucggcucacugcgaccuccgccucccagguucaugagauucuccugucucagccuccugaguagcugggauuauaggcgcacaucaccaugccuggcuaauuuuuuguguuauuuuuaguagauacaggguuucacuauguuggccagacuggucucgaacuccugaccucgugauccgccugccucggccucccaaagugcugggauuacaggcuugagccacugugcccagccucuuguuaacacauuuuaaagauucauucacgauguagcaugcaucgauaguucauuccuuuuuguuguugaauaauauuccauuguaugaaugaugaacauauugaauaaugcugcuaugaacaugucauacaacucucuguguggaccuaugguuuuguuucucuugguuggauagcuagcaaaaccauggagaggaauaauuguuuucauuuuuuugauauuuagauuauuucuaaauaugcuuaauaagagcaccaaucuggcagggcgaggugacucaugucuguaaucccaggacuuugggaggccgaagcgggcagaucacuugagaucagaucaagaccagccuggccaauacggugaaaccccgccucuacuaaaaauacaaaaauuagcuaggcaugauggcacgugccuguagucccagcuacuugagaggcugaggcacgagaaucacuugaaccugggaggcagagguugcagugagccaagauggugccacugcacuccaaccugggugacagagccagacacugucucaaaaaaaaaagagcaccaaugaagaauauuaaaacagccacccaaguucuuucucgcuacuucuaguucccggcgcuuugccggguguuaaugguggcccaaaaucaugggugcuguggcuuucucccuaaggugucacaggagcuaagggugccacuuaacaaacugcagaagaugcaggcaggugaaggacacccagucugcuguggcaguggaauguggcagaaaagccagcugggagggcggggagcaauccuggaaggccuggcugaccccacaauugaacaggguuuggugugucauugcuuuuaggccuuuucaguggacagaacugggguggauauacacucauuuauuugaaaucaugcauuuguuccauacuccaauuccagcccaccccuucuuugcucuauggucaagugagugagaacaggcggcuacauuuucagccuuguugcucaccgcuuccuuccaguagucccauguugcuucauaucucuucaguacauguauuauuuagacccagagccuuggcuuuuaaaucaggcagccccaguuucaaaugugucacugccaucucaguuuugugauuugggcauaccucugucugugcauagcgauauuaacuucuaucuccauggguguguggugaggauaaaauuaugugcuuagaggaaacguucauuccaugguagcuauuuuuuauuaauucuauacuuuugaaccuauuaugcuaccuauaaugcccuauuuuuuuuuucuuuuuaaucauuggcaaacuucucauucccugagacccagcuugucacaccucugaagacugcugauauccucaagauguuccuuacucccuuuccuugcuacuacuuuacuauggauauaugaacaacauuauugugcuuauuacaugcaauaaauauuuauuggaugaaugauacuaaaauucacauuuaaaaugccaaaaucaaaauacacaugauaugcuguauaaguagcauaauguugauuuuuaaaucuaaugugcuguggguacauaguagaaagcagugacuaccaaauuugccuguguuuuagaauuuaaauggggaguuuuaaaaaggguauuucugugccccauuuuuaauuuacugaauugaacuuacuacaagauguaguacuccagaaaucuuggauuuuaauuugcuuuccccagcuguugaaugauuggggauagaugaaauaagauuggcaaaauguugauaaugaagcuggguaauggauauacaaagauucauuauacuguucuauuuugguguaugcuuaaaauuuuccaucuuagaaaauuuuuuaaaaaaagaaauuaccagccugcauguagccagccuggcaccaguccuaacuaucauuugggagccacuauucucauuuggauuuacagucaccagaaacuuuacugaggacccagugguaaaccagcuauuguauucugccuuugagauacuuugaauagaggcuaauaugucauaugaauaaggguaauuaacugagaccccuuauuacuggcaaacaugguaagaggaagcuuccuguaguuauucagccaucauuauccuaaccacugaauauucuauucucauuuuccagagucauagcuuuuuuuuguauguguauuuccuaucccaaauggcauauaaaaagggggaugggacauguaggguggcgugaaauaaaugacagagcauugacaaacauauuuuaaacauucuguuucuuagaauacagugaggagaugaauaauuuucaccagaagcaaguauaucuuccuuauaugugucuucuacaaauuucuaaagaagacuuuuuuaaaaguaaauuuaucaauuaaauuagcagaacugggccuuuagugcuauguauaaaauuugagccaaugaaaaauaaauuaguuacuauuaguuguucuuuaauacuuugcuaagaaguuuauucaugucuguuaacauuuccguauuuccuuuuguauuuuuacugccuuugauacucauucauggauuagaagggauuauaauuugauaauaauaauggcauuuuacauguuauauguuauggucccuucuaauccagaaacaaugaauacuaggcaauucuacuuuaggauuucauaaucugaaagcgucuaaccucaaauacuuacuaacuauaaaagggaaaggcaguaacuuucccuuuugguaaccaagcaauaccauauuaaccaagugaccaagguuaacaucacaaguacuaaagcauauguauaucauguauccucugauguguugugcugagaaggacacaauaucguucugugguauuaccaaaaauucauaacuucguuccagucauuuaaaaaaaaucaaucagagaaacuuuuuuagauugaaggagacuaaggagaaauaaaaauuauuauuauuauuaucuugagauggagucccacucugucacccaggcuggagugcaguggcgcgaucucggcuuaccacaaccuccgcuuccuggguucaagugauucuccugccucagccucccgaguagcugagauuacaggcaugcgccacgaugcccugccaauuuuuuuuguauuuuuaguagagaugggguuucgccaugugggccaggcuggucucaaacucuuaaccucaugugauccgcccaccuuggccucccaaaaugcugggauuacaggggugagccacuaugccuggccacuaaaaauuaaauuuaauaugagauccucgaaagagaaaaaagauuagaaaacacugacuuguauagucuuguuuaauuaauaguuuuauaaguguuaauuuugugguauuauugaucauugucuuaugguuauauaagauguuacuauuagaggaaguucagugagaggcaugggaauucucuguacuauuuuuacaguuuuucuauaaaucuaaaauuaguucuaaauaaaaaguuuuaaacaucagcacaaacuggaaaaaacuauuugcacuuccugugacagagggcugauuuuuucuuuuuacauagaucucauaaaaaucaguaggacaaaacagacguggaaaaaugggcaaaggauauaaacaagugguuuauggaaaaagaaguacacagaaccaauaaauagauuaaaacauacaauccuuugcauaauucaagaaauggaaauuaaaacaagauauuuuuacuuuuugguuugucagugaugaaaaguuugguaauacccagucacccuuauuacauaacccuguauaaauuguuucauaccuuuuagaaggcaaguagcaauuccucuguuaggaauuuacccuacagcaaugcugguaacagcuauauauacauuaguguucauuguaguaauguuuuuaauaggaaaaaaauggcccaucaguagaguagcuaaauaaagaaugaaacauucacaugauggaauucucuguuacacuaaaaagagugagauagccuagugcaagcugagugcaaugguucacaccuguaauccaaacacuugggagccugagccaggaagaucuguaguccaggaguuuuagguucgaaugagcuaugauugcagcacugcacuucagccugagugacagagugagaccuugucucuguauuuuaaaauaauaguaaaaauaauaaaguaaaucuuucugugcuuugggaagaguuccaggauauacuauaaacugaaaaguaaugauacagaacagcauguauaggaugcuugcauuuguguaguaguuuuucaaaguauauaacuauauguguaauaaguacacuuggaaugggaaaaguaacuuuaauauaguaucuugaugggagagagcccuggaauugaagggcaggggaggcuuacuuuucacuuuauaccuuucuuuaaggucuaauuuuuaaaaauuauauacauauuccuuuaaaagaaaucaauaaaaacuuaaaagaaaaauauacuucauaaaauuuuuuaaagauuuuuuuacucuauuaccuaauaauaacuauuauuagccaagagcaguguugaacacuuuuuauauauaaucucaauucauuaauuuguuauaauuugcuuuuuauaguuucuugugaaauaugaaaguuacauuuuuuaaauaagaauuuuagcauaugggcuuguguaucacugguuaguauucaucagccacuugguauguuuguuaaaagcugcagaggcugaaacccuagacucugcucuaguaaaucagagauaauguccuggaauuugaauuuuaaaagaguuccagagaugauucuuauugcaacuuuaauacacugcuuuacgucacugguggugguguuuuuuuguuuuguuuuguuuuguuuuguuuuuuugcuguuguuguuuuguuuuaagacagaaucuucacucugucgcccaggcuagagugcaguggcgcaaucuuggcucacugcaaccucugccucccagccaguuucaagugguucuccugccacagccucccgaguagcugggauuacaggugccugccagguggugguugucugaaaauuuauuucauuuccuuucaguuuaauguuagaaauuacccugcugguaccuagaguccauuuucauccauuguuuuuuaaaauaaauguucuuaagcugucuauuuaaccuuacuuacgcuucauuagaaaauaccugugugucaaccauacauauuuuaugaauuuuuuucucguaguugaucacagccgaguuaaauugacauuaaagacuccuucacaagauucagacuauaucaaugcaaauuuuauaaagguauguacuaacuuuaaaugguguuucucugccauauuaaugucuuucuacauacuaguuuuguaaaaacuuuuugaauugcucaaacaugauaccaacagcaaaagaaauaaaaauaaagccacugcccuggcacaauguuuuuauaugcuuuccuucuagccuucuuauucauauagauaaauaguuucuacuuaguuuugugauagcagagauaacauuuucuuuuuuauuucuucuuucccauggaagucuuaccuauuacuaaauuauuuucucaguuaucccuuuggacacaaaugaacaucaucaauccccguuguugacccauauagguuguuuccaaauuuuuaaaaugauaauauugcaguaaacaucuuuguuguuuugaauaauuucuuaggauaaauuacuaggggugggauuacuggauaauacugauuuaaaauucuagaacauagcuuuaaauguaaaacuuuuggcaguugucacuguuucagguggcaacccaaaauccaagauuaaauagucucuuuuauaaccuuuguuuggauacccuuugaugaaaagcagucaaguucuuuuuuuuuuuuuuuuuuuuuuuuuuuugagacggagucucgcucugucucccagucuggagugcaguggcgcuaucucggcucacugcaagcucugcuucccggguucacgccauucuccugccuuggucucgaucuccugaccugugauccacccgccucugccucccaaagugcuaggauuauaggcgugagccacugcgcccagcgucaaguucuuuaugguagcaguagagauagaugcaaagugcuacuugauucaguuuaaauaaaaggcuuuuuuuccaucagcuaaucugugauuuuuaaucuuucaagugauaugauaguauaauuuucauuuauuuuauauaugguguuuauacauauuuucauguuuuuguugauaaaaauguuaacugauaaaaguuuaugccaggccgggcacgguggcucauguccguaaucccagcacuuugggagaccuaggcggguggaucaccugagaucaggaguucgagaccagccuggccaacauggggaaacccagucucuacuaaaaauacaaaaauuagccggucaugguggugcaugccuguaauaccagcuucucgggagacugaggcaggagaaucgccugaacccaggagguggaaguugcaguaagccgagaucgugccaaugcacuccagucugggugacagagcaagacuccgucucaaaaaaaaaaaaaaaaguuuaugugguaaaauuauuaucuaugucaauauucagcagucaugguuuuaaauaaaaauuucuuuuuuuaacaaaguuaaaaaccaaaaugaauacauuaaauaaaaacuaauaaauugauaguuugcuauuucagauguugucaauguucauauucuuuuuuuaaggcuguuuguuaaaaguuauaguuuuuacuuaugcuuaaugacacugauucauuguaugagucaguuauguaccaguuuaguauuuuagucagugacauuguuugguuuauauucucauguucauuauuaaaaaccuguauaguagaugcuugauaaacuuuugaguugaauagauaauggaagguagcuauggaagaaacuaagaaagagcucuucacuaguuuuaguauuguuuuagaaucagagcaugcucuguauuucugccaguuagcuuuguugaguagguauuagggcuuuuguuauuaaugccuagauaaguaauaauuuuuaauuagcauaaggcgguucuuaaauaccuauucugugcaccauauccaguaaacacaaaguaauagcagucaucaaaagcuuaagugaauugaauauauuuugccaugcuuuaauauacuaugaaagacacauuauuuggaaaugguuuaaguuaaaacaacaauauuacuaauacaauuugaaaccuuauauuuuggguaaugaaauauuuuugguaaucaaaauaaaugugaaauuugcuuuuaaccauuuuuagggcgucuaugggccaaaagcauauguagcaacucaaggaccuuuagcaaauacaguaauagauuuuuggaggaugauaugggaguauaauguugugguaaguaauuuacuuuucacaauaaauuuugagaaauacuuauguaauaacauaggcuauuuuacugaauaaggaaugaggggauuuuuaaaaaauccauaauuauguuuacuuauugcugauguuuacuaaaaagauggacccauuuuuaggaugucucauuaaauuuuuacaaacuaggcuaaauauuuuaagaaggugugauaauaauuuaaaucuuguccuaagucaguaaguaaugauacagcuaucaaacaacuuauaaaaagcagaaaaggauuagugcucuaauaggucaguaaaauacuugauaguacaguuauacucauuugagucccucuucucaggaaaauauauauaaacacauaacuauaaauagacuauaaauaugcaguauaagagaauuucaucuaucccuggaguucauucagugcccucuuguucuuuuggaugaagggaaauaauaugcccuuagauuuagaagcagagaaauuagaauacugcgaagagcuacccuauacugcucuguaguauucuugaaaccuaaccaugugcauugauacuuuucauuguguggauguggaaaaucaguaaugugaaacuuucauuuuugucuuacggcuuuuuaauggaauuguaaugauucuaaagcauugacaugcucuggucuuugaaagauuaauaaaaggggggaaauuuuccaguuauuuauauuugcuguacuucacuuuaaaaacuagaugugcuuggggauugagaaagagcaugaagaaacuuucuggaugaugggaacauccuguaucuugauaagauuuguguugcacagauguguguauuuguccaaacucggagaauguucacuuuaggauuugugcauuucauuauauguaaaauuugccucaagggaaaaauacuggaaacaauauaaaaauuauguucuagauuggccgcgugggguggcucaugccuguaaucccagcacuuugggaggccgaggugggcagaucacgaggucaggagaucgagaccauccuggcuaacacggugaaacccugucucuacuaaaaauacaaaaaauuagcuggacgugguggcgggcgccuguagucccagcuacucagcaggcuaaggcaggagaauggcgugaacccgggaggcagcgcuugcagugagcugagauagcgccacugcacuccagccugggcgacagagcgagacuccgucucaaaaaaaaaaaaaaaaauuuauuguguucuagauaauaauaugcaugcugaaguauuuuggggagaguguacugauguucacaacuuacuuugaaaugcauuuuuaaaauaagauggauugauagagggauagcuaugugauaaaacauggugaaauguuaaugauagaauauaggugauggcuauacaauguuuacuguaaaauucucaacuaugcuguguguuggaaaguuuacauuauaaaaugggaaaaagcaggugugaucaacuuuuaaaaugguguuaaacgcauucaauauuuaaauaauuauaaauauauuuuuaauuaauagugcuauuuauaauuagguaaauauccuaaaagugauauuuuaauauaauuucagaagucacaaaguaaaucuguaagauuuacaugauuuaauucaaaccaaaaacaucauguuaauuggaaccaauuuaauuuguugcuguauaguuagcccuuguuuggaaagucuaauuuugauaauuucuuuaacuuacacauuuaauauugaaacuacuuuuuuaggcaagccaauuauacuucucggugcaaaauucuugaaaucuguauuuuauuaaaaaguaaaauuguguuuaacugauacguucuuuaucucacuccccaccaucacuuuuuagaucauuguaauggccugccgagaauuugagaugggaaggguauguauaaucuauuccucuuacuauuucauuuuuacggauaaauauucuuagucuuuuauuauuauagucuuaacauaagcgguuaauguagauacuucuuuuauuuugggguacugcuguugcuuuuauuucauacaagggacaaaauaaucucucaagcauguuguuuucuuuuauauuuuguaaguauguuuuaucacacacaggcauaccucagagauauuauagguucaguuccagaccaccacaauagcgcaauucaaacaaauuuuuuguuuucuuagugcauauaaaagucauauuuauacuguauuauagucuguuaaauguucaguagcauuauaccuauaaaacacuucaugccuuauuuuauuuuuuuauuuuuucuagacagagucucgcucuguugcccaggcuggagugcagugguacaaucuuggcucacugcaaccuccgccucccagguucaagcgacucuccugccuuagccuucugaguagcugggauuauaggcaugugccaccacaacuggcuaauuuuuguaguuuuaguaaagaugggguuucaccauguuggccaggcugguuucgaacuccugaccucagguguucugcccaccucggccucccaaagugcuaggauuauagacgugagccacugcgccuggccuuccaugccuuaauuuaaaaauaauuuauugcuaaaaaauguuaaugaucaucugagccuucagcuaguuguaaucuuuaugcugguaaaggguuuuguugacguugauggcugccgacugaucaaguugguauuugcuaaagguugggguagcuguggcaauuuuugauaaaauacaagacaggaccaggaacgguaguucacauuugaaucccagcacuuugggagguggaggugggaggaucacuugagcccagaagguugaggcugcggugagcuaugauuaugcuacuguacuccagccugggcagagggagacuccaccuauaaaaacauaaaauaagaaacagugaaguuugccacauugauugucucuuccuuucaugaaagauugcucuguagcaugccaugcuguuugauagcaacagcaguugcuguucuacccacaguagaacuacuuggcaaauuggagucaguccuuucaaacccuuccacugcuuuaucaacuaaguugauuuaauguccuaaauccuuuguugucauuucaagugcucacagcaucuucaccaaaaguauauuccaucucaagaaaguagauuccaucucaagaaaccacuuuauuuucuuauccguaagaagcaacuccucauccauuccagguuuuaucaugagauuguggcaauucauuuccaucuucaagcuccacuucugauucucuuuguuguuuccaccacauuugcaguuacuuccucuacugaagucuugaaccucucaaaguuaucacgaggguuggaauuaacuuuuuccaaacucguguuaaucuugauauuucgaccuccucccacgaaucaugaauguaauuaauugcaucuagaaugcugaauccuuuccagaagguuuucaguucacuuucccuagacccaucagaguaaucaugauuuauggcagcuuuagcuuuacaaaauauguuucuuaaauaauaagacuugaaacucaaaauuacuccuugauccaugggcugcagaauggauguuguauuagcaggcaugaaaacauauuaaucuccuuguacauguccaucagagcuuuugggugaccaggugcguuguaaacggaaauauuuugaaaggaauuuuuuuuuccaaccaguaguccccaguagugagcuuaaaauauucauuaaaccaugcaauagggaugggcugggggugggguugaaaaaacaaaaacaugcuguaaacagaugugcugacauccaggccuuacuccauuuauagaggacagacagaguacauuuggcaugauuuuuagagcccuuaggauuuucagaaugguaaaugagcauuggcuucaacuuaaugucaccagcugcauuaaccccuaacaagagagucagcauguccuuugaagcuuugaagcuagacguugacuucuuuucucuaguucugaaaauccuagauggcaucuucuuccaauauaaggauguuucauccauacugaaaauaugucauuuaguauagcuuguuucaucagugcucuuagcuuagaucuuuggauaacuugcugcagccucuaaaucagaauuuggugcuucaucucgcacuuuuauguuauggggacagcuucuuuccuuaaacuucgugaaccagccuuugcuagcuucuaacuuuccuucugcagcuuccucacacuuuauagaaaugaagggaguuagugccuugcucuggauuaggcuuuggcuuguagaaauguugcagcugguuugaucuucuaucuagaccacuaaaacuuucuccauguaagcaauaaggcuguuugaccuacuuaauuuuuguguguuuccuggaguagcucuuuuaauguccuccaaaaacuuuuccuuuuuguucuaaacuuggcugauuaguacaagaggccuaccuuucugccuaucucaguuuucaacaugccuucuuuacuaagcuuaaucauuuuuagcuuuuuuauuuaaagugaaaaguuugugacccuuuucacuugaauacuuugaggccauuguaggguuauuaguuagucuaauuucaauauugugucucaggaaauaggaaagcccaaggagaggaagagagacuguacaaaaacuugucaauggaacagugagaaugcucacaacaucuguugauuaaguuugccauuuuauaugggagcaguuuguagcaccccaaaacagaguaguaacuucaaacaucacugaucagauuacaauaacagauaucaucauaaugaaaaaguuuggaauacugcaagaguuuccaaaaugugacacagaccugaagugagcauaugcuguugaaaaaaugauaccgauauacuugcuuggugcaggguugccacaaaacuucaauuuguaaaauaugcagugucugagaaacacaguaaaaugagguaugccuguacuuaacaauaauuaauuagguauuguuacuuaguaaacuucaaauauucagugguguuguaacuagaaugcuaucuauggacugaaauagagagguauuuuuaaauaggaauaaaauugaacaaguggaaauacauuuuaaaaaucugguuaucauuaauauaugguuugaauuuuuguuuguuuguuuguuuugagacugugagacagaauccugcugugucagucaggcuggagugcaguggcgcgaucucggcucacugcaaccuccaucucccggguucagguauauuuccugucucagccucccgaguagcugggacuacaggcgccuaccaccauggcucagcucauuuuuguauuuuuaguagagaugggguuucacuguguuggccaggcuggucucgaacuccugaccucaggugauccgaccgccuuugucucccaaagugcugggauuacaggcauauaaucccauguaauccaccgcaccaggccugaauaucuugauuagucuguuuguuaauaccacaguauguuuuguuuguuuccuaucuucaaaacugagagaagauaauuucuuacccugauuuucuaacauugguauuuuuaugcuaugucgaaguaaaauuuauuucaaagcuauucugguauccuacagcaucauauucuguccucacuguaggagguaaugauauauuuacagauaauucauauuuaaauaaaacuuauaaaguguggucuucuauaaauauggcauacaaaucaaacuuacaaauuacauagugauuuuauuugaaguuuuuuaauacuaauguaguuaauauauuuaaaauuaucuuuaguuuguaaauauguuaauuuuuucaguaagcaauauauugcaaaagauacaucuuucaguuauauuacauaaauaauugggaagccuuaauuuauuccauuacucccaacuauuuccuaugucaguauuaaguaauguuggacagaaagugaauaaaaugagaaaauauaaaaacugagaaauuauuaaguaaucaaguuaucuauuuaaggguugucaauauauacauuaauauuauuaaucaauugucuaagagaauuuaaaugucauucuccuaauguuuuaaguuacuguuaagguuuaggauguauuucucuuuucauuauauuaguaagcucauaguauguaucaaguuauugaugaaaaaucaaguagcauugaguacauaauuuuuugaagcgaaagguuuuugugauucacugugucuuauuaguaauagauuaugagcaaguuaggaacuaugaaauuaucugauaaccuugacuuugaucuugacuuugaaugugaccugguggaaaaagcauagauaauuaaaucagacaaaccuaccuuuuacaagcauuuugaccauggugcaguacaguucacucugagcuucaguuuccucacauuugaaaggaaauaauacccaccuugcaguguuagagauuauguauguaugauauuuaacacauaguuuuugauaucauuauuaguuuuauaccaggaauauaaguaccaauauaaucuuauuacugcucaucugaaugaggggcauuguuagucacaccgcuuucuauucuuaacuaaauuaaucucuuacaacuuguuuucuaucuguuucaaaguauuaaaguuuugucagguaaaagauuaaaaaaauguuuuuuaaacucucaaaaauaauuuaagguccaaguguaaguauaguggcucacaccuguaaucccagcuacuugggaggcuagggugggagaauugcuugagcccaggaguuugagaccagcuuuggcaacauggcaagaccccaucucuauuuuuuuuaaaucuuuuuuuuuuuuuuguggggagagacagucucgcucugucgcccaggcuugagugcaguggcacaaucucagcucuuugcaaccugcaucucccagguucaaacgauucucaugucucagccuccugaguagcugggauuaaaggcaugugccaccaugccuggcuaauuuuuuuguauuuuugaguagagacaagguuuugccauguuggccagucuggucuugaacuccuugccuuaagucauccacccacguuggccuuccaaagugcugggauuauaggcaugagccaccacgcccggccuccaucuauuaaaaaaaaaaaaaauuagccgguugugguggcacacgccuguggucccagcuacucaggaggcugaggugggaagaucacuugagcccagaagguagaggcugcagugagccgugauugcaccacugcacacuccagccugggugacaaagugagacccuaucuaaaaaaagagagaauuuaauuuaaucauuuucuguaaacaucucuuggaaaaugagauuuggaaguuaccuguguuuuuaagccucuaaaauguuagcuaacccaacauaccagacaguucuacuuuguuucucugugagcauuacugucaacuuauaguucauucagccuauagguaauaacuccauuuacuguauuuggaacugugaagauuuaauuaggaauucauuaaccaaugcauuucccacugcuuaaaagguuuauuuaagcuagauggucacuuagagacuuugauuuuauugggccuugauacaaauugcaucauuucuuaauaccugaaucauucuauuuuccauaaaguuaggcuuuucauucacuuaacugauuuucuaaaaugaugaggugcuugauauuagaaacugaugaaaauuuaucauucuuuuucuauaccuguuuaaaauaggaagguaagaggagaaauuauuugacuacacuuucuguaaucucuaauaaaauugaauaguuaauacaucauguuuguguagggcuuuuaccaucugugguacauuugaaauacacuguuauuuaacaaacaugcaacaacucuguaagauaaggauuauuauuccuauuuuuacagauaaagaaacuaaaggucaauaaaggaguagaauuaguacuugcaaaauucuucugauuccaaguagaauauucuuuccacuucaucacauauuuuacauuuaaugagaauucagccagauauuuguagagauugucauguuacaagcaauacaacuuaccuagcaaccuuuauaccaaauaccuccuuguaccagacacuuuuuuaaaauuaguuuuucuugucuagaggaggaucuuuggucuacucuguagaccuggcagauagcaaugaacaguuaugcacuuaagucaguaagguucuuaugacuauucuuggagaagacacaguagccuauuuuuuaaaacaacuggguaaaucuaagcucucucagcuccaugccugcuaauguggguuuuucuguuuuggggaaguagaaguaagcagaaccucaggacacaaaauauuuauaacaguuuaagaaaaacuuacaugaauuacuuacuaauuuuuuuuuuuggaugacagaaaaaaugugagcgcuauuggccuuuguauggagaagaccccauaacguuugcaccauuuaaaauuucuuguguaaguauccauuuuuguaaacacuuuuuucagaaaauuggcaugcuauacugaugaauaauuaaauuauaaugugguaugaacccaggcuuauagacgccaaggacucacaaaccuaugcuuacauuuaaaaaaauuuuguuuauauacugcuuuuaaauuuggaagcuuuuggguugacuucauaaaugcauauuuuccuuguaucuuacuauauugauuguguguuagucuuuguauaucaauugauaguagguguuuacauguaaaugaaguaacugugcuuuuaauauuuggaaaucguguauucauuucaaauugauuaaaugggaaagacuugguaacuggaguacaguguaucauauuaacccuucauaucuaauugugcucucaaaaauuguuauaauuauauauaaagauaaguuuaagaccuaccauacuggaaguaaagauugguccugucuggcagauuauuugauaugaaacuuaaaauguuuucuuaauauguaaugaccucuggaaaugaauuaaauucaagcucaaaagcuaacacagcaaaaaucugagaaaaugaauaaaaaaaugaaaacagugaaggaaauaggaguaggaaaaagaaaggcauggacaaaaagaaggaaaauauaagugaauuuuaaaauagaaccaaguuuucuuuaggugccauaaaaagacuguaauugaacauaaccuaaaaaucaauuaauuuaggccaggcacaguagcucaugccuguauccuaccacuuugagaggccaaggcgaguggaucacuugaggucaggaguucgagaccagccuggacaacauggcaaaacuccuuuucuacuaaaaauacaaaaauuagcuggguaugguggugggcaccuguaaucccagcuacuugggaggcugaggcacgagaauugcuugaaucugggagguggagguugcagugagcugaaauugcaccacugcacuccagucugggcgacaagggugaaacuccaucucaaaaaaaaaaaaaaaauuaaugaauuugccuauauuaggguucuccagagaagcagaaccaauagaauaagagugugugugcaugcgucugugugcauguguauacauuuaaggagauuuauuacgaggaauuggcucaggcaguuauggaggcuggccaguccaaaaucugcaggguaggcuggagauccuggagagccaaugcugcaguuucagucugaaugcugauaagcuggagacccaggagagcugauguucaguucuaguuggaaaagucuguuguagaaucaggaugagccaauguugcagaugaaggcagccugcuggagaauucugucuugcuucaggaggcugguccuuuuguuguauucaggccuucaacagauuggaugaggcccaacaacauuauggaggacaguuugcuuuacucagagacuaccaguuuaaauguuaaucuucuccaaaaacagugucacagaaauaacuagaauaauguuugaccaaauauucugggcacacuguggcccagccaaguugacagauaaaauuaaauaucacauuccuuauucagaguuucuuguuuuugacuuuguuuuccaugauuaaacgaaauauaauuucugugguuuuacuugucauugcugaguucuugaacuccauaauuuuaugacuuaguuauacucaugacuucugaauuccucucauacauacccaaaguuuagugcuuucuagguugacauaaaaaaggacaggacuguaucuguauuaugcugucuacuuuauaaaucaauguuguuuuuauaauguuaacuauaacucaccauugaacuuuuuggauguaguauuuagucaauauucuuaaggugcugauuagaauuaacuauuugugggguaaauguaaaaauuuuaggccaggugcaguggcucacaccugucaucccagcacuuugggaggcugagguggggaggauugcuugagcccaggaguuugagacaagcccgggcaaaauagugagacauuauuaacauuuuuaaaaacguuaaaaaucccacugcauuuccuuuuauuuggcuugaauaauacccaauacacaccacacugucuacuucaguggggaaauaccaacccuccuucaccaauccagaaagaaaucuguaauauuagauuccucgacaguguagaaaccuaguucuguguaguaugguuguuuuggacauuuguaaauuuauuuuuaaaguuuuauuuguauauaucuuuuugagacaggauuuugcccugucagccagguuggagugcaguggucugaucauggcccacugcagccucaaucccccaggcucaagugauucucucaccucagcuucccaaguagucggggcugcuggcaugggccacuacuaauuuuugucuuuuuguagagacgaggucucccuguguugcccaggcugauuuuaaacuccugagcucaagcaguuugcccgccuuggccucccaaaguacuaggacuacaggccaccacacccggccaaacauuuguaaauuuagauguaauaagauaacuauagugaauauuauaauucaagagaaaauacagugcuuaacaucaacaacaaaccaacuugaaauuuuugaacauuugagagucaggaauaguaaacaauuuacaauaauggauauaaggcagaaugcaauaguuuauaauguagaaaaugaauugauucuugggggaugguuuuucaauuaaacuaaaagguauaucucuauaaaugguucacaaagaaaaaacaaaacauggagaaagauuuauuaaaaagaaaacagauaacuugaaaggucucuagauaagugguuugguuugauuugauuaguaacgacuugguuuaauuugucagcgucaggauugauccaugcugaagaaauauuuucuuugauaauuuuaaaauggaagguaauuuguuugucuuauaauugguucagacaacucgggauuuguuaucauugacuuaacugcaaagaaaaaucaaauuuauaaauagcauguugguaaaaauauucguaguaagucauuugacuacuuggcagucagaguuugagacugagaaaugacugucuuuucuagagcucucucucgaugugggaugaggacaaggguaaagugguggugaaagggugaagacugguuagcaggagcucaaucacauguugccacauguaagcacuuagacuggaugucagcacacuacccauggcucagaucuagcccacugccuguuucguaaauaaaguuuuguuagaacacaucuauaugcauuaauuuaugaauuugucuaucacaauagcaaaguuguguagacaaagacuuuguggcccaaaaagccaaaaauauuuacuaucugguccuuuacagaaauauuugaaaaaguucaaauauuauuugaaaaguucaaaguaaauuacuguaauuuuaaaaauuaaagcagguauaauaguauuauuuuuauuaauaaaacaacauacacuguuguucuucauaauccuuguucuaaacuaucuguaguuuuaaccaauaaggcaaaaagaauaauuugcuuagugauagacugauguagauuaacacuuugacuaaaucacaguaagagaccuuuaaagugguuauguuaucaacaaccacaauaauaauaauaauuugggguguucuucccucuuccuucuucaguugcuauccaguuaauugaaacuugaauguuagggaaaaucauguguuauggaaagguaaaaugguugaagauaggauauggugguugguacugaggaaugacauucuauguauauuuacaugauucugggggugguuacuacuuugcagauauuuuauugggugguagaugcuuaaguaauucguuuagacacuuuuuuuuagguauaaguaaaacuuacaaaagcaaauugauguuuuuuucuuuacugucuauacaaauuuuuuuaaugaauuuuuuuucuucaaguuucuuaguuuaguagguaacuugauucccaaauucacuucucuuauuuguacauauuguuugggucuaucuguuaggagacuuuaucugauaggagacuucauuuuaagguuuuuaaaaaaauuuuuuuuuuaguguuuuuuguuuugagacagggucucacugugucacccagacuggaaugcagcgacgugaucgcagcucacuauauagccuuggccucacugcugggcuuagugauccaccuaccucagccucccaaguagcugagagcacaggcuuacgccucaauguccagcuaguuuuuguauuuuuuuguagagacaggguucugcuauauuguucaggcuggucuugaaccccuaggcuaaagcgauccguccaccucagccucucaaacuacuggcauuacaggugugagccacugccuaacuuuuucaagacuauuuuuuuuagagcaguuuuagguuuacagcaaaauugagaggaagguacagagauuucuuauauacacccuguccccacacauguagcccucauuaucaacauucccuaccagagcagucucuuuguuacaauucacaaaccuacauugacaagucauuaucaccaagaguucacauuuuacauuaggguucauucuuggugcuauacauucuguggguuugaagaaauauaugaugacguguauccaccauugugguaucauacagaauagugucauugcucuaaaaguccugugcuccaccuauucauucaucucacccccuucccaacccuagguagucauuauuuuuacugucuccauaguuuugccuuuuucagaagucauauaguuuguuuuuguuuguuuguuuguuuguuuugagacggagucuugcucugucgcccaggcuggagugcgguggcacuaucucagcucacuauaaccucugccuccuggguucaagcaauucuacugccucaaccuccugaguagcugggauuacaggugcgcgccaccacacacagcuaaguuuuguauuuucguagagaugggguuuuaccauguuggccaggcuggucucgaacuccugaccucaagugauccaccugccucagccuccugaagugcuggaauuacaggcaugagccacugcucccagcucagaagucauauaguuugaaucauacaguauguagccuuuucagauuggcuuauuucacuuaguaaugugcauuuaggguucauccaugucuuuucauggcuuacuagcucuuuuuuuccuuuuauuauuuuuaauugacacauaguaucuauacuuauuaaugggguacaugugauuuugguacauguauguguaauuuaaaauguggagugacuaaaucaggauaauuagcaugucuaucacuucaaacauuucaaauguuugaugacuuuuagaauuuuuuuauaauuaucagguacaucuggaauuuuaaagauuaauuuuauauuguggacuuugauacaaguauuuuauuuguuuugaugugucuuuuuguuuuaacguuuucacugacuuagaaauguuucucuuuauuuaggaggaugaacaagcaagaacagacuacuucaucaggacacucuuacuugaauuucaaaauguagguacuuaccauuuauagacuaucuguaagaauaguuuucaggcugggugcaguggcucaugccuguaaucccaacacuuugggaggcugaagugggagggugacuugaguccagggguucaagacuagccugggcaacauagugagaucuugugucuacaaaaagaaaaaaguuagccgggcaugguggcaugugcccauagucccacucacucagaaggcugagcccgggagguugaggcugcagugagccaugauugugccacugcacuccagccugggcaacagagggagacucucaaaaaugguuuugagaauagagaauaguuuucaaagagaagacauagagagggaggggagcgugggcugaaaaaccaccuauuggguaguaugcucacuccuuugguaaggaucauuuguauuccagaccucagcauuauacaauacacccauguaagcugcacauguaccccuuaauccaaaauaaaaguugaggccagguaugguggcucacuccuguaauccccaacacuuuggguggcugagguggguuggucacuugaggccaggaguucaagaccagccuggccaacacggcgaagccccaucucuacuaaaaaauacuaaaauuagcugggcaugguggugcacaccuauaaucccagcuacucaggaggcugaggcacuugaauugcuugagccugggagacagagguugcaauaagccgagauggugccacugcacucuagccugggcaacagagcaagacucugucucaaaaaauaaaauaaaaaauaaaauaaauguuuuaaaaauagaaaauauaauacuacuaccuaaauguuuuauuugguaaaauggguuugcuagaaaauuauuuugcuuuauaucugcaaaaugcaaauaauauauauaauauauauuauuauuuugcuuuauaucugcuuuauaguuuuuuguaaguaaaaaaaguaacagcaauuuuuauuuuuaaagcaugugaaguuaguuuuugucuuugcaaacuaaucaacuuuuagcuacuaaaaaaauaaaacaagcuauauaaauaguauacuauguuauuuaacauaauuaaugaaauuugguaauuuuuuaguuacgaagaugaaaugagaguguaauauuuagucuugacauuuaugcuuaucacauuacauaaaaaguaauauuaauuauaacauacccuaaauuuguuaaauuuggaauaguuauaccuucuuugcagcaaauauuuuuauucuauugcaguaagcagguuauugcauuguuuauauaauuauuacccuguuuuacugguuuacaauuuguuaaagaaaagucacuaucaaagcuaagucuucauuuagauauauauuguuuuuaguugaaaccccccacagcgccccgacuuuuuuuuuuuuuuuuuuggcaacagggucucacuauauauugcccaggcuggacucaaacuccugagcucaagcaguccucccaucuccaccuuccuaguaucugagacuauagggaugagccaccaaacccagcuaaauuuuuuauaguuuauagagaugaagucuugccauguugcucaggcugcugucaaauuccuggccuugagugaucuugccuuuugcauuggccacccaaaguguugggauuacagaugugagccacugaaucuggacugguugcuaauuuuuuaaucuacgguaauaauaauaaguaccuuaaugaauuucugugguagaucaggcaucuuaauucugcuaacugcaucauauccagauacuguuacgucuguugcacauagaugaagauacagaagcuuuaagaaguuaaauagcuuaccugaaguuauuuaggaaauggccaaaguaggaauuugaguaugguuugcuuagauuccgaguauugcucuuucuguuaaacaccugcaauaaccauucucaaaacauuugacaucaguacuccuuuacauucuucaaaguuauugaggaucccaaaguuuuuguuucuggggguuguaucuuucaguauauacuauauuugaaauuaaaacugagaaauuuuuaaaaaacaugaauacauaagcauauauuguauuggcuguuaaagaauaaggcacguaacauuuuaguauuauucugagaauuauuuaaagcucauagacucccucaaaaggguugaggggaggggguacccagaccguauauugagaaccacuaaucuguaagaagacuagugaguuuggcauuggacaaauucaucucuccauucuuuuucaguuuaauguucuguuagucuucugauuacaaugaauacuacucuaaccuacucuaacauggugcuuacgguauauugcucauccauuuaauaguguagauuaguuaaauaguauauauaguguuauguuuacaguacaugcucuggaaguagaacugccugguuuagagcccacacuugucacuucuuaggaaaguuugggcaaguuauuuuaucuguauaucucaguuauaaaaugaggaugguauuaacaguacuuuccucauggaaauuaaauuguuacaugugaagcccuuagguauuuggcauguguuuaacagucaauaaguguuggcuauuauuuauuuggguuuuuuuaaaagcagugcuaaaugccacacaaauuucuuagaaauggcaguuuaaaugagcugugcaacuuuaaacuuugcaaaguauuuucauaauuguugacuuucuguuuuucuugaaggaaucucguaggcuguaucaguuucauuaugugaacuggccagaccaugauguuccuucaucauuugauucuauucuggacaugauaagcuuaaugaggaaauaucaagaacaugaagauguuccuauuuguauucauugcagguacaaaagaauuucccaaguuuauaaauacauuauuuaaguuugauguuacacaagguuuuauuucugcauuaauauguuaguaaucuugaauuucuccuagccuugauacaauguuugggacuagggccuuguaaguugauguggucucauuugguugacagaccguuuagaguauuguugcauuaaaacacaggaucaucuauuugaaaauaguauucacauggugggaagcuauagaacauacucuuuuuacuguucacugauuagagcauauaaucucagauccucaucauacucuacuuucuaaagucaguaugguaguauuuucuuuuaaucaauuucccugaaacaaugaccaagcaauuuucauuccugauaaacacugacaugagauuuuuaaaaacaggauauugcucugaugcccagguuggagugcaguggcacaaucauagcuuacuguaaacucaaacuccuggccugacgugauccuucugccucagcuucccaaguagcuaggacuacaggcaugugcuaccacacugaacuaauuuuuuuuaauuaaaaaaaauuuuuuuuaagagaccaagucuugcucuguugcccaggcugauccgaacuccuguccucaagugauucucccacuuugcucucccagagucuugggcuuacaggcgugagccacuacgccuggcaacaugacuuucuuuuuuuaauauauguaagauguacauacguaggucuuauugaucuaagauaucaucaauucuaagacacaccauuauuauauauauuaacaguaaaaaaaucacugccaauuauaaggggacaaugucauuuguaagaagccauuggugguaagauacauaccaaucucagagcuguuacauugagaugaaaaaguguguuuuaguuugaugaaaaacuaaaugcuguuuuuauucuuggggaacaucaguuuccacguuugcaccacuuccugucauaucaugaaauuuuauaauuuauagcuacugaaaaauuuaaagccggaagcaagcauucuuguaguaaaguaauaaaaacuauugauacacauuuacuagacauuuuuauuauguuuuauaguagauuacuucauuauaaggauuacauaaaauucaaugauuacugaccuaguuaagcuaccucugaaugugaaaggacaaguauaggugcaccuacuuuaaauugcacaauauaaaucuuuucauuuauucaaauaauauuugaaguucaguuagguuuugcaaaauuacucguuuggauguguuaagaaaucauguaaacucuuccuuugacuuugggggaaugaacaugagauuuguuuauucuuggggggcaguuaauuuuguauucuagaagggggguuaauguauaauauauuuuagcuaagagaaaucaguuuaagauaaccaacuuuucuuaaucuaacauuuuggcuuauuucugucaucuggucauucucauacaaauaauacaaagcuaaauauacauaauacauaugcacauauauguauauguauacauuauauguaauacauaaaacaaagcuaaauuuguauuauggauuuaggaguguaauggaaaauaccccuuuaagaggaaaagcacaaaacugaauuagucaagaaaauaauaaauguuugcaauaagugucaugaccggguauaguggcucagugcuuugggaggccgaggcaggaugauugcuugagcccagaacuuugaggcugcaguagacaccaauuacacuacugcacuccagccugggugacauaguagacccuaucuuuuaaaaaaaaaaaaagaauauagguaucauuauaauaugggugauacaggauauuuugaaaccuaauuuuuggaauuucauuauauagguauggguuucuacauaguagaagcuacuugaauccuuagacaguuuuucuacucugaauuuuuaguuuacauuagauucuucuaaaggccuuacagucauaguacuuacuucauaagacugcuaucaauuuauuccucuaagggacuuguuaucugcauucacauuuguuauaaaaaguaaaugagauuuuucaaacuuaagagauuuauuuuuuauuauuuacauaguuaaaauauuuuuucaguggaguugaagcauugaagauaguuuucuuauucacuugguuugaccguaaugcucauaauuaacgaaguaaaagggcuacuuuuuauucaugggccaggaaaguaacuugcugguggagaugugggaaucaguuaacaacuugguucauuaaaacuauuuuuuucugugguuaauucagugguuaguugaccauuuaauuaaguaggauugaccaguuaaaaauaaacaauauguuuaauuauagaauuaaaagauaaagaaauugcuuucacuuugacuucuuauaaguuaguuaaaauaauuuccuguucaaucauaaauccauuuguauaggaaggcuuuucaucaaaaacuaaauugaccguuaaauauuuuuagacaaucaaaacaguacguuaacuguaaggacuuagaaaacacauccauaaaagcaagaaaauucuuuugcuuuccacuaguuccacuggagauaaccauuguuaaaacucgagaauguguccuuucaguguguguauguguacauacaguauuguuuuguuuuauuuuguuugacggaguuuugcucuuguugcccaggcuggagugcaguggcacaaucucggcucacugcaaccuccgccucaacuauuuuaaacagcaguuuaaaugcuuaguggccacucuguuuuuuuguuuuuaauuuacuuuaauggccaucuuauuguuaaaucuuugagcacaucugcaguuauuaggacaaaguuauuauuggauaaauauccagaagugagauuuguuggucaaggacauaaacuuuuaaaguauuuuaaugaguauuuuuuaauguguuauccagaaaauugaugcuacuuaauucugccacuggcaguaugugagaguaccuauuucccuauaccuuccccaauacuguguguuaucuuuuuguuugcuuuuuuuuuuuuuuuuuuuuuuugagacagagucuugcacugucgcccgggcuggagugcaauggcacgaucucagcucacugcaaccucugccuccuggguucaugcgauucuccugccucagccucccgaguacugggauuacaggcacacaccacuacacccagcuaauuuuggguauuuuuuaguagagacgggguuucacuauguuggccagacuggucuugaacuccugaccucaugaucugcccgccuccaccucccaaagugcugggauuacaggugugagccacgguucccagccuuuguuugcauuuuuuucuuccuuuuuuuuuuuuuuuuuuuuuuuugagacggagucuugggcugucgccugggcuggagugcaauggugcgaucuuggcuugcugcaaccucugccuccuggguucaagugauucuccugccucagccucccgaguagcugggauuauaggcaugcaccaccacacccgguuaauuuuauauuuuuaguagaguuggggauucuccauguuugucaggcuggucuugaacuccugaccucaggugaucaccugccucggccucccaaagugcugggauuacaggcgugaaccacugcgcccagccucaucuuuuaauaguuauacaagugcuuuauauauugaggacauuaacuuuuauucauguuguaaguaccaugguuuuuccugucuucugccuguuugcaauacauaaguuucauuuugucaugucagauuuuugaaugguuuuuguccauugagauauuuguacauagaaagucuuucccuaacacaauaguguauauauuuugcauauauuuuuaguacuuucauagauuuacuuuuuaacauuuaucauuggauaaauauccaauauguuuauaucauauauauauauauauuuuuauccaccuggauuuuuuaugguuaagguaugugaucagaauuuaauuuuuugcucuucauugauagcuaacuucuccuuugccacuuacugaacggucugaucucuggagaauucacuguuauguaagaaauguuacauguacucagaucuguuccugaacuuucuauuguguuucauugaucugguuaucuguaucuuuauguuauacuuuuaacuaucaaauuuuagauauauauaauuuaucccaguaacucaacuaaaauucuauaaauguuuugaugcacagaauucacaaauguaucaacuaaaaauuaauauaauugauuauguuuauuaagaguuuuaaaaaaucuuucuagguuguuuauaguguacuuuuaucaggaauuuuagguuacauguuuaacaaacugcugauagguauacauuucaaaauaugcauuaaaauguuacacaacuuuguggggguuuuugccaaagauuauucuggugaugucaguaacaucuuauaauuacucauagugauuuucaauucuaagaugcauaagccuuucucuaguugagaagcaguuacuuuaaaauacuuuugucaugaguuuuuuuuuuuuuuuuuuuuuuuuuuuugagacggagucucgcucugucgcccaagcuggagugcaauggcgugaucucagcucacugcaaccuccgccucccagguucaagugauucuccugccucagccucccaaguagcugggauuacaggcgcccacuaccacgcccggcuaauuuuuuuuuuuuguauuugcaguagagacgggguuucaccacguuggccaggcuugucuccugaccucaggugauccgcccuccuuggccucccauuguguugggauuacaggcgugagccacugagcccagccugucauguuuuaaaauaaaaaaaccuaugguauguuacucuaaaguccccagcucccauuaguuuuuugggauaugagagcauaucauugucuuguucuuuuguggaaaucacugcuguugcucaauccguuuucuagggcuuauagcauucuucaccuuuccuauaccuucuauagauugaaaugauguaccauuuccuccuguacucuaaaacaagagccaucuuuuuuuuuuuuuuuuuuuuuuuuuugaguuggaguuuuacucuugcugcccaagcuggagugcaauggcacgaucuugggucacugcaaccuccacuuccccgguucaagugauucuccugccucagccuccugaauagcugggauugcgugugucugccagcacgcccagcuaauuauguguuuucaguagagaugggguuucaccguguuggccaggguggucucaaacuccugaccucaagugauccaccggccucaggcucccaaagugcugagauuacaggcaugagccccugcgcccagccacaagagccaucuugaacauagaauaaaugucucuguaagacguuguuagcuagucacauuuucugauguagcauuagacuuccagagugacaacuuaguagcuauucucugugucacuuacucuuggaaguuccuuaaauuaauuuuuguuuuucuuuuugagaugaagucacacucuguuacccaggcuggaaugcauuggugccaucauggcuuacugcagccucgaccucccaggcucaagcaauccuucugccuuggccucccaaagugcugggacaacaggcaugagccacugcgcccaaccccuuaaaaaugaaauguuuaaaagauagaagacaauaggccuuccuuauucaagacuucacuguccucaguuucaguuacucauaguucaaaaauaucaaauggaaaauuucagaaguaaacacuuuguaaguuuuaaaugcugcaccauucugagaagcauggggaaguauguccugcuugcaagauaaaucaucccaugguccaguguguacacacuguagacucuaccagcccauuagucacauaguagauacugcaguuaccagauggacugucauggugucccagugguuauguucacaugacccuuauuuuacuuauaauggcccaaaccucaacaguagugagguagugacuagugauagauuguuauaauuguucuaauguauuauuaguuauuguuguuaaucucuuguugugccugauuuauaaauuaaacuuuaucauagguauguacauauaggaaaaaucauaguguauauguauauguauucuguguaacagauguugccaugaacacacuguaaguuguauuuuguuuauuacuaaguagaauuuugucaaacuucuuaaaugauuuuuuguuucugaauauuaacaugucuauccacauuuauuuuauaguuguuuuaucacaaaaaucaauuguuuuucaaacuuuauauccuuagugcaggcuguggaagaacaggugccauuugugccauagauuauacguggaauuuacuaaaagcugggguaagaauaauuuuuuguagcauuauguucaauugaucuauuaugauuuucaaacuuaauuauaauugcaguaaauuauaguguauauuuuauuauacauguuauuuuuuccaaaguaguuuuauuaaguaagaaauaaagguagugaaggccgggcacaguggcuuacgccuguaauccuagcacuuugggaggccaaggugggaggaucgcuugagcccuggggcucgagaccagccuggggaacauagggagacccccgucucuaaaaauaauuaaaaaauaaaaugauuauaaaaaauaaagguggagaaaagguauaauugcugcauauugccuuugauaggaugcauuggggaacaaugugacaguguucuaggugagugaauacuugcauuaggauauaaacuguuacugacuuuuccaauacuaaauuuucauugccuuuuuuuuuuuuucuuuuuuuuccgagauagaguuucacucuuguugcccaggcuggagugcgauggugcgaucucagcucacugcaaccuccaccuccuggguugaagccauucuccugcuucagccucccuagcagcugggauuacaggugccugccaucacgcccagcuaauguuuuauauuuuugguacagacaggguuucaccauguuggccaggcuggucucgaacuucugaccucaggugauccacucaucucggccuuccaaagugccgggauuguaggcgugagcuacggugccuggcccauugccuuuuauguuuacucuagguauaaguguauuucacucaguauguauuuaugccugcuggagacauuauaguauuguagucuaugaaugcugacucgagccaaauugcccagauuauaauucuggcuuucucauuuacuagcugugggaucuuggucaaaauacuaaucccauagugccucuauuucuuuaucagaaaauaggggucauaguaguaguaaugcauaagaauuaaauaacuuuugugaaguucuucagaacuaugugguaaauuguaaguacucaguuuauuguuaguguugauuacuguugcuguugugauuguuguuccuacuacugcuuuuuccaagaaauaguguuugauacuguggaugauacagagauaaauaagauacagccuucauuauagauuugaaaaacaagucucuucauuauguauacauuugauucuuuugcugguuccauaauguguucauuucuagagaggcgccuuuaauccuucauagcuuuauaguuuccaugaauuguucaucuuugucuuguacagaguagaauuaauaaaauguuuauuuuuucuuuuucuuccuucuuccccuuauuucucuuuuuucccugccaucucuccauuuuuuauuguugcaaggaaauauuuacauguuaaacaguuccuuaaaaagcccucugggguuaaauauuuuuuuccucaaaaacuauaaucaucuaauucucaaaugaaaaugcuuaagugaacaaaauuuaacuggaauucgaucacauuuuaacauaaaagucaaagauuaaaauuggaaugagaagggacacauaaaugaaugcuagcaaacaaaacaaacauuuggucauuuuaaaaguuguguauuuuggauaggugccauggcuuaugccauaauuccagcacuuuugaaggcugaggugggcggaucaccugaggucaggaguuugagaccaaccuggccaacauggugaaaccccauuucuacuaaaaauacaaaaauuagccaggcgugguggccggcgccuguaaucccaguuacuugucaggcugaggcaggagaauugcuugaaccuggaaggcagagguugcagugagccgagauugugccauugcacugcaaacugggugacagagcaagacuccgucucaaaaaauaaaauaaaauaaaaguuguguauuuugaacauaguucucucucucucuuuuuuuuuuuuuuuugagauggagucucacucuguugccuaggcuggagggcagugguguaaucucggcucacugcaaccucugacucucagguucaagcgauucuccugccuuagucucccgaguagcugggauuacaugcacgcggcaccaugccuggcuaauuuuuguauuuuuaguagagaugggguuucaccguguuucgggcuggucucaaacuccugaccucaggugauccgccugccuuggccucucaaagugcugggauuacagacaugagccacugcacccggccuaguuguuaagucuucauguaaaaaucuuggcugggcgcgguggcucacgccuguaaucccagcacuucgggaagccgaggcgggcggaucacgaggucagcagauugagaccacccuggcuaacacggugaaacccugucucuacuaaaaauauaaaaaaaaucgccaggcguaguggcgggggccuguagucccagcuacuccggaggcugaggcaggagaauggcgugaacccgggaggcggagcuugcagugagcggauaucacgccaccguacuccagccugggcgacagagcgagacuccgucucaaaaaaaaaacaacaaaaaaaaaacccaaaaaucuuaugauguauauaaggacuuccaagcagcaaaccuggaaaucauuuuuaacccuuccaucuuaaucacuccaaaauauucuuguugauaacaguuaugauauuucugcuucuguaaaccuccgccaguuucucacucuuucagacuguccucuuccuugauacaaaaauugugugaauaucagaucuucucaugucaacauugccuauugcaguagucgcaauuccauauacacaaaagaauugucuaggucguuucauaauuaguuccccaacuuggagccaaaggaucuauauuuuuaccuaggucuuuuagcugguccuuauauagccaauccaggagauacuggccaauagaauaaauucagucucuuuauuauguucacagucugauccuaaauauccuuaucuucucuccuccuuugaguaccuucuccuucuuuuagucuuaggcuuuguuuacaucaaacuucucaauuccccacauagauuauacauugaaucugcugugcuuauguauauuuccuucacuuuuuaugggauaaccuucuuuugauauccaacuauguuguagcugcacacacucaacaguuagccauagccucuuuauucccuguauacugcagucauacuuuggcuggacauaacugucuccccaucuugaaugcugagggucaagaacaguuuuguuuccacagugccaagcacagugucugagaugcauuaagugguguucaauaaauguuugcaguaaaccagcagguauuuaaguuuuaugugaaaagcugaagaagauuuuacuauuuucugaauagauacacaaaguugauguauuaaauuuucuguuuuagaaaauaccagaggaauuuaauguauuuaauuuaauacaagaaaugagaacacaaaggcauucugcaguacaaacaaagguauaguuguuuguuucccuuuauaaacugcuauuuuauaaaugcuuucuucuuuuuuaaaauguuguuuucauuuuguuuuuuaaucauuuuucuccuucauaggagcaauaugaacuuguucauagagcuauugcccaacuguuugaaaaacagcuacaacuauaugaaauucauggagcucagaaaauugcugauggagugguagguguucuuggucuauuaauuuuaggaaacuuuuacucuuuguuaagauguaauauuuagccuuuuuuuuguugucuuguguuuugucuaacaugagaagaauauccaggacacuuaacauuuuuacuuaaacucauuuccuucuuauucguaucuguauuaugauggcuauuuaaugacuccgauauaagguaaauuauguucuaaaugaaauaaaguuaggaaagaucucaugucaaaaaucauauaauucguuaauguuuuacuuuuuuaaaaaauaauugcauuguucucuuuacucuucccuuccacccccacccaaguaauucugcauugauucuacuugaauuucauuuuguauaaaguguuuuaguuauuuguguauaugcuuuucuuuucuuuucuuuuuuuugagacagaguuucacucuuguugcccaggcuggagugcaauggcacagucucagcucacugcaaccucuaccucccaaguucaagugauuuuccugccucagccuccugaguagcugggauuacaggcgcacgccacugugcccagcuaguuuuuguauuuuuaguagagacggaguuucgccauguugaccaggcuggucucgaacuccugaccucagguggucugcccgccuuggccucccagugugcaaugugcugggauuacaggcaugagccaacacuccuggccuuguguauaugcuuuucaguuaagcagaauuaaagagccacaguuaacucccuuuuguuguguuauaauucaguguuauuuuagccuuguaacaucuuacuggauauucaacuucuagaccugacaaaaacacuguauucucuuaguauucucauuucugccuuuguuuucuaaccaauugucuugcuucaauucuauauauaaccaccuugucccugaaggugcugagauuuuuuuuuuuuuuuuguagaauuuguuuacaucuuugucauugagucuaugauaacuauuacauuguuaaaccaaguaugagaaaauaaguugcaaaauuuauaaccuucauuuuccuuuucucccuuuaaaugguuuugucaguucccagaauauuuguuugaauuuucuugguuuuccaaaugacagauuuauuaccaaaugcugaucucaguuuguuaggauaaucuaauaucgguccaugaguuuuaggaaauaugcauuucuuuuauuagccaagugacaauuucacguuuuuaaguuuuaugugacaucguucuuauuccuuuauuaacauaggaauuauugugcaaggaaauccuccuacaaugccuuuagcuuaauuaaauccuauuaugacaugcucugaaucuagccaaauauuuuauaauguagaaucaaauguguuuuuguuuuguuuuauuuuguuuuuugaaauggaguuucacuauuguugcccaggcuggagugcaauggugcaaucuuggcucaccguaaccuccgccucccagguucaagcgauucuccugccucagccucccuaguagcugggaucacaagcaugugccaccacaccuggcuaauuuuguauuuuuaauagagacggaguuuguccauguuggucaggcuggucucgaacucccaaccucaggugauccgccugccucagccucccaagugcuaggauuacaggcaugagccaccgcgcccggccucgaauguguuuuuuguuuguuuuguuugauugguuuuuuuuguuuuuugguuuuugguuuuuuuuuugaugacgaagucucacucugucacuuaggcuggagugcaguggcgcaaccucugccucccggguucaagcgauucuccugccucagccuccugaauagcugggauuacaggcauguaucaccacauccagcuaauuuuuguauuuuuaguagagaugggguuuugcauguuggccaggcuagucucaaacuccugaccucaggcgaucccccugccucagccucccaaagugcuaggauuauaggugugagccacugcacccggccaaacauuuguauuauuuuguauaauuuaaucuaaguugagauauuuaauauuucgaaaagcugaguaggcuauaaacaguuuucuuuaauuuuuggguuuuuuuuuuuuuuuuuuuuuuuuugagauggagucucgcucuguugcccagaauggagugcaguagcacagucucggcucacugcaaccucugccucccggguucaugugauuuuccugccucagccucccaaguagcugagauuacaggcgcccaccaccaugcucagcuaauuuuuguauuuuuaguagagacaggguuucaccauguuggccaggcuggucuuaaacuccugaccucaagugauccacccaccucagccucccaaagugccaggauuacaggcauaagcuacugcacccagcaucuuuaaacuuuaauugaaaagcauuucuguuuuauuccaugaauucaagauuaauuucaaagcuaaaguuuuuauaucuggaaauacagguuuuuaggcuggaugcaguggcucaugccuggaaucccagcacuuugggaggccgaagcaggcaggaucaccugaggccaagaguugaagaccagccugggcaacauggcaaaaccccgucucuaccaaaaauacaaaaaagauuagccucccagacucacggguacaucaccuugccgaguuuauuuuuuuuauagagaugagguuuuacuguguugcccagccuggucucaaauccuuggacucaagcaauccauccgccucagccucccaaagugcaggaauuauaggcuaaaguucuuuuauugcaauauucaguguuuggguuuuguuuuguuuuguuugagacgaggucuugcuauuucacccaggccagagugcaguggaacaaucagggcucacugcgcccucaaccucccggacucaagcuuuccuccugccucagccucccaaguagcugagacuauaggcacauauaccacaccuagcuaauuaaaaaaaaauuuuuuuuuguagagauguugccagguuggucuugagcuccugggcuccaacaguccucccccaccucagccucccaaagcacugagauuacaggcaugagccauugugcccagcuauuguuguauuuuuuaaaacuuuuaacuauauuuaaauaaucuccagaaaauaugugauaaauaccgcaucaccuuuucaucuuuuucuaauuagaucaaagucugaucuuuguaagguuuuauuccauugaaucaauccuuuuuuaauauccugaaaucuauacuaggauuauaauucuaucauaggcucuuucugucuaauaggucagagcuuuacgggaauauaauaaaaaagucauacuuuguaggagaugagaugaaauaauacccauagcagauaaguaguuaacuucaaaccuacuuucguaccucauugcaugguacauaguagacauaaacuaaauguuugagagaaaucucuccauagaugaauggauaaauaguaaaaaaaaacagaagaaaagauggauuaucauuccagauaacuuuuuaguauuuucuucuuaagaaaucauguuuucuguaaacuuguaaauauaggugacucuuuuuauaggauggcugucugugguugcagaccauaaaucuuaaagaaaauguggaaucugaaaaauugagaaaaaucaucuuagaacugugugguugaaugaaaugacuugaaagguguauuaacuauuuagaagcuaugcugugagaaguaaaaauaaguccccacuuacuacuuuucugacaauuuaaucgguaaaaguuuuguuuaaauguucuguguuccaguauuauuucuguagaaauuuuaguuugauauacuaguugguuguuuaagacuuuaaaaugaauaguguuuuuuagagauauuuauaacuacagugacuuccuggagugagagaucuaaagagaaaauuuauucuguaagccuguaucauauugacugaggauuuagagguaccuuaauaagcaaacaucuguuaaguugugcagugugccuuuuuaucuuguguguaaaggacaccguuacaaguacugucaacaccaguauuucaguucuagaaugauuaaguaauagcaauaacaguuuguauuaucguccuuuuauuguguuuguauaguacauuuuagaugugauaaugaauucuggauuuuuuuuccuaaaauauaauuuuuuuauuuuuaaagcacccugauuuauaauuuauuuucuucugcagcugauaauauucuuaaauauuagauaauuuguuucuuaauguuuuuguagcauuucauaaagcuguuauauggaaaauaacaguacgcaagauaacuuuagaaaguucuguuuaaaacaagagaacacaggcuaggcgccguggcucauuucaugccuauaaucccagcucuuugggaugccagggcaggagaauugcuugagaccaggaguuugagaccugccagggcgacaaagcgagaccccaucuauacaaaacaauuuuuuuuuaauuaccuggguaugguagcacgugccuguaguccuagcuacuugggaggcugagauggaaggauuguuugagcccaggaguucaaggcugcagagguaugaucaugccacugcauuagauuauuuaauuccuaaaauucuuuuccauuucaaaaguuggugauugcuucagcaaguuguauacaugacaaauguggacucaaaaauuauagguaauaaaagagagucagaagauguggguguguaggagacauuaacuaggaaauccaagaacauugugaaguccagugaccaggagguuuuguacaugcuguuuagguaguggcucuuuaucgaauugcaguucugcauugucacauugauuccuuucaucagaggaaacucaguauguucugaaagcuaaucucucccagaagcucucuuuugguucuuccuguuaauggcuucauccugcucuuacucacccagaaugaggaauccuucaugaaaccuuuacuuucucacauguaguguuugccuaaaauguccuuacuaucucuucucuuuacccuuccaccuguuuuccuucuuccaauccucauucauuuuuugucaaaaucuuaccaaucccucaaugccauucugcauuuuaccuuaauauugucaacuuacuuuuucucaauuauauucuuaauauucucaacuauagcuuuuuuuucugauuucauagcuucauaguacugauuaugccacuuuggggcuguaguauuacccuucuacuuuuuuucuggggauuuuaccagacuacauuuugaaguuaaagauaauaccauguccuucuuacauuuuaguauccucugcuuugcugacuuuauucagugcauuucacuagauguccacauugccuuaccugcaguuccaaaauccaaagaaaacauaguuuuguuuuguuuuugugaauucaauauuacacucacuuggcaacaaaauauuucauugacaugacaugaguuuaugugugcuacaaaagaaaaaugcuguuuuguauguuagaaacaguucaaaaggaguuucauaugguuugccuuuaauuuuuauuuaaccuacuuaaugcacauuuugguacaaaauaucaaguguuacagaauuaugguuauaucauuaauggaaauaauaagcagaugaucaauaauauguuggggguacuuuuuuguuuuuuuuugagacggagucuugcucugucgcccacacuggagugcagagacacgaucucagcuuacugcaaccucugccucucagguucaagugauucuccugccucagccucccaaguaacuggaauuacagacgugcaccaccacgccuggcuaauuuuuguauuguaguagagacaggguuucacuauguuggccaaggcuggucucgaacucuagaccucaagugauccaccagucucagccucccaaaguucugggauuacaggugugagccacugcgcccagccuaggggguaccuuuuugaugcagagucucuaaauucuggugguaccugaggaucugaaacuuuggcgaccaaaaguccugauuugcgugaggcacaccaguucacacuaguugucuagguuuaauaauuaauaaugcuucuuuuucauucucaaaagagcccugauuuagacaauaaauuauauggucacccuaccuauagccagauauuucugcaccaaaugccucgauuuugguggguggcuuuaauuaaggaagaaugcuuuaaguuuuaugacauaacucuguuguucuugucaggaagugauauguauaaaacuauuaauucaucagauuauauauaaggagauagggugcacuuaaaauugcuaggaaguugagaucucuaguuguuuaguuggaaguaauugaaguaacaguuggacaagcugucaugauggacauaguagaagugccuuuuaauuaaaaacaaugauaacaaaacaaaaugcagcuacgguuucagaguuccuuaguugauaguauguguaacgauggcuguugucuaaaauuaucugagauguuggcaagggugaaaaucauuccucucuucuggacauaacauacccuagaauuaaaauacccuagcuagauaaauaugagauauguugacagugaaacuaauucaaggccguauuuucauuucaccgcuccccuauucacaguccuaaaccuaagguucuuauaccuguauugacucugaaacaucaauguuaaugauguuauugguccuugugaccagcaagaaccaaggauauucuggggaugggcucugucugccuuuuugagguccauuuggguagccagugauauaggagcuauauucccuaauggauuagagcacuccacauagugacagagugagagugaggcaagaaaugguuaaaaugaauccuaggaccaccaguuuaaaaguacuagguaguaauggggagucauaaaaagauacuccauuacuugguaaaugguauaagccuuauuuguuggcuuuuuuuuugucucugcauauauuaaguuccuagugguagugauggcggggcggggggauacuacguucuuuaauccacauuaucuuggggaaucuguuuuuuuacgguagcauuugagauguguugaaaugcugcuguacaccuugaucuuuccaguaacugugaugcgcuguuuuuuugauacaaucucuccauugaagucugguccuucaggcuaaaauauagagccagaauauaagacuuuuuuuuuuuaacuuggcaaaauuggcauuguuuaaggauugaaaagcacagaaacaauuuaguugaaacaugaagaggaaaaauuauuuuucucuuaaccuuagugaaguauuuuuucccuuggcagaaugaaauuaacacugaaaacauggucagcuccauagagccugaaaaacaagauucuccuccuccaaaaccaccaaggacccgcagguauuguaugucuucgaacauuuucuuuaaaagcauacuuguuucuacucacuguuaauuaaaaugacaaauucugaauauuucuaaauuacuuuuauaacuuuuauuauuauuuuguuaggauguaacauacguaugacaacugauuuguuacugguuuauuaaaaauuugguuucauuuuggauaaaauuucaauaauauacuguagcagaauguggauacuaccaugaauugacuaugguuuauguuuugauaugugauauaacuaaaauuuuaguuauucuaaagauucccauuuuuuuccugaugacuaaauaugcuugccaaaaauugcaugcauguugaagugugaggauauuuaauaacguuacuagcaaagaugaguuuauuucuuuaauuuuucuugcuuuucuaccaagcucauuuauaauaguuaaaaucauauauauucauaucuuucuuuuccuucccuucuuguucaggguagcugcuuagucaguaacaugguaguauggagagaauacagaggcagaagaagauaguuucaacuccuuuuuagccauuuagcucugggaucuaggauuaauuuacuuaauccuggggagaaggaguuguuuaaauauuguccuaaggauuaaauaaaaaacuauuagaauauuuuauagugucuuucuugcacauagaucugccaaaacugaucgacuucccaucaaaauaaauucuuuuauacaggauacaccaauuguuuccaucuuaaaacuuuggggaaaguugggucagacggccagggucaugucuuagcauugaguugcuaauuccaagagaucauucuaacgaaaucaucucucugaacaaaagaaaaagccugcagcuucccucaguaacugaagguuugguuagaaucccugcacaccacaggaauaauuuauucucauuuugaccaugcaagauucuaacugccugggaaggaagcugcugaguacagaaagaggcaguguacucugguauaaagaggcuuuuuacauaaauaggucccauuccaaauuuuaacuuuagcauuugccacugaaugaacuuugacaagccacuucucugaaaauacuuuacuucauuguagugagaguacucguauucuccguuuuuaaaaauuagugauaauguauauaaagcauguaguuacaugcccggccuauaguaacagauuuuuuaaguguggugguaguuauagucucuagaauaccuuugcauacuucucuuaggaaccucaggaagccuauauauagaugagguuaggucucaacauuuaaauguucgagauguuaacugugugcuaucagaacuuuuaguaguucuuuccuguucgauuuccacuuugguauccaccaaaacugguuggcauuuuagccgucuguggaagguaaccaguugaaaccuauaaaauauuaaguucucuaacuucucuguuccauauaggagcccuagaauccuaaaagaaacuacuggcccuaaaaaaauuaaggaacauuuuugcugcccuguguuuuaauuugguuuuugagauugagccaauauagagguuuucaaagucuacacugauauuuaugauuuguauguucuucuaccucuaacuacauguagcagcagucucuucuuaauuuuacaggaaaaaagaauagaauaucugaauuuaaagccuuuuuccuauaccuguugaaaaguuuuacuucuguuacucucuaauaaacaaaaagauaauaaagaaaaaagcaaaugcauauuaagaaaaaauauucaacucaagacagauuuuuauuaggcauacauucuaaaaguucuuugugugugauuuuauaauacaugcauaggucaccuuuuuucuucuucauguaauggagucaaaugccagaaugucauuauuuuugacaaagagaaccuugugacuucuaaguugggaugauuuuuagaacuauuauaaauuguuccaacauaacugaaaauaaaaucacaaaaucauaagauugauaacaaguaaaauaguauauuuuguuuuucaguauggcuacaguaaacacauuaauuguuuguuuaaaguacaugauggggccaggcgugguggcucacgccuguaaucccagcacuuugguaggccaaggcaggcggaucacaaggucaggaguuuaagaccagccugaucaauauggugaaaccccgucucuacuaaaaauagaaaaauuagccaggcgugguggcacgcgccugcaguuccagcuacuugggagacugaggcaggagaaucgcuugaacccaggaagcgaaggugccagugagccaaguucaugccacugcacuccagccugggugaaaaagcgagacuuugucucaaaaauaaaaaaacaaaaauaaaguacauguuggcugggcauaguggcucacgccuguagucccaacauuuugggaggcuaaggugggcggauugcuugaauccauauauauauauauauauaaaaauauguguuguguguauauuucauuuuuauuuauuuauuuauuuauuuacuuuuuaaacguuuuuguuaaaaauaagacacacacacacaguagccuaagcauacacagggucaggaucaucaauaucacugccuucugccuccauaucuuguccugcuggaagguaucgggcagaaacacacauggagcugucauccccuaugauaacagugcccucuucuagaauaccuccugaagaaccugccugaagcuguuuaacaguuaacuaauuuuuuaacaauuagaaggaauacacucaaaauuaacaacaaaaaguaaguacguggccaggcgccuguaaucccagcauuuugggaggccaagguggguggaucaccugagguugggaguucgagaccagccuggccaccauagcgaaacccugugucuccuaaaaauacaaaaauuagcugggcguuguggcgggcaccuguagucucagcuacuugggaggcuaaggcaaaagaauugcuugaacccgggaaguggagguugcagugagccaagauugcaccacuggacuccagccugggugugacagagcgagacuccaucucaaaaaaaaaaguacauaagccaauaacuauuuucuuuaucauuauuaucaaggauuguguccuguacguaauuacaugugcugugcuuuuauaugacugacagcauaguagcuuuguuuauaccagcaucacaacaaacgugaaugacgcauuuugcuacaaauucaugggaauuuuucagcuccauuauaacuuuguggggccaccauguuauguguggcccaucauugacugaaacgucacaugacuguacaugucuuucaguaauuuuuaauauuccaauucuuucuguuuuauuuuguuuuguuuucagacagagccuugcucuuuugcgcaggcuggagugcaguggugugauuauggcucacugcagccucgaccucaauugaaccucccacccuagacucccaacuagcuggaacuauagacacacaccaccaugccuggcuaauuuccguauuuuuuguagagauggguuuucuccuuguugccuaggccaguuuuaaacucuugggcucaagggauccacccauuuuggccucccaaagugcugggauugcaggcgugagccaccaugucccaccaguauuccaguucuuccaguucuuaaaagugaacagaacuaggaaugacugggcauuugacagaagccucuaauaugaaaaaacagaggaaauggagacaauacagaguaaaaugaaaaagaugggggaaaaaagaaacaacaguccacuuuucucagucauugggaaaugcugcaaccacgaaauaagaacuguggguaauaaguaagaagcucuuagaaauuaagaauauaggccaggcgcaguggcucaugccuguaaucccagcacuuugggaggcugaggcgggcagaucacaaggucaggaguuugagaccagccuggacaauauggugaaacccagucucuacuaaaaauacaaaaaaaauuagcugggcgugguggugugugccuguagucccagcuacucaggaggcugaggcaggagaaucgcuugaacccgggaggcggaaguuacagugagucgagaucgcgccacugcucuccagccugggcaacagaaugagacucuugucucaaaaaaaaagaaagaaagaaauuaaaauacuauaaauuuaaaaauuaagcagaaguuuggaaaauaaggaacuccauuuuccaauaaaauuuccaaaauaaagaaauucauucauuucaagaaaaugaauggauaaagaaaaaguaggagagaaaagauaaggaaauuagaaagcaaaacuagaagaucugucacugaacuaauaauagucuaaaaggagaguagggaagaagaaauuagcaaaaaaaaaaaagaagaaaaaauguguuagaauuaaagggcauaaauuuuuauauagagcguauacaccaagcuugauauacaccaccaaaugugauggauaaaaauaaaauuguuaaaaaauauaguuuuuuaaguuacauuaugaaauuauagaacauccaacauaagaaccuugcuuagguuuagaguaagauaaaaauaaugcugaaauuuggaguaaguuuuuuuaaauuaaaaacuuugaaaauacucgauuaacaaacccauauaucauacucgauaucugucaagcacuguucuaauuguuguucagauguuaacucauuuaauucuccuaacuacccugugaaaaagguacuguuaaggauauaugggguuuguuaaucaaguaaaucuguaaaauacuggucaugaggccgggcaugguguuucacaccuguaaucccagcauuuugggagccugaggagggcggaucacuugacguuagaaguuuaagaccagccuggccaacauggcgaaacccugucucuacuaaaaauacaaacauuagccgggcgucauggcgcgugccuauaaucccagcuacuugugaggcugaggcaggagauucgcuugaaccugggaggcggcggagguugcaguaagcugagauugcaccacuguacuccagccugaguaacagaaugagacucugucucaauaaaaaauauguaaauaaaauacugauuauggaaaaguggucucaccauguacacguagggaaaauaauacaccucaauuuauaucaaaauuuuaucucauccuuuuaaaacucauauuuucuauuuguauuauaauauguucuuaggauaaccuauuggucuuugcauaugcuuuauaaauuguaggaggugucugcaauuauuuuuguuuuagaucgcaaaaauuugacagccacucuuucagauuaagaaccaacuuguaggccagguacaaugccucacaccuguaaucccagcucuuugggaggacauggcaggugaauugcuuaaguuuaggaguuugagaucagucugggcaacaugaacauggcaaaaccacaucucuacaaaaaauacaaaacuuagccaggugugguagugcacaccuguagucccagcugcuugggaggcuaaacugggaggauggcuugagcccugaaggcagagguugcagugagccaagauagugcaacuguacuccagcccagguggcagagcaggacccugucucaaaaaaaaaaaaaagaaucuacuuguaaaacuugaacagauauaggaauaucuuaugagaguauugcugucauuuuaauaugaucaguauucuggagauauucauuuaucuucucauguccuaggaaugugggaaugugucuagagaaucugaacuucacagagucuuuauuuauuuauuuuauuuauuuugagacagagucuugcucugucaccuaggcuggagugcaguggcgugaucucagcucacugcaaccucugccucccgaauucaagugauucuccugacucagcuuccugaguagcugggauuacaggcgcacgcuaccaugccugacuaggguuuuguguuuuuaguagagacgggguuuugccauguugguuaggcuggucucaaacuccugaucuugugauccgccugccuuggccucccaaagugcuaggauuacaggcgugagccaccaugccuggcccacagagucucuuuuaaggggaaaccugguguaccaugugauuacugccaguuaucugguuggauaaaaaaagguugaucaccuggggggagaaaaaaaagcaaaaacucugaggugggguccaguggcucaccccuguaaucccagcacuuugcgggggccgaggcaggcaaaucacuugaggccaggaguuggagaccagccuggccaacauggcaaaaccccaucucuacuaaaaauacaaaaauuagccaggugugguggcaugugccuguagucccagcuacucaggagguugaagcacaagaauugcuggaacccaggagguagagguuccaaugagccaagauggugccacugcacuccagccugggugacagaacaagacucuaucucaaaagaaaaacagaacacaaaaacuuaaauauacaagcccucaagaaguuugcuucauauaaaguucuuaaaaagcaacaaagccugggcaacauaguaaacccuaucuucuucuuugguuuuuuuuuuuuuuugagacaggaucucauucuuucacccaggcuggagugcaguggcaugaucagagcucccugcagccuugaccuccccaggcucaggugauccuccuaccucagccuuccuaguagcugggacuacaagcaugcauugccacauccaguuaauuuuuuuguauuuguuaaagacacaggguuuugccauauugcccaggcugcucgcucucucucucucucucucucucucucucucucucucucucucucucucucacucucacucucacucgcgcucucucucucgcucucucucucuuuuuuuuuuuuuuuuuuuuuuuggagacagucuugcucugucgcccagacuggagugcaguggcgugaucucaacucacugccaucuccaccuccugggcucaagcaauucuccugccucagccucccaaguaucugggacugcaggugugugccaccacaccuggcaaauuuuuguauuauuaguagagaugggguuuuacuguguugcucaggcuggucucaaacuccugagcucaauugauccacccaccuuggccucccaaagugcugggauuacaggcgugagccaccaugccuggccccuauuucuuuaaggaaaaaaauaaaggcaacuagaggguauaacccacccgaacaaaggaguauacccagaaagaggaaaaugagaccugggaaacaggagaaucugaaaccagagagaacauuagcucugugauggacuagggaaccaguaguccacacuggagcaggaggccaaaaguuacuaacaaggaugucugugguauugauacuuacuaugugugcuugucauuauugagaggagguauaccaaucugcaagaaaguuagaagaaaagcugaguaacugaugaugcauagagagcuaagccaucagaaauccaaggcagucauuaggggaaaacaagacacuauagaagaaaagauacgaaaucauggugucauagaugggaauacuaucugcagucauacgacugagguaaugaaaaauuacaauauaacaguauuggaaagauagagaaggacacuuccacaguaggaagucaguagaaaaugugugaaacaaagaucaagaaauaacuuuugaaauagucugaaauacagagguguaaauuuuagaagcagcuauaaaaaaauguugaaaguugaugccucuggcuaacaggagggcugcggggcagagacuauguuuuucauucaaagucuuguauuugacuuuuuaaacaguauauguguauuaccuugaugaacauuaaauuuucuuagucugaaaaacugcaguuuuuauucgcaaccagauuguaauggcucuuaauaugcuacucuuagcuacauaauucucagguaucaacuuguuuaacagucuuaaaaugcccuuuuuaaauguuuguuuuucaguugccuuguugaaggggaugcuaaagaagaaauacugcagccaccggaaccucauccagugccacccaucuugacaccuucucccccuucagcuuuuccaacagucacuacuguguggcaggacaaugauagauaccauccaaagccaguguugcauaugguuucaucagaacaacauucagcagaccucaacagaaacuauaguaaaucaacagaacuuccagggaaaaaugaaucaacaauugaacagauagauaaaaaauuggaacgaaauuuaaguuuugagauuaagaaggucccucuccaagagggaccaaaaaguuuugaugggaacacacuuuugaauaggggacaugcaauuaaaauuaaaucugcuucaccuuguauagcugauaaaaucucuaagccacaggaauuaaguucagaucuaaaugucggugauacuucccagaauucuuguguggacugcaguguaacacaaucaaacaaaguuucaguuacuccaccagaagaaucccagaauucagacacaccuccaaggccagaccgcuugccucuugaugagaaaggacauguaacguggucauuucauggaccugaaaaugccauacccauaccugauuuaucugaaggcaauuccucagauaucaacuaucaaacuaggaaaacugugaguuuaacaccaaguccuacaacacaaguugaaacaccugaucuuguggaucaugauaacacuucaccacucuucagaacaccccucaguuuuacuaauccacuucacucugaugacucagacucagaugaaagaaacucugauggugcugugacccagaauaaaacuaauauuucaacagcaagugccacaguuucugcugccacuaguacugaaagcauuucuacuaggaaaguauugccaauguccauugcuagacauaauauagcaggaacaacacauucaggugcugaaaaagguaauaauauagugucaaauacuuaaaugucuuuccuaugugcuagucacuguuuuaagcacuuuagcuguauugauuuauuauguuuuauuccacacucuaccauagaaccuacagcaaaaucugucuuagauacuaauuuuuuaauauaagcuuuuaauguauuguuaacaauuuggucacauuauauuacuggguuuuguguuucuaaauuauuuuaguaguuauaacuggauaacuuauuuucuuuuucuucuguauuauagaucuuaguguuuuuguaucggucaaaaauuuaucugacugaauaauuagaaauaauuuagggaagaaucacuuaaaauaacaguggcaaaaauacuguagaaugucuugauuggccauauaauguuacucguuuuuccuaaauguuuagucauuuuuuacuguuccuuuaacuacagauuacauuuuuuuguuuguuuguuuuuacugucuucacaaaugcuuccaaauauggcugcuuccaacccugaguuuaacccaggaacaauacugcaaacugcucaauucaguagugagugggcuauaugcauaccuacucaucaaagcuauuauuuaaagaauuauuauuuuuuuagcacucuuagcauuucaagauaaugcaugcacucaguucccaaaguguauuauugcuucuugaaacuccucuuugaucugcugaaaguaaugauggcuaccaucuuaaacagacccuaagguugagaguaaacauauaaauuugaaagcuguuuauugauauauugauuaucaguggucacuuaccuaucagugaacuuugguagugacacauacagacugguauuuauaacgugcaggcaaaauaaguacugugaccuugaaagauuuuuuuuuuuuuuugagacuugcacucaaaagauuuuuuuuuugagucuugcacugucacccaggcuagagugcaguggcaagaucucggcucagccucccaaguagcugggauuacaggcacccacuaccacacccagcuaauuuuuauguuuuuaguagagacaggguuucgauauguuugccaggcuggucucaaauuccuggccucaagugaucugcccaccuaggccucccaaagugcugggauuacagacgugagcuaccacaccuggccuugaaagauuauuuucuauuucugacccauuauauaccacccauacuguagugcuuguauuuucucucacacauacuguauuuuuuaacuugagagaguguauuugguagacuagaugacagucuuuuugagacagaguuuugcucuuguugcccaggcugaagugcaguggcgcaaucuuggcucacugcaaccuccgccuccuggguucaaggaauucuccugccucauccucccuaguaguugggaauacaggcaugcgccaccaugccuggcuaauuuuuuguauuuuuaguagagacaggguuucacuguguuagccaggauggucuggaucuccugaccucgugauccgcccaccucggccucccaaagggcugggauuacaggcgugagccaccacgcccagccaggugacagucuuaaacuauuugcuuaaauuacagaauuaucuuuucuugauuuaucuuuguuuuauuugaaggaucuuuagaagauaaugaauaguauaauauuacuuuaccaguuuaccauaauuuuaaauugcuaaugucuuuuguuccucagcuucagaauuugaaauauaacugcccagcuguaacuauauaagaaaauauguagauaagaaauuuucauuuugaguuuuuaguauaucaagcaugugguauuguaccuaggaaguuuuauuguuuuuuuguuguuguuuuguucuuuugcuuuuuuuuuuaaaaaaaaccaaaaaaccauuacuggaaauaggauuuggugagggccagaaagauguaugaugugauaugcuuauuaaaaguuacuacuacaugacgagucuguugguggcucaugccuguaaucccagcauuuugggaggcugaggcaggaaguucacuugagcccaggaguucauaaccagucugggugacauagugacacccaaucucuacaaaagauaaaaaacuagccgggcaugguggugcacacuuguggucccagcuacucuggaggcugagguaggaagaucacuugagccuaggagcucaaggcugcagugagccauaauugcgucccggcacucugccugggcaacagagggagacccugucucaaaaaaaaaaaaaaaaaaagaguaagauauagcuaaaagcacccuacuaugugccagcucauuucuguuuguuugguuuuguauuucaaagcaaaaaucacuauacaugugauuucugguuucuuuuuacucaaccuuaacuauguuauugguuugauuuuaaccgaagauuuuccuguguguaaauguucuuuguugcagcauaacuacaaguagucucauuuuuaauguguugccaaauauuuaccauauggauuauuuacuuuauagauuguuuauuuaccuuauagauuauuauuuccuuuguagaucauuaucuuauagagccauuggcaccagaauuagaguuuugggggguuuuuugguccuagaacuuguuagugaauuacagucacacauuucuuaauggcagggauauguucuaagaaaaauaugucauuaggcaguuuugccauugugugaaugucauagaauguauuuacacaaaccuagaugguauaguauauacuacacaucugggccauacaauguaaccucuugcuccuaggcuacaaacuuguauagcauauuaccauacucaacaauuguaacacaaugguaaguauuuguguaucuaaacauagaaaagguacaguaaaaauaugguaucauaaucuuacaggaccgcuguuguuuaugcggucuuguugaugaaaacaucauuauguagugcaugacuauaauggaauacuuuuguauugauaccuaaaaaaaacuuuugcauaaguuacugccugacaaaaauucuuagcuaucaauucuaauuucagucuugacuuaggccuccugaaagauuucucagauucaacuacagaaggccccauacaguguaugauuugcaaaagccuauauaaaauacgcaauaucugguuggauaaccucuaaaacaaaaguuuuuaacaggaaaggcagcccaaaguuccagggagaaacaugcauuugcaaagcaagggccacgcuuagaaaauaaaaguuuuuaagggugagaacugccaugagagaaaaagcacagaguuucuggaagauaacugauagaaaaagggcugaacugcccuuuuuguuuuguucauuuaauuuaagaaaugguaccagaaugccaagauuaugugucccuuccuuccaacagccaucucuucacugugcgcuguuaguagcaagagggcaaggagacauauggugaugacucagacuaccacuacuggauaagguagauaguucuuuaguggcaagagagaguucugguacucuugguagauguaucaaguauuggacuggaacuccucuuucaggaggacccagaagcuguauuuucuugcgucuccagcuaaauaaauguagguggggcaaaagcaaucauacucaccucaugcguguugaaaauugacaagaccuaugcauagccaucaggugugguaaaauagcagaguaucauggcagaacuguguguucauuuaagaacaaugggcaaggcucaagacaaaauaauacaggaccgucgcauuucuuuuucuuuaucccacccuccccaaccugagaguucacacacaggauuguauucuuauauuuucuuucuauuccuccagugaaaacucaaagaucaaauacacucauuuaccuuaagccauaauaaagcuaaccaaugaggcuuacuuaaugcacucucuuucccaagagcuaauuuuguuuuuacuagugaaaaaccuguauauagcuucagucagcauucucaaaguacagccaugugccacuguacacaaaaucuuuagcaauaaauaaaugaagauuuuuuaaaaaacuuuaauagcuauaucuuuaucuguuuuggaaaaauaacuaguauuuccaauguuauuucaguuauugcuguuuaagacaugacugagguacacaguuaaguuuaaaaugagucagauuuuaaaagugaauaggacacauguuacauaguauggcaaaaaucaugaaagguguuaagcaauugaauccuguuugggaaacacuggcuuaggcguuucauaacgcaaaugaccaaagcuuuccuuuuuggacacaaaacaucaucaguaagcucaguagagaagucacuugccagcugacuucucuacugaagauucccuucaggcuuggagaacugaaugaugucuguagagugacaggaaagucaugggagagagucauuucuguauacauuaucuuugcucaauaagcaucauaauucuugauaaugaguggaaaagguuucuugcauuuuuuugcauuuuuaaaaacugaucuagauauuugugacaggaauuuuuagaaugucaagaaagcucucugauuuuguuuagaugacauguuaauuugucuaaauuuuuauguguuuaauuuagauguugauguuagugaagauucaccuccuccccuaccugaaagaacuccugaaucguuuguguuagcaagugaacauagugagugucucuuuugcuuuuacauuuacuucauauucuaauaauaaacuccgaaaaacauaccugauuuuaaucuauuagcuauugugcuacauaauuaaauucaaaaacaaguaaauugauguugacaugcuuuuaauucuuuguuugaaaaaugcuuuuaaauuauauuuuuuacuugcuaagaucgauagaaauuacugcauuuauguuagauaucagaauucaauucauuuaaauguaauuauaggcugggcauggugguucaagccugugauccuagcacuuugggaggccuaggcagguggaucaccugaggucaggaguuggagaccagccuggccaacauggugaaacuccaucucuacuaaaaauauaaaaauuagcugggcauggugguggacaccuauaaucucagcuacuugagaggcugaggcaggaaaaugacuugaacccgggaguuggagguugcagugagccgagauugcgccauugcauuccagccugggcgaagagcaagauuucgucucaaaaaguaaauaaauaaauaaaugcaauuacaaagccaggugcaguggcucauaccuguaaucccagcaccuugggaggcugagaugcacugaucaccugaggucaggaguucaagaccagcgugaccaacauggagaaaccccgucucuacuaaaaauacaaaauuagccaggcgugguggcgcaugccuguaaucccaccuacuugggagacugaggcaggagaauugcuugaaccugggagguggauauugcagugagccgagaucacacuauugcacuccaaccugggcaacaagagcgaaacuccaucuuaaaaaaaaaaugcaauuauaaguguauuugcaaucugguguauuuucauucauuaaaaauagcacuuauugacucaugccuguaauccugccacuuugggagaccaaggcgggcagaucacgaggucaggacaucaagaccauccuggcuaacacacugaaacccugucucuacuagaaauacaaaaaauuagcugugugugguggcaugcaccaguagucccagcugcucgggaggcugaggcaggagaaucgcuugaaccccggaggcagagguuggagugagccgagaccaugccacugcacuccagccugggcaacagagcaagacuccaucucaaaaaaaaaaaaaguagcacuuauuuaugaaaacauuaauugcuuuccuuagauuuaggucaguaaacauuucuguugggugggcgucacuggauugguguuaacugaaagacauuuaacaccacuggaguagacugagcacauuggcucauaccuguaaucgcagcacuuugggaguccaaggcgcgaggauugcuugagccuaagaguuugagaccagccugggcaacacagugauaccuccucucuucuaaaaauaaaauaacuguccaguugugguggugggcgccuguaaucccagcugcuugggaggcugaggcaggagaauugcuugaacccaggaugcagagguugcagcgagcugagaccacgccauugcauuccagccugggcaacaagagcaaaaaacuuugucucaaaaaauaauaauaacaacaaaaaauuagccaggugugguggcaugugccuguaguccuugcuacucaggaggcugaagaagaaggauugcuugaucccuguaguuggaggcugcagugagccaugaucgcaccacuguacuccaguuugguaacagugagaccccgucuguggaagaaaaaaaaaagaccacuggaguaucagaacugggagaaagugaugauacuuuaaaacauugauaauauacuucucccuauuaauccucuaaaaaagagugcagaaacagcuugauuguauuuacagugucucaugcucaguggaggugcucacuugucuaaguacauuuuaccaauauauuaauuuugacugauuuuuguuuuguuucauuugguuuucuuuuuauuuauuuauuuuuuauuuauucauuuuuuugagauggagucucauucugucgccccggcuggagugcaguggcacgaucucggcucacugcaagcuccaccucuuggguucaugccauucuccugccucagccucccauguagcugggacuacaggugccugccaccacacccggcuuauuuuuuuguauuuuuuuuaguagagacaggguuucaccguguuagccaggaugguccaucuccugaccucaugauccgcccaccucagccucucaaagugcugggauuacaggcaugagccaccacgcccggcuaauuuuuuuguauuuuuuuaguagagacaggguuucaccauguuagccaggauggucuccaucuccugaccucgugaucgcccgccucagccucccaaagugcugggauuacaggcgggagccaccacgcccggccuuguuuuguuuuauuucgaguuggaguuccacucugucacucaggcuggagugcaguggcacgaucugggcucaagcuguucuccugccucagccuccugaguagcugcgauuagaggcauacaccgucacucccaacuaauuuuuuuauuagagauagggucucaccauguuggccaggcuggucuugaacuccugaccucaagugaucugccugccucagccucccaaagugaauuuugacugauuuuaagauaaauguuaaagagccaagcacaauggcuuaugccugugaucccagcacuuugggagaccaaggcagguggaucucuguuccauuugcccuaggaguuugagaccagccugggcaacauggcaaaacccugucuguauaaaaucaaaaauuagccaggcgagguggcaugcaccuauagucccagcuacucaagaagcugagaugggaagauugccugagccugggagguugaggcuccagugagccgagaucgcgccuggucaacagagugagacccugucucaacaacaauuaaaaagaauguugaaagcaaugaaacgguauacuucaguugucuaagucugucacguugucuguagauuaagcaguauacuucacuugucugucacauuaucuauagacuguaauacacugaugacugaauuuauuuacuuagguuuugaaggaaggaaacagaauguucucgaauuaauagaaacuacaauuuuuuuuuuuuagaaacuucagaaauaugcuuacccagaaacuacaaaauuuuuguggaagcgauaguuucuaaaaucuuuaggaucuguuuuuuguauuacuuuaaugcaaagaaauuucagaaauucaagguguuaauaacaauaagauuucauuuuucucagauacaccuguaagaucggaauggagugaacuucaaagucaggaacgaucugaacaaaaaaagucugaaguaaguccuuuuggaauuggaacaguuauagcuuaacauuucuacucuuuuguuaacuaaucuugcaguuguugaaauagcugucaucuuaagaucguuaaauauaguuuguaauuuuugaucggcauuucuuauacuaagauuucagaugaaaagcccauauaaaagguagguucugaaauuuuuuaaaaggguaaccugaucuacauacaacuaucacuuuaaaguauuguuuucucaagcuguuuuugaaauauguaaauuaugcuucaaauaauuuugaagguaugaaugaaauaggaguuacuauuuucaggguccuaauucuuucuuacauuucuagaugcuucccauuauaacacuaggcacauagucgcuucuuuuguuuuuuucuggcuaccuggcauuucuuugacauucgagaaauguuuuggcaauuaaauauuuugagggcguggcaugguggcucaugucuguaaucacagcacuuugggaggccaagcagaaggaucacuugagcccaggaguucaagaccauccugggcaacauggggagaccuuaucucuacaaaaauuuuuaaaauuagccaggcgugguggcgcaugucuauggucccagcuuuuugggaggcugagaugggaggauugcuugggccccagaggucaaggcugcagugagccaugaucacaccacugcacuccagccugagugacagagugagacccugucucagcaacaacacauuuguccauaggagauaacauuuuuuauuaacauuaauacuuuuuguauuuucucccauacuuuaauaucucugaaauuuagcuacaucuuauauuugauuuuaagacaugauguaguuuaauugacauauaaaauacaauaaugauauaauuaguaauaguggcuggcaaaacacagcuguauguuccuucaugcaguagcccaugcuuuucagugcucauccagaaacauuuacuccaaggagaaauagcauaacauuuuaaaauuuuaagccuaauuaaaaaacaauuguuugcuuuuccucugaugcugaaaaugauaggccuugauuucuugggauauauacccauaacagacccagcuuucuauuauuuguauauaaaaugaauguauuguaauagguauuaaaugucuuccucguagggcuugauaaccucugaaaaugagaaaugugguaaguuguuagauuuuuuuuuuccuuuuuacuguagauuuuauugauuaauuucuacaaaauaacaugcuucauaguucaugcuauauaguuauuucuguaugugaaaaugucuaggacaacucuuguagaagcuuaauauuguacuauaauucuuccaaauuaauuauuaccaccagauaguaguauugaucuggaaaaucaugggagcauuuacuaucaauaauuacaggcuaaugggaaagagauuuuuuaaaaauauuuuucuguuuuuuauuuucuguuuuuaaaaacaccuagaaguuagaucccgacuuaaauaaaugauggaauugcuucuguagaaaccuauuguuuuagaaaucuuccuuuuaguacuuuuucauuuauuugugaagaccaauaaaauugugaaagaaugaaugaauuuuaguaguuaacaucuuuuguuacuaaucuuaaacacugguaauuaaagaguaaacuacaaucuaaacaacauaaaacuuuaaaaguggaguuauuaggccuggcgugguggcucacaccuauaaucccagcacuuugggagacccaggcaggcaaucaccugaggucaggaguucgaaaccagccuugagcaacauggugaaaccccgucucuacuaaaaauaaaaaaaauagcuaggcgucaugccaucugccuguaaucccagcuacuagggagacugaggcaggagaaucccuugaaccccggaggcagagguugcagugcgccgagauugcgccauugcacuccaacccgggcaacaagagggaaacuccgucucaaaaaaaaaaaaaaaaaaacaaguagaguuauuauuucaaggugcaaauagugcauuaauuaacccugaccuuguugauuucuuaaaauuuuuuuuuuuuuuuuuuuuuuuuuuuuugagacagaggucuugcucugucgcccaggcuggagugcaguggcgcgaucucggcucacugcaagcuccaccuccuggguucacaacauucuccugccucagccuccugaguagcugggacuacaggcgcccgccaccacgccuggcuaauuuuuuuguauuuuuaguagagacgggguuucaccauguuagccaggaugaucucgauauccugaccucaugaucggcucgccucggccucccaaagugcugggauuacaggcaugagccaccgcgccuggccugaccuuguugauuucuauacaaagacauuucaguugcaacuauucccuuagaacauaggcauauaguauagcuaccuuaagggaauguaauaugucaagaccuagauuuaugaaguaagaauaacgagaauccucacauugcagaaguacucacugcagauuucugugugaccacaauaauaccugacaugauuuucugugcacacuacacuuguauuuauauuguucuugaccuguaaaauuauggugcccaggagagaaaguuuucucuuuucaugcuugccaacauuuaaaaaauuaaagaguuauauauauaugaugcuacaaaggauggugauuaacaaaggcuuuguguugcuacuuagaucauccagcgggagguauucacuaugaaaugugcauagaauguccaccuacuuucagugacaagagagaacaaauaucagaaaauccaacagaagccacagauauugguaauuuguuuaauaaauaauuuuuaguaaguaguuaacacuggcaggaaugagaaaagcucauuugccauugugaaaugacacuugccaagaauaaaacaugauuuuccaaaguugcuuggacuagucaugaaauaaaugaaauacuuaauucuauuucacauugagauuaaaaacuaaaauagaaaacugcaguauaaaaaaucuuuuguguuggaaagacuaaauuaucauggauauuuuucuuacauugugauaaaauugguuuuauuuccagcauaagauuuuuaaaagaagcaaucauuuucaguuauuccaaauaaauuuacaauuguuuugcauuuaccaaguuuuguuuggcuuaaauucuaaauucccuuguggaaauuuauuuguuccagaaaaugagaaugucuguggacaugguuuuuaguaguuugaaaguauuucugaacacugacuaguuauugugguguuuucacuguagguuuugguaaucgauguggaaaacccaaaggaccaagagauccaccuucagaauggacaugauucagggagcuagaagacacuuuaaguuauacuggaaaauucaggugccacugaaagccagauuuauaguauuccaucuuuaauaugugggacuaacagcaguguagauuguuaccuuaauauuuuuugcugggaccaucuaccugccuuauacuacacuuaggaaaaaguauuacauaugguuuauuuugaaacuucaaguauuauugccuuaaugucucuuaacccuguuacacgcugcuuguagacauguuaauauaguaauaccuuuaugauauauugaguuuaaggacuacucuuuuucuguuuuaucauguaugcauuauuuuguauauguacagggcaaguagguauauaauuugauaaaguugcaauugaaauauuauuaacagaagauguaagaaauuucugcauggucuaaaucuuuguguacuuuauuuguaaauuauuugcccuggaguuuuagaaaauaguuucugaauuuuaaacuugcuggauucaugcagccagcuuugcagguuaucagagaucaaagauuguaauaauaauuuuguaaauuguaagcaaaaaguuauuuuuauauuauauacagucuaauuguucauccuaauuguuccuguuuucaucuagucagagauucaguaagugccuuggaacaauauugaauucucuuagcuuguguguguuucuuuaauauuugaacucaagugggauuagaagacuaucaaaauacauguauguuucaggauauuugaccugucauuaaaaaaaacaaacaguuuuacagugcc

SEQ ID NO: 191451 - RNA, 35593 nt, Homo sapiens
ggaguuuuaaaaaaauuuauuggcuauguuugauuauccacaacagaauuucccuuaauuagcacaggaaauugaaaguugguuauaauuuaauaucucugcucgucuucaacagacauacucagcauuuauacuuguaaauagaauugaguuuucauuguuucguuuucuguuuuuguuuccuuaggaacaagaggaugaaggaaauauggucagcauuuuaauaacaccauaaauccaagauaauaaguaauucuauaaaguuuuccaguuucauuaauucagaauuucaucauauaacuugaaauccaauuggcuuccucuuucuuagaaacaaaaaccaaagaaaccuuuuucugaaagacauuauuuuccaguauuaggccaauuuguccucaaauuaaguagaaucucaacaucuuguugagccaguuuguaaauuccaacuucauuuaaugcugcuguggcaggaagcugcccugaagcugacugcaguacaucuuucagcaguagugcagaaccgacguucaaauucaaaacaauacaggcuucuuuuauacuguuuagggaaaacaaaggagggaaaugagaucuccauuaucugcaucaauuauauuacaauuuugagaauccuaaacagcuucucugcacugcugguccacauguucucuauaaaaauauuuauggauuuauuauuugguucuuuuaacaugguaagacuacacaggugcagaguugcuauuucuuuagauuacuauaagguaauacgaucccuauuucaauauguauccguuauuucccuaaauacaauacuuaauauuaacacuauauuaaauauagcuauaacuuuagguagauuagaacaugggaaaagacaaaaauaagagauaaaugaaagcagcagaaagaacauuaaaauaaauuuuaaaaacaguccuaugaaacguguaaacauaagcuuucauuuuauaagucuaaaaggaaugcuuuauaaccucacaaaacccaaacauaauuuaaauuuuacuuuuuuuuuuugagacauggucuugcucugucaccuaggcuggagugaaacugcacgaucauagcucacuacagccucagccucucaaguagcuaggacuacagguccacacccccacaccuggcuuuuuuuuguuuguucauuuuaauacuuucuguagagauggagucuugcuauguugcccaggcuggucucaaacagcuggccucaagcaauucucccaccucugccucccaaaguacugggauuacagaugugggcuacuaugccuggccuauaaauuuuagaucaacaaauucugaaacuauaauuauauuuagaaccaaaauuaaugucaaauguuuaaggaaacaaauuucuuucaggccuggccuauuagguauuaaacauauuuguaauuuuuuuuuuuuuuugagacagucuuggcucacugcaagcuccgccucccggguucacaucauucuccugccucagccucccaagcaggugggacuacaggugcccgccaccaggccuggcuaauuuuuuuuuuuuugguauuuuuaguagagauggggguaucacuauguuagccaggauggucucgaucuccugacuuugugaucugcccaacucagccucccgaaguguugggauuacaggcgugagccaccacgcccggcccuguaauuucuuauauuuagugaauagggcacaacuguacuuguuuucauuuucuauuuauuccuccaguaacuaagcaacuagaagcauuaaaccaaauacuagaaaacaaaacccaacagguaauuuauaucuaguucugaaacuuuuugaggucaugggucacaucuaucaucuugguuuccccauugugcuguaagcauacaguagauagacaauguuuuaaaauuucaacugaucuuaucccacccaaacaucuccagaacccuaaaguuaaaaggaguuagccuccuguaacaauuugauacauuaauauuaauuguuaaauguugagcuuacuguuuaaaauaauuuucuggucucuugcaauagugagaaaacaaagggaaaagauuccgagucauaucaaacugcagcugggcugcuccuccuucauugaagugauuagcaagaauuaucugaaacaaagaauaauucauauaacaguugucuuuauuaucacagcccaaaaacagucuauucuuacuuacuucuugguagauguauacauccagcuucucuacaagcauuugccagaaaauuuuaaauaaggagaaacaaagcugcugcuccaacugaaguaaauggucucguaacgucagcagcaacgggcaagccgaacuggacagggacaucacugccugcucugacugagauggcaaggacaaccaucuggaaaaaacacauuuuuaccaaaaaauuuucaucaguuucuauuuuucaaguuuuuaaaucauuuuaaauuugaggaaguguucuguccuagggcauuuuggauaagaaaaaauauacagccuaacauuaaaagcucuaucagaaaauaaauguaccuguauuuauauuuucacucucaaauacucuuuaauauggggauauauccaaaauauccccaaauuuuaauaugugaauuacugauauaaggcaauuacaauuuaaaaugucacuuaauuuuugcauuuuauuuauguaguuuuucuuuuuuuuugagacagagucucgcucuguuggccaggcuagagccacaggguucaagcaauucucgugucagccucccaaguagcugggauuacaggugcccaccaccacgcccagcuaaucuuugaauuuuuuaguagagacaggguuucgccauguuggccaggcuaguuucgaauugcugcccucaaguaaucugcccgccuuggccucccaaagugcugggauuacaggugugagccacugcacccagccugauuuuagcauuuuaauuaagacaucagcuaauauuauccucuaauuuuuaguaaaaacaggacuaauaaacgaauuuuaagcacucuguguggcagggacuaugcuaggacaaaaagauacugcuugcuaucaaggaugaaaguaacacagguguucacagugaaugguagugggauaaaccacaacaaaaguaugcagaguaccacaggugcacuuuacuuugcaaaaugggagacagguuaggcuauucaaccccagaucacacacuauccuauugauauauuuacaaacaacuaaauuauaaucaguuuauucugauuaagaaugucagccaggugugguggcucacaccuguaauccuagcacuuugggaggccgaggcagguggcuugccugaggucaggaguuggagaucagccugcccaaaaugugaaaccacaucucuacuaaaaauacaaaaauuagccuugugugguggugcaugccuguaguccuggcuacuugggaggcugaggugggaaggucacuugaaccucuaaggcagagguugcaaugagccaagaucgugcaacugcacuccagccugggugacagaguaggacugucucaaaaaaaauguccaagagaacauacuuuagaaauauuuccaucaacaauaaaguacauaaggccaaaccggguucuaucuagacaccuugaaaaucugaccacauauucuuuaacuuuuaccaaacugguguuaagagcugacuuacauagaggacauaccuuucuuuuuuauacaauuuugcagcaucuuuaacuucucuaaaaacguggucuacuugacgggucaacauaucaugcuuuaaacguucuaagagguuaaucaugucaucaaagacagagcucuccauagaggcuagcuguccuagcugcaauuuacucagaguauuauucucugcaaacaccuccagugcagccuguugaaguuguagaaagaacugaaagcaaaaacauguuaacacauuagcauacuuuuuuuuuaacaguuugaaauagaauucauaugucauacaauucacccauuuaaaguguauaauucgaccgggcacgguggcucaugccuguaaucccagcacuuugggaggcugagguggguggaucaccugaggucaggaguucgaaaccauccuggccaacauggugaaacuccaacucuacuaaaaauacaaaaauaagccgggugugguggcaugugccuguaauccuagcuugaaccuggaagguggaaguugcagugagccgagaucaugccucugcacuccagccugggcgacaaagugagacuccaucucaaaacuaauaauaguguauaauucaaugauuuuuuuauauauucaguuguauauccaucacaauuuuagaacauuuucaucaccaagaaaaaagccguuauccucuaauaccgucuccccacucccucaacucauaggcaaccacuaauugacuuucugucucaauggauuugccuguucuggacauuucauauaaaugaaaucauacaacguaugguugguugugacugucuucuuucaguacauuuucaaggucuauccauauuguaacacguaucauauuguaacacguaucagcacuucauuuuuuuuacauugccagguaauauuccauuauauagauagaccacauuuuauuuauccauucaucagcugguggacauuuggguagcuucuacuuugucuauuaugaacaaaugcugcugugaacauuuuuguacaaguuuuuuuuguuuuguuuuuuuguuuuuuguuuugagacggaaucucgcucugucacccaggcuggagugcaguggggugaucuuggcugacugcagucuccgccucccggguucaagcgauucuccugccucagucuccuaaguaccugggauuacgggcgugugccagcacaccuggcuaauuuuuuuuuuuguaacuuucguagagaugguguuucaccauguuggucagacuggucucaaacuccugaccucaugauccgcccaccucagccucccaaaguucugggauuacaggcgugagucaccaagccuggcaguacaaguuuuuauguggacauauguuucauuucucuugguauguacugaagaguggaauugcuggaucuuaugguaagucuauguuuuaacaguuugaaaggcuaggcaugguagcucaugccuauagugccagcacuuuaagaggcugaggccagagaaucauuuuauagugagaccuuaucucuagaaaaaaauuaaaaauuagcugagugugguggccacagaccucccagcuacucaggaggcugagaugggaagacugcuggagcccaggaggcagagguugcagugagccaagauugugccacugcacugcagccugggugaaagaacgagaucucaucucagaaaacaaaaaaacaguuugcggaacugccauacuguuuuccacagcaacuguaccauguuacauucccacuagucaauguuaaacuauucugaaauggaacaaucucaagauauauuguuaaccggaaaaagcagaagaguuugcauaguauguuaccacacguugacauacacacaccaguauuuauauaaauagcuuuaguaguauauacaagaaauugaucaaagugauuggcuuuagggaagauuagaauuaagacuuauuuucacuauauauauauuuucaauauauacaguuuuguggcuuuugaauuuuguaucacauggauuacauauagugaaaaauauuuuucucuuucaacuucuguguacgguaaucaugaacuuaaaaaaaaugacacuaucggccaggcgugguggcucaugccuguaaucucagcacuuugggaggcugacgcagguggaucaccugaggucaggaguuugagaccagccuggccaacauagugaaaugccaucucuacuaaaaauacaaaaauuaccugggcaugguggcaggugccuguaaucccagcuacucgggaggcugaggcagaagaauugcuugaacccaggaggcagaguuugcaguaagccgagaucgugccacugcacccuagccugggcgacaagagugaaaccccgucucaaaaaaugacaacaaaaaaaugacacuaucuacuuguuuuuuuuauuuuuugagacaagagucucacucugucccucaggcuggaaugaaauggagcaaucucggcuuacugcaaucuccccucccugguucaggcgauucuccugugucagccucccgaguagcugggacuacaggcgagcaccaccauaccuggcuaauuuuuguauuuuuaguagagaugggguaucaccauguuggccaggcugaucuugaacuccugaccucaggugauccacucgcuuuggcuucccaaagugcugagauuacaggugugagccaccaugccuggcguuguucuaaauaaaauuaaaaauauuuuuuaaacgacacuaucaacaagcauuuaagcauaagauuauaaaggucugaaauuuuauuuuuccaaaauuaacagaggacuaaauaaaucaccuugccaagguuuuuuuuuuuuuuucucuaaaacucugaauagcauuaggccgugaacacaucauaagccauuauuaaggucaucaaacauuuggcuucccuugauggccuggcacgguggcuuacgccuguaaacccagcacuuugggagcccggggcggcggaucacuugaggucugagguucgagaucagccugaccaacauggugaaaccccaucucuacuaaaaauagaaaaguuagucgggcaugguggcgcacaccuguaaucccagcuacucaggaagcugaggcaggagaauaacuugaaccugggaggcagaaguugccgugagccaagaucacaccacugcaauccagccugggugacaaagugagacucuugucucaaaaaaaaaaccaaaauaaaaaacauuuggcuacccuugaaaugguuucuuaagaauuuucaguugcuuuucuuuuaaaguucuugaaauaaaacuaauuaaaauuuuaaaaaccaaaagccauugagaauucucccaaagauuucauggauaacgaacaaaccauaaaaucuggugguuaauuuuuuuauacauuuacuauuaaaauucugacuacccaacaugaaccuaaaucaucucucuuugucucuccccaucucccucucuccucccgugcccccgccccauaucuuuuugcauggcaaugugucaugggcaucaacuacuuuuacauggcaacuuuuccccuuuuaacaguaccccaauuuuccuuuggggaaacacuuccccaaucugagacaacuuagguggugucagcccuauccuuuggugccagggaugcacacauaacuugguaauaccaugcccuggcugcacuaguaauuguucagagauggacauaugagaggcaccuugguauuucugcugaaacuaucagagaagcagcacucuucuuuugagauugcagaaggaccaugugagccuggaaccaccuguggccacacguccagagccugccucagaacaaaaccagaaauugacaacuuuagaacagccaugccuaauccuuuuagaaaguuaaaauccucaccucccauaucucaccccacaucccaacuuaggccaguuugaauuucauaucugucaccuacaacugaaaaauuccuaauucugaauggcugcuuauuucaggcuuggcacaaucuggcaacuggcagacaguuaucaguagagaaccugaaacaaauggaaagugaauucuguccauucuuuuuccuuuuucuaauuaugcaauacaagagcuuuaauaauuuuuacuuauacaguauucacuggcugaaggacugugaauaugauuaaagaauguuugagguuaagacagaacuugcacuauauaguuauuguuuuuuauuuuuugagacagaguuuugcucuugucauccaggcuggagcgcaacggcgcaauuuuggcucacugcaaccucugccucccgguucaagcuauucuccugccucagccuccugaguagcugggauuauaggcguccgccaccacaccuggcuuuuucuuuuuuuuuuuuuuuuuuuuuuuuuuuugagacagagucuugcucucucacccaagcuggagugcaguggcacaaucucagcucacugcaaccuccaccucccagguucaugcaauucuccugucucagccuccugaguagcugggacuacaggcgcccaccaccaugccuggcuaguuuuuguauuuuuaguagagaugggguuucaccaucuuggccaggcuggucucgaacuccugaccucaggugauccgccugccucggccuccaaaagugcugggauuauaggcgacaacuaccgugcccagccacgccuggcuaauuuuuuguauuuuuaguaaagacgggauuccaccauguuggccaggcuggucucaaacuccugacgucaggugauccacccaccuuggccucccaaagugcugggauuacaggcgugagccaccacacccggccagauuugcaccaucauaaccaugcuaggacacaauucauucacaauuugaacaaucaacucugaaauuuauuucucugcugacagagaaccuaguuaauucagcaugagauuauacguuuucuaaggguagggaugauggcuaauucaucuuucuuuuuuuggcggggggaguugcccaggcuggagugcaguagugugaugaaggcucacugcagucucaaccucccgggcucaagcaaucuucccaccucagccuccaaguagcugggaccacagagcaugccugccaugcccaguuaauuuauuuuauuuuauguagagacagggucucccuaugcugcccaggcuggucuccaacuccugagcucaagugauccacccaccuuagccucccaagcagcuaggacuacagggguacgccaccaugcucagcuaauuuuuuguauuuuuuguagagaugaggucucaccauguugcccagacuggucucgaacuccugggcuuaagugaucagcccaccuuggcuucccagaguugggauuacaggugugagacaucgugcccagccaucuuucuuaaacagacuauagcaccaaguaaagcaguugaugauguucuacaaauaauuucauugaagaaaaaauucuggcacaagaaucaagaauaacaauuuguuucauauuacuaaaaacgcuuagcagaauauggagcugugggggugcugagagaauacuuacuuaaauuagaaacacaacacauaaaaguacaaaaugaaugcauguaugcuaauuagcugacuuuauuuuuuuuuuuuuuuugagacuguuuugcucuugcugcccaggcuggagugcaauggcguauucucagcucacugcaaccucugccuccuggguucaagcgauucuucugccucagccuccugaguagcugggauuacaggcauuuuuuuuauuuuuaguaaagacaggguuucaccauguuggccaggcuggucucgaacuccugaccucaggugauccacacaccuuggccucccaaaguguugggauuacaggcaugagccaccacacccagacugauuagcugacuuuauaaacaaacugaucauuacccucuaucuuauaaucauauuaugaaauaauuguuuuauuuuccuugcucagcagaaugacauuaugcacauggauuucaguuauuuuuauaggaaaaaaacuuuaacuaauuacuaagucccagacagaguacagauaagcauaaacuaugaugauuguguuuaucagauuuuuaucuuguuuauaucuaugaugaguauauuuauuauauuuauuuuugcccccuauuuauuuggcuuauuuaaaauuuaaauaaaaaugguuuuuguuuggcuuuuucuuucacauuaaaauagguauuaugaggaauacauuuucugcuauacaaugcuuuagaaguaaccauaaauuuuuguucuacauauaacaaaauguacuauauaguguauuaauuuguauacuacaauuuuuauuccuaaacucauaauuuaaaauuuaaugcuuucuagacuuccuuccuaauccaggcauuuaauguuuuuacauguccauguuugaauauauuucauuuccgcuuuuauuuccuguuuuauugcauuaagauaauguacagauauuuuaaauuaauuuaucuuguccaucuuugugacucaucuggacacacuugaaaauuguguuuuucccuguuauacuauggaauguaucacuaaucuucaguuaaucaaucuaauuguuuaaguuuacaauuuuuuaauucucacuuuaccuaucacauucuaauaguauauuuaagucuuuaguuaaaauugcauuugucuuguuuaccuuucuguuuucauuuuaugacacaauuauauauuuuauauuaauaauucauauuaaaauuuucauagucauuaucagauuuauuccguauaguuaguuucuuuaauauuuaaugucuauucuauuuuaccauuucauagucauccuaguucucuguuuaugcguucugucaugaaauguacuuuaugggacacccaaguugguauaaaccuaaguugauuuuguauucucacagaugaucucagaacagugauucuuaaccuaagggcacccuguucaagaagggaguucugaagguccucugagauuauguuaauaucuaaaacaucuaaaagaauucaucugucuaugucaagguuauaaaggcuaauuagacuuuuguuuggaagcaucuauuggaaaaucugguugccaaagaguccugauagccaggauauuccuugaauuaauaaaaacaguaaaaauaaauuacuacuuaauaauuauacuuaggcauaucaagucugucaguagguuaacuuaauuaggcagaucaaaucuugucagaaucugcauggagaaggcaagggucaguagaaucuggagggaaaaggccuuaugguauuuguuaacuggacccaagguuuuuauuuauagauuuauuuaaaauauaccuuccaauaaaucaguuaauuuuuucagauacaaucauagugcuguuuuuuuuuaaaagaguucuuaccuuuuagagauaaauacuaauauauaucucucuauauaaauauuaccaugaaauaugauaucugagaucugcuucaaaauaaucaaguauuggggggcagaaaagagguuuaaauaaaacaaaauugguguaagaaguugagugagcugggcaugguggcucacaccuauaaucccagcacuuugggaggcagaagcagguggaucaccugaggucaggaguuugagaccagccuggccaauaaggugaaaacucgucucuacuacuaaaaaaaaaauuagccaggcaugguggcgggugccuguaaucccagcuacucaggaggcugaggcaggauaaucccuugaacccaggagacagagguugcagugagccgagaucgcaccauugcacuccagcccgggcaacaagagcgaaacucugucacaaaaaaaaaaaaaagaaguugagugauagccacgccacagaaguucauuuuccuauucuauuuacucuugcauauauuugaaaauuugauacaugaaauguuaguuucuuauuuuuauuuuuuguagagacagggucucacuauguugcacagcuggucaugaauuucugggcuccagugauccucccaccucagccucccaaguagcucggacuacaggcauaugccaccacaccuggcuaauuuuauuuuauuuuuuauucuuuggagaaauggggucucccuauguugcccagguuggucuccaacuccugggcucaagcaauucucccaucucagccuccuaaagugcugggauuaagagcaugagccacugcacccagccaaauagauuuuuaauguaugaaacaauuaaaacuuuaaauguuucuuccuauuuucaugacucuuuauaaucugucauguuuugaagacauucaagagguauuaaacauuauucuuuuauuuuccuuaaaguccuggauugcuuuugacaucauuauuuaaucuuagcucuuccugugauugcaauuaccauacaugaauauuuccaaguaugguucacucuauaaacaacuauuucaugaaaggcuugcuugccuuuccaaugauuaaauacauuaaaauaucaggacuauuuaacuacuugagauuugauugagaaaaauguguauuuuaauuacaccuuuuaauuauggcacuaugguucugucuagcauguuuauuuuugcuugcaauagauucaacauuuugaaaaguauuaauaaaauaguucgaacuaguauauauuacuuaauauaaaagcauauuaacucacaacauugucagcccaaucugcuaguacuguugagauguaguucacagcauuaagaauugcacaguaucgaaagccaagggaagcucuagucucuucuuucaucacuuguguuaaucguauccuaaaaucaucuacuaaguccuucuguaacuccaggaacugaagcuuucgggaagcugugggaagauuuuuauaccugucuguggaaaaaguuauuaagacauaugaagguuuugguaccaucuaugauauaguuauaaguuuucccuacuguccugcuucagugcuuuugucaaaaaucaauugaccaguagucaagaauggauuuauuucugagcucucuuaaggaugugaguuucaaaaguauauacauuugccaaaacucauugaacaauacaaauaagaucugcacauuacacuguauguaaacuauaccucaaguuuucaaaaaggcaaaugaaaaaauuauacauaaaaaugacaguuuuggccagucgugguggcucacgccuguaaucccagcacuuugugaggccaaggcagguggaucaacugaggucaggaguucaagacuagccuggccaacauggugacaccucaucucuaccaaaacuacaaaaauuagccgggcaguaguggcgugugccuguaaucccagcuacuugggagucugaggcaggagaauugcuugaacccgggagguggagguugcagugagccaacauggcaccacugcuuuccagccuaggcaacagagugagacuccaucuaacaaaaaaaaaaaaagaaagaaaaaaaaaugacaguuucuucaacacaaauaaacagcauuuuuuuaaaaaagaaagaacuucaauaaauuaaaagauacacauuuaagaauuuacaggcaguuggccgggcacgguggcucacaccuguaaucucagcacuuugggaggccgagguggguggaucacgaggucaggagaucaagaccauccuggcuaacacagugaaacccugucucuacuagaaauacaaaaaaauucgccgggcacaguggcucacgccuguaaucccagcacuuugggaggcugaggcggguggaucacgaggucagaagaucaauaccauccuggcuaacacggugaaaccccaucucuacuaaaaauacaaaaaauuagccgagugugguggcgggugccuguagucccagcuacucgggaggcugaggcaggagaauggcgugaacccgggaggcagagcuugcggugagcugagauggcgccacugcacuccagccugggcgacagagugagacuccaucucaaaaaaaaaaaaaaaaaaaaaaaaaaaaauuagcuggguauggugacgggugccuguaguuccagcuacucaggaggcugagguaggagaauggugugaacccaggagguggagcuugcagugagccgagauugcgccacagcacuccagccugggcgacagagcgagacucugucucaaagaaaaaaaaaaaagacaauuuacaggcaggcaugguggcucacgccuguaaucccagcacuuugggaggccgaggcagguggaucaccugaggucaggaguucgagaccagucugggcaauaugaaaccccaucucuaguagagccgccaccaugccuggcuaauuuuuuuguauuuuuaguagagacgggguuucacuguguuagccaggauggucucgaucuccugaccucgugaccugcccaccucagccucccaaagugcugggauuacaggugugagccaccgugccuggccaacugccuguaaauuuuuguauuuuuaguaaaaauacaaaaaaaaauuaaccaggcaugguggcaggcaucuguaaucccagcuacucaggaggcugagguaggagaauugcuuggacccaggaggcggagguugcaguaagccgagauugcgccauugcacuccagccugggugacaagagcgaaauucugucucaaaaaaaagaauuuacaauugacaugaugagaugucugaaauuuucuuugaaauacuccagaaaaaaaaaauugaggaguaaaauauaacagaaaagugauaauugcuuuaaacuuuggcaauagguaccugagaguucaucauauuauccuacuuuuguguauguuugaaaauuuucugaauaaaaaguuuuuaagagacaugaauuuuccuuaauuuuuuugucuuaguauuuuucauauuuuucuuauaguuaaaaauauggaaugaugacugggcacgguggcucaugccuguaaucccagcacuuugggaggccgaggcagguggaucacaaggucaggaguucaagaccagccuggcuaagauggugaaaccccgucucuacuaaaaauucaaaaauuagcugggcguggcagcaggugccuauaaucccagcuacuugggaggcggaggcaaaagaauugcuugauccugggcagcagagguugcagugagccgagaucaugccacugcacuccagccugggugacagagugagacuccaucucaaaaaaaaaaaaaaaaaaaaaaaaaggaauuauuuacugacugggcuggaaugauacuucuucagguuaccagacaagccuaagaaacggacaggcuagugguugacgaaggugaagagggccagggaugguggcaaugaggguccaguggcaccuggacaacaagcaggcccacaagggggcaacgugauuggcuaaagaccaaccagggccagaggaugcuaggcuacccuccagccagagaaucccugcacuguaacaaaaguuccuauuacuacuccaauccuuaaaauuacuucauuauuuuacucucuucugcaaucuuugauaaaucaagaucaagacaauauuuaaaauauaggccaaucaccauuuacugaagacaccuaaaaagcccaauagcaagacaguuuggauaauaaaauuaaauuccuauuuaauuguuuuuguguaauuauucaggaaguuuuccuucauguauaccaauguuuaaauccuuaaauuauuaaaaacccaaaaguuagaauauuguguuagauuucuaccaauauagaaacugaauuugaagauaacaaccaucauauaauauuaauuugcugagccacuuauuuauugauuacuuuauugacagggucucacucugucaccaaggcuggacugcaguggcgugaucauggcucacugcaaccucuaccucccaugcucaaaaaauccucccaccucagccucccaaguagcugggacuacaggcacacaccaccacaacuggcuaauuucuguauuuuuucggaagagagggcauuucaccauguaccccaggcuguucucgaacuccugggcucaagcaaccugcccgucucagccucucaaagugcuaggauuacaggcaugagccacugcacccagccuacugagcuacuuuaaaaacuaccacgugaaaacaguacuuuuaaaacaaagucauaucuuaaaagacauacuuaccaguuauaaccaagaguagagucauaaaaguuucugcacaaucuggaacuuucauuucauccacgucagugauauccuuauauugcgauacccaggcagcuucugaggaaagcauugaguccauuuuuugaagagcaacugauaagcagacaaaacaauuaugucaauuaaguaguuacagucguuccuaauuauucaacuuguaauuuuuuaggaaugauggcuuuucuauaaaaaagaaacaaaccuacaauaucccacugguuguacuaaauuuaacuuaauuaaugcuuuaaacaggauacuuuacucccauccccaaauucugaaaauaguuauguugacuagauaagcuacaguaaaaaauauucuauuggccaggcacgguggcucacaccaguaaucccagcacuccaggaggccaagguggguggauugcuugagucuaggaguucacaaccagcuugggcaaaaccccagggaaaccccaucucuacaaaaaauacaaaaaguagccaggcauggcuugcauauaccuauacucccagcuacugggguggcugaggcaggaggaucaccugagccccagaggucgaggcugcaguaagccaugaucggcccacuccacucuagccucggugacaaagugagacccuaucucaaaaauaaaaaaauaaaauauucugacacuuugggaggccaaggcagguggauuacuugaagucaggaguuccagaccagccuggccaacauguuguaacccugucacuccuaaaaacagaaaaauuagccaggcgugguagugcgugccuguaauccuaacuacucgggaggcugagacaggagaaucgcuugaacgcaggggguggagguugcaaugagcugagaucaaacuacugcacuuuagccuggacaacagagcaagagucugucccaaaauaaauaaauaaaaauaaaauaaauuauaugauaaaaucuauaaaacaaacaccccacuggcuugacuauuccacucuagaaauauguagaguguaauuucaggaaaaauggaaguuucaugugaaguaaagaaaagauuaucucugaaggaaacagaaaacccugaaaaggaaauuucaaauggcucuaguuccuauuuagaacuggagaagaaaaauaucaaaaauguauacccacagaaacagacauaucucccuaccaucuggccacaucagcacuuacauuuucucuccaccgucaaccaucucugaaaacagguuuccucugauagaauaugcauacaacuagcaaaagugccaggauagccaugaacacuguguagcucccuuucaaacaagaguacuucauccaccaaaugacagaagagauugucaucauauagcagacaaggaauaucaguggcuaacuucucaagaaccagcaucauaaggccccgagaaaauucaagcuaaaaaaauacacaaacaugagguauguaaauaaaaaguuauccaugcacacauacaguucuaaaacagaaacacuuaugacugagucucuuacccuugcguuuaccaaagagccuacuuugucuaauauuggcugaaucuucucauccagaaauucaguaugguuuccaauccacauaaguacuugagccaaguaccauucuggcuaaggaaggaggaaaauaguuugaauucuuaagucauuccaauuagaaaguuacaauuacaugguucuauuuaauuguauaugcacaacacuuauaaaaauuaguugaaaauuccuguauguaagagcacaauuucuacuccaaauuuuaaacuccugcaaggcuuaauaaucaaauguuugcuaauguacucccaacaaauuucaauaauaugacuuaagucaauaaacucauaaauuuacaaugccauauauauuuaaaaccuagcacuucaauaauauguaaaaugaugaguauuacaaagaacugauggccuauauuuuuugaaauagcauuugaaaauaauuuuaauauuauuuucuuaugguuuuuauuuucaaaaaguaaaucaagaaaaaaauugcuggccaggcguggcagcucaugccuguaaucccagcacuuugggaggccgagguggguggaucagcugaggucagaaguucaagaccagacuggucaacauggugaaaccccgucucaccuaaauauacaaaaauuagcugggcgugguggugggcaccuguaaucccagcuacucaagaggcugaggcaggagaaucgcuugaacgcgggaggcagagguugcagugagccgagaucacaccauugcgcuccagccugggcaacaagagugaaacuucguuccaaaaaaaaaaaauugcuagucugcauuacaaaaacuacgcaugucuuauacagguuuaagagcagaaauaccaaguacaugccaggcgcaguggcucacuccuguaaucccagcacuuugggaggcuaagucagguggaucaccugaggucaggaguuccagaccagccugaccaauauggugaaacccaucucuacuaaaauuacaaaaauuaguccaguguggugacaugugccuguagucccagcuacuugggaggcugaggcaggagaaucgcuugaaccugggagguggagguugcagugagcagagauugugccacugcacuccagccugggugacagagcgagacuccaacucacaaaaaaaaaaaaagaaaagaaauaccaagugcuuacuauuugcuuugcuuuguuuugcaaugauaacucagcaauaucugaugcccaagagcggaaauaccauuuuuccuacaguauaugaacacaaguccucaauuauauguaugaacagcaguaacaaaacaggaauguagcccuuuagaaaaaaaacagaaaugugaagagagucagauuuuaacuuaaaccagcaaagguauagaaacucuaacauuuguuaccaauaaaaaccaaggacaagagcuggcaaaacacaccuugcuuaacacauuagucugccgguucccucugaagugauaccugaaccucuucugaagaggagucagcauaaccuggaugggcaggaugacagaaggggaggcaggaagagaguauuuuucugggaguugcuuuggcucaguaaguaauucaucucugacauaaucaagucaaggaaaaagaaucaaaagcauaccuaauauacacacacauauguauguauacacacacaauaaauuuuuccaacaaauguaucagauacucaguagaguuaauuaugaugcaaauaauauguaaccuaauuuuauauugaauaaacauacaguuaauucuuuauauugaauauacauucaguuaaaaugcacaaaaagccaggcaugaugauagugaaucaugccuguaaucccagcacuuugggaggcugaagcaggcuaaucacuugggccacuucacaggaauuugagacgugccuaggcaauacggcaaaacccuaucucuacaaaaaacaacaaaaauuagcggggcaugguggcacgugccuguagucccagcuacacaggaagaagaggugggagaaucaacugagccuggguggucaaggcugcagugagccaugacugcaccacugcacuucagccugggugacaaagugagaccaugucuuuaaaaaaagcacaaaaaugagccaggugcaguggcucucaccuguaaucccagcacuuugggaagcugaggcggguggaucaccugaggucaggaguucgaggccagccugaccaacauggaaaaaccccgucucuacuaaaaauacaaaauuagcugggcauaguggugcacgccuguaaucccagcuacucgggaggcugaggcaggagaaucgcuugaacccgggagguggaggcuguggugagccgagaucaugagaucacgccacuucauuccagccugggcaacaagagcgaaacuccaucucaaaaaaaaaaaaaaaaaagcacaaaaaugguauuagaauuaaucuauaaaucuuuccuaaaauaguaacaaaaaaaauucaaguaucauuugauuaaauucacgcuaugacacuaaagguuuccucccaauugcccauuuguucuguugccccaagagaccuuuuugugcuaugaacuuggaucagucauguaucccggaacucuuccuuacagcccucacaccuacaagcaauucacuuugcaagaguacaguccaccacucaguggacauuuacagaccaaguccaaacacaggauucuuauuuggcuuucuuggccacuuugaaaaaguuuuacucucuagccacaaacccauucuagaaaaaagaaauuuuaguaaguuuucagcugcaacaaagauacgagguuuguaguuucaaaagcugacaaaacagugucuccagguaacuguauaucuccggggcacuggcaggucgacuuaagccaacaguuugugauugagggggugcgaugaauggccaaugaagcugugcuaaaauuuccucaaaaucacugcaauggaaaaguaacacauacauuucaguacaucaccaaaugaucaccaaauacccaucggaaagcaauuaccacaaaauauggguaaauucccuaccuuguaagcuuguccuugagaauuuuaugccagaauuuaacuguggcucucaugaaaccaagaagaugaguacaagaugauuccugaaguuuaaugucaaguucugccauagacacuagaguggaggcugccuccgguacauuauuggucaucagauauugcugaauguuaucacuguaaacaaaguaaagcaaauuuuuuuuucuuuugagacagagucucacucuguugcccagguuggagugcaguggcaugauuuggcucaaugcaaauucugugucccagguucaagugauucucccgccucagccuccacaguagcugggauuacaggcaugcgcccccaugccuggcuaaauuuuuuguauuuuuaguagagacaggguuucaccauguuggccaagcuggucuugaacuccugaccucaagugauccgaccgccucggccucccaaagugcugggauuagaggcgugagucaccgugcccagccgaaagcaaauuuaaagaacggauugcucagaauaauuucaaauucggaaaaagugcuucuucuucauguuuuauauaaaguuacauccaaggaagaaugaagcaccacccugagguagccuuuguuuuuuaacaaagcaccacccugaggccuuuuaccaaggccucucugggagccuagaguccucuacuucugcauucuucuaagagcagcagccugcagccuauguucaagaccucucccgggaccuuucccuuccuacuccuccugacagaccuguuuugugucauauuccuuugggcaccacucauuucugauaaaucugccuuuuacaaagucuucaguaucuuaauccaagggaauaaugugguaguaucugguaaagucaaguaugauggucuucaauuguuacauacuuugcccagcugaacuugauuucccacuucaaagaaauauaauuccaggcggggcuugguggcucaacccuguaaucccagcacuuugggaggccaacauggguggaucuccggaggucaggaguuugagaccagccuggccaacuuggugaaacgccccccgcccccccuuccccaucccccaucucuacuaaaaauauaaaaacuagccaggcaugguggugggcaccuguaaucccagcuacucgggaggcugaggcaggagaacugcuugaacccgggaggcggagguugcagugagccaagaucaugccacugcacucuagccuggcaacagagugagacuccgucucaaagaaaaagaggccaggcgugguggccucuuugggaggccaacauggguggaucaccggaggucaggaguucgagaccagccuggccaacuuggugaaacccuucccgucucuacuaaaaauauaaaaacuagccaggcguggucaugggcaccuguaaucccagcuacucaggaggcugaggcaggagaauugcuugaacccagaagacagagguugcagugagcugacagggugccgcugcacuccagccucagcaacagaguaagacuccaucucaaaaaaaaaaaaauauauauauauauauacaaauauuacagaagaauuucaaauguacaaacagaauaugaguacugccuuuuuuuuuuuuuuaaaagagucucacucugucaccuaggcugcagugcagugguacaaucacggcucauugcaaucuuaaccucucggggcucaagcgauccuccuaccucagccucccgaguagcugggacuaugggugcucaccaccaagccuggcugauuuuuuuuuuuuuaaacagagaugggguuuugccauguugcccagacuggucacagaauucagagcucaagcgaucugcccaccucagccucucaaagugcuaggacuacggcaugagccaccaugcccggcaggaguacugcuuuuaaggaaggaaugaaauagauuuccucacaacacuaaaguaugaaugacauuuacaacauaggaaaagcuagagaaacaagguucacucagagugauagugcuauacuauaguauccaagaaacagagcuaauguaaggaugcuaauucuagcaagaagaaacuacuugaaaaaaagacaauguacaucagaauaaaaauaggccauuauaaaaaaauuuagagaugaagaaaaucccagaagcucuaaaggaaagcuggaaauggagagauuaucauaaaagaccucagggaaauaacacauuauuaaagacagaaaaauaacugugcucuaccugcuuaugaauuugaucccuauuucuaauauaaaucccucggcauauuucccuuauaaacaauucagauaucugaagaguuuaucaaggccaggugcaguggcucacaccuguaaucccagcacuuugggaggccaaggcaggcagaugacuugaggucaggaguucaagaccagccuagccaacauagugaaacccuaucucuacuaaaaauacaaaaauuagcugggcgugguggcauacaccuguaguccuagcuacucgggaggccaaggcaggagaaucgcuugaacccgggagguggagguugcagugagcugagauugugccacugcacuccagccugggcaacagaggaagauuccaacucaaaaaaaaauaaaaagaaaauuaaaauaaauaaaauaaauguuaaaaaaaagaagaaaaaagaaaaguuuaucaauaaccauggaccuaauuuaguuaaucuauuacuuuggcuacuacaagagugagguuuucaaauaacguauuuuacuuaauaaaguuauuaacauugccccuuacugauauuuccuuucugagggacaaggagaaaugcaguaaaauaaagcaagguuuaaaauuccuucacugcaaauaauuuaucuaaacaagaaugagauguucuaaaccacuuuauauguaaaacuccucauacaugcaaaacaaaguuuuuuuguuuuuuuuguuuuuuuuuugagacggaguuucgcucuugcugccuaggcugcagugcaauggcacaaccucagcucacugcaaccucugccucccgaguccaagcaauuccccugccucagccucccaaguagcugggauuacaggcacgcgccaccaugccuggcuaauuucuuuuuuuuuuuuguauuuuuaguagagacgggguuucaccauguuggucaggcuggucucaaacuccugaccucgugaucugcccgccucggccucccaaagugcugggauuacaggugugagccacugcaccuggccuaaaaacaaagauuucuauauuauauugauauguaaaauucuuuaaaauuuugggaaauauaugcaagaaaaagaaauacauaaaacauauccauaacaaaaguaauaucagguuuauuaacuaugauacauuugaaacaggacauuaagacucccagaagacuuuucucccucagguuuuccaggcaaaauuaaugguugcugacagcucugcagcaaguacuaguuaaaacaaugcaaggauaguggggaccuuaucaucuacuaaucuagguggaaauguuacuuuggguugucugaaaggcaaagcuagauacaauuaacuaccagugauagguauucaacucaaaaagaacuaaggucaagccuuacuuccuuuuuuguuuuuccuacccagagguagcagaacucuuguuauucauccaagaauacuguguagcucuuaugauucccacugaaaaauauucaaauuauacaaaagcaauccauuucauuaacugaccaguucuaaaaauuaaauaagaauaacuauuaccaaacuuuguguuuuauuaauuuggcauuacaaagaauaguuuuuaucauguguucauaauccaacuguaagacuuaaaaguuuggccggacgcgguagcucaugccuguaaucccagcacuuccagcggccgaggcuggcggacagugaggucaagagaucgagaccauccuggcuaacauggugaaaccccgucucuacuaaaaauaccaaaaaaaaaaauuagccaggcaugguggcgggcgccuguagucccagcuacucgggaggcugaggcaggagaauggcaugaacccgggagguguagcuugcagugagccgagauggcaccacugcacuccagcugggcgacagagcgagacuccaucucaaaaaaaaaaaacuuaaaaguuuaacguacuuacauuaccuucuuucaaaugcuaauuaagcucccugaaaagcuuauguucacucacaauaaaggaaaagaaucauuaucauaaugcuauuuucacaacaacugguaaaauuauauuauuauaaucuuuaauuaacucaauuauuuaauggcacacauguacucucuaagacagaagccucaaaggaaaauaguaauugugagaacaaagaggcccauuuuaccuuaguucuucaauuugugaaauccauuuaagguaagcaagaugacguucgaucucuucaaucuggcuaaucaugguuccaagaucguccauccaagguugcgcagucagcaaauggcuguuaauggcgcugaagagaugaguuuccugcuccagaaacugauuaagaaauugcuuugauucuucugcauuuuuuaaggcacuucgaauucuuuuaggaauuucugaugaaauuguaaguaccugaccauaauuuuaaaaaagaaagaaagaaagaacagcagcaaucagauaaaauuuucauaauuuuuuuuuugagaggggaucucacgcuguugcccaggcuggagugcagugguaccaucauagcucacugcagccuggacuuccugggcucaaccaauccucccaccucaaccuccccaguaguugggacuacacauaugcaccacuacaccuggcuuuucuuuuuuuuuuuucuuuaaauagaaauaaggucucacuauguugcccaggcuguauguaaccuuuuuuauuaguucguucccuucaaaauacacauuuuuuguaacagaacugaaaaucauccaucaaaaccuucaaaaaaagguuugauuucuucauccuguacuaaucaauccaaacauaacaugcuguuuuauauacacacaaauagcaggaagaaguaugccuuuguguugaaaacaauaagugaaacaaaaaaauaaaaauaaaauaaaaaauauaugcauacauacauauacacauacauguagagaaagggacuuaacucacuggcuccaguaagcaucuagaggucugccuccauaggcucagcagaggauccagcuagagaaaacuuauuuuauuuuuuugagacagaguuucguucugucacccaggcuggagugcaguggcgugaucucagcucacugcaaccuccaccucccggggucaagugauucuccugccucagccuccuaaauagcaggaauuauagacacgugccaucacgcucggcuaauuuuuguauuuuuaguagagacgggguuucaccacguuggucaggcugaucucgaacuccugaccucaugauccgcccaccccagccucccagagugcugggauuacaggcauaagccaccgugccaggccgagaaaacuuauuaauacaugcucuaccugcuaaauauuuuccuucaaagcaaaggaagggccgggcacgguggcucacaccuguaaucccagcaguuugggaggccaagacaggcggaucauuugaggucaggaguucaagaccagccuggccaacaugaugaaaccccaucucuacuaaaaauacaaaaacuagccagguuugguggcacacaccuuguaaucccagcucuagagaggccaaggcaagaaucacuugaaccgggaggagguugcagugagcugagacugcaccaccgcacuccauccagccugggugacagagcaagacuccucaaagaagaaaaaaaaaaaugcaagcugggugcggugacucacaccuguaaucccagcacuuugggaggccaagguggguggaucacaaggucaggaguucaagaccagccuggccaagauggcaaaaucuugucucuacuaaaaaauacaaaaaaauuagcugagcaugguggcacauaccuguaaucccagcacuuugggaggcugaggcagagaauuucuuaaacccgggaggcagagguugcagugggccgagacugcgccacugccaucuagccugggugacagagcgagacuccauaucaaaaaaaaaaaaaaaaaggaaacaaagaucucauucuaacaggcugagcaucuauauuuugccaacauaccccaggugauucugaauuaaggccaggcuaagaagcacugacuugaugagaugauauccaggcaaugccuuuagaaagggcauuuaguggccaggugcaguggcucacaccuguaaucccagcacuuugggaggccaaggagggcaggucacuggaggucaggaguucgagaccagccuagccaacauggugaaacccugucucuacuaaaaauacaaaaauucagccgggcacagugucucaugccuguaauccuagcacuuugggaggcagaagcugguggaucacuugagguaaggaguuugagaccacacuugccaacauggugaaaccccgucucuaauaaaaauacaaaaacuagccgggugugguaguaugagccuguaaucccagcuacucaagaggcugaggcaggagaauuggugaaaccaggaggcggagguuacagugagcugagaucgcuccacugcacuccagccugggcgacagagugagacucugucucaaaaaauaaaauaaaauaaauacaaauacaaaaaugagcugaggaugguggcgcaugccuguaaucccagcuauucaggaggcugaggcaggagaaucacuugaaacccggaaggcagagguagcagugagcugagaucacaccaccacacuccagccugggcgacagaggaagacuccaucucaaaaaaaaaaaaaaaaagaaaauggcauuuauuaagugaauuuuucuuauaguaugugggaaaacauauacaaauauuagucaucagcaaaauacaaagaacauuauagaauaauuucaaucaacagugauuagauacuuauucuguaccaggcacugcgcuagaaauaugcagauaaacaagacacagcauccguccuucaggucacuuugguauauaagaguguuguaagcaaauaauuucaacagugggauuaaugcaauaaaauagacaggcuauauuuaaugaaugggcacauuaaucaccuaaagaucuuguuguaauacagauucugauacaguaagucugaaguaagacugagauucugcauuucuacaaagcucccaaucugccuaaacuaacaugguaucagcaagagugggaaagaugggccgggagcagugacucacgccuguaaucccagcacuuuggaaggccaagauccacuuucgggcagaucaccugagguugggaguuugagaccaaccugaccaacauggagaaaccccaucucuaccaaaaauacaaaauuagccgagcgugguggcacaugccuauaaucccagcuacuugggagccugaggcgggagaaucacucgaacccaggagguggagguugcagugagccaagauugugccauugcacuccagccugggcaacaagagugaaacuccaacucaaaaaaaaaaaaaaaaaaaaaagagugggaaagaugggauggauaccagagauguugaggcugaacucagaugacuuggugaugggauagaggaugagaggaugauaagaaggaaucuaggacuccuaggcuucaggucugggugacaggcaaauaguggugccauuaucuaaccaagacagacaagccucuaaaaaauggaucaguauaguuuuggacaugcugaauuuaagguucaauaaggaacuucaguaaaaguuucuguggucauuagggaaacaaaccugauuacaguggguaaaagaugaaugacaaaaaguagagauagauaacaaagguuacuuucugaagccugacaaucaaaggaaagaacuaauaccugcuaaaagaucauggguuuuuuuguuucuuuguuaagguuuuauggaaaagaccugucuaugugcacaugcugaagggauaggacugguugacgaacacaggguaaaauuauaagagugacacaaguuuacugagguggcagagagaaccugggguauaaggucugccuucgacugauccuuugcugaaugaagagguuaaaaaugacugcacauaaauuugucgauugugggauagacuauucaacagacugaauucaaugcuacuaaauucaugcuaggcuucuauuuuuuucugcuagggaaaaggaaagggcagaauggacagguuggguagaugucucaaacagaaucugaaagaacaguugaggggaguagcagaggagcugacguucccauggaaggacugcugguggggcugaagacucagccaggguggcagaccacacacauagauuggcaucaaucuacucagcugcaugacuuccuccaacugggcccacaacaaccugccugcaggagugaaaaggcagacaaagccaggcuaaacuugaagacuagcaguaguuguggugggaagacaggaagguguggaggccuaagguaauggggacaggagaauauacgaugaccaaaaaccuggaaauaacccacacagaauuuacuuaaccuaauuuaguagcuauaugauaaaaauguuuuaucuuggccgggugugguggcucaugccuguaacccuagcauuuugggaggccaaggcaggcggaucacgaggucaaggaaucgaaaccaucuuggcccaaguggugaaacccugucucuacuaaaaauaccaaaauuagcugggcguggugucgcgugccuguagucccagcuacucgggaggcugaggcaggagaaucacuugaacccaggaggcagagguugcagugagccgagaucacgccauugcacuccagucugggcgacagagucagacuccgucucaaaaaaaaagaaaaaaauguuuuaucuuugacaaacacaccauugccaaguagaggggccuacuuauuuuuuuguuuaagcuuauacucauuggguuuuuaaaaaauuauuuuaagugauauguucauuguaaaagaaaaaaaaaccuauaaauacauagaaauauauauuuuugagacggagugucacuuuuguugccccggcuggagugcgauggcaugaucucagcucacagcaaacuccgccuccuggguucaagcgauucuccugccucagccucccgaguagcugggauuacaggugcccgccaccacaccuggcuaauuuuuuuuguuguauuuuuaguagagucgggauuucaccaugugggucaggcuggucucaaacuccugaccucaggugauccaccugccuuggccucccaaagugcugggauuacaggugugagccaccgugccaggccuaaaaauauuuuuuaaauacaucacuugucaaccaaccacacagaaauaaccguuacguuauacuucuuuucacuuuauacuucucccuauggguacauuuauuaaaaucugaaauguggccggguauagcagcucacaucuguaaucccggaacuaugggaggccaaggcagguggaucaccugcggucaggaguucaagaccagccuugccaacaugaugaaaccccaucucuaccuaaaauacaaaauuagcugggcagggugacacaugccuguaaucccagcuacaugggaggcuaaggcaggagaauugcuugaaccugggaggcagagguugcagugagccaagauggcgccauuguacuccaaccugggcaacaagagcaaaacuccgucucaaaaaaaaaaaaaaaaaaaaaauugaaaugaugguguuuacaccaugguauauauuuuuguaugccaugaaauuauuugcuuguaaaagcaauuuaaaagucacuguauguucacuagaaacagauugaaaggaaaaaaaagucacucuaugaaaaucuauguaaaauguuaggucucacuauguuuugaagacaaaccauaucaguaggaacuuugucuuuuaccuaauuuguaaaauagguaauacaauguacguucuuaaauccucuuaaacaguauauaauagacuauuugucacguucuauaucuuuaaaauucuauauauaauagauuauguuuauauuauauuguuaaaaguauuccacugauaauuauuucagugaguuucaauacuuaccuguucuucuaacugcauuuuacuuacuguccucuguucuaugaguuuaucaaguuucuuuaaagauuuaaggucauuuccaacuuccuuuucuaugaaugcagacacauaagaagggagaucaccauuaucuguaccuucacugacuuguuuacuuccaauaagaacuguaacauuuaugucaccuacaacaaaagaauaacaauuacucaacgccacuaaguacuauggaguuaaagaaaauauaaaacauauaaaagcaguuuaucugccuucaaaaguuaauaauuuugccaggcacgguggcucacaccugugaucccagcacuuugggaggcugaggcaggugcaucaccugaggccaggaguuuaagacuagccuggcaaacacggcgaaaucccgucucuacuaaaaauacaaaaauuagccaggcgugggggcacaggccuguagucccagcuauucgggaggcugaggcacgagaaucccuugaacccaagaggcagagguugcagugagccaagaucacaccacugcacuccagccugggcgacacagacagacucuguaucaaaaaacaaaaccaaaacaaagcgccacugcacuccagccugggcgacagagacucuguaucaaaaaacaaaaccaaaacaaaacaaaguuaauaauuuaaagaacaacacacacagacaaaugcccagaagaauagcucuaaagcacucuaucaaacaacuacugcaaaaugcuuaagagcugagggaaguauuaaaggaaaaauuccuaaagugugauccaguaaccacagguuucaauagacaaggaauaauaccuuuucaaaauguguaaggaaccaguaguauggucuagggcaacaccaaaagaagacucuuguuuuaaaguguuuuuaaaaagaccgggcgcaggggcucacaccuguaaucccagcacugugggaggccaaggcaggaggaucacuugagcccagaaguucuagaccagccuaggcaacaaagcaagacuucaucuaacaaaauuagccaggaaugguggaacacaccuguagucucaggugggcugaggugggaggauugcuugagcagccugggagauggaggcugcagugagccaugaucucacuacuacauuccagccuggacagcagagcaagaccucaucucuuaaaaacaaacaaacaaacaaacaaaaaaguaaaaaagguuuggcugggcgagguggcucaggccuguaaucucagcacuuugggagguugaggcaggcagaucacaaggucaggaguucgagaccagccuggccaauauggugaaaaccugucucuacuaaaaauacaaaaauuagcugggcauggcggugcacgcuuauagucccagcuacucgggaggcugaggcagaagaaucgcuugaacccgggaggcggagguugcagugagccgagaucacgccacugcacuccagccugggcaacagagugagacucugccucaaaaaaaaaaaaaaaaaagguuuuuaagcuucaaaugucaucgaugucauuguacaaagauaucuuugucagaaacagaaaaaagaaaauaugagagaacaaauuacuaggaaaaaaucaaaaugacaaaugcaaccacuaaauaguauaaagugagauucuuuccauggcaaauaaacuaccuguuuugugacauuuaauaaguccaauacacauuaggcuuauuaauauuaauaucuaaauaaugauaugccuaagugcaaaauguaaaugucagauauuggucaacuauuuauguaaagauuaacagaauauauaccaauguuuuauacagaguauguuccugucuccaccccuacaccccaacaaacaaaauuuccuuuguucuacuuaacuuauaugaauuaaauuaaaagauuuuucacaugcugugagaaucaggaggugguacugaccuuuucccccuuuccuguucagugcaagauccagaacccaagcuauacauugugccuucccagagcaauuuuaaauugacaauuuagaggguaggagaggcaauauuaacauaacacuaugccucaauuuuccaacuagaaaacaaauuguaacauuugccccagccuauaucucaagguuauaaaugggacuauauaauacaaauuauauauuaauuauacuauauaauuauauauaauauuaacguauaauaaucuacuauuauguacagaacucacaaugccuuuuuuaaaucuuaaauaaaacaagugauuugugugguguaucugcagauaaauggaggcaggaaauguuuugugaaugcuaaaguugcuguaucuuagggaggaaauucuaccuucauuuuuuaaaaaaaauuacacccacugagcacaguggcucaugccuauaaucccagcacuuuggaaggccgaggacgguggauugccugaggucaggaguucaagaccagccuaaccaaaauggugaaacccugccucuacuaaaaauacaaaaauuagccggguguuuggcgggcaccaguaaucccagcuacugaggaggccgaggcaggggaauuacuugaacucagaggcggagcuugcaguaaggcgagaucgcgccacugcacuccagccugagagacagagugagacuaagucucaaaaaaaaaaaaaauuacacccuugauguguaaccauucaaauguggcauaguacauucuuagugaaaugacauucuucaaaaugacacaccggugguuugggagguuuuuaugugucuccuuuucuauuuuuuguaaagagcacuccuaacugcaaagcaguuugagcuguggaaagaggaacaaggucaaaguccuugauaugauagucuacaucuauuauuuuauuaaaaugacagcucaguaggcaucagacuacuuuccaggcaucugaaugaggcaaagguggaaaauggaaagggaaggguuuaacugagagauacaaggcacucugaaauccuucaagaaaaaggagcugagauguggcaguuaugacagucaugugcuauggacugcucagagccuucuuucugaggcagauucuaucagccgcuaauguuaagggcaaaucuuacuccuaagggccaugugcuaaugugggcaccguuuuucuuacugcuacacauucccaacuguuugccacagucaaaagaaccaaaaaucccaauagcagagcuaucacaugcuuuuccccuuccucucccaaaaaaugucacuucaaaggucccuaaagagcccuugauuugcaauaaccugccaucaaaguaaaauggcaaaaguccacaacccugacauauacucccguacuagggaggaaauggugguacugaccuuuucccccuuuccuguccaguccaagauccagaacccaaguuauccguugugcucuugccagagcaauuuuaaauugccaauuuacugaaggugaacuaaacaacugucauuugccuccuuugaacccaauuagggugguggucgucuguccuagaucaugggccccuccaaauuccugaugcuuaguaaguugauguuucauuaaaaugacaggcaggccccaauuauucugaguacuguaugauaggcagacuuccagcgaaaacacucuagucccuguacuagguauggaucgggaagugcucuucuccaaagcaucccauauuuuacaauuuuagaaagacaaaaauauguguaucauggucaucaguauuaccauauaagcauauugugcagaaaacgguacugcaucuaaaagauaggcaaagaaccuuucuauauugcagacccuggaaggcugaguuugggcgggaagaaaaagcuaagguguuuggagcuggcuuacuuuucuccucgagguucuuccuuucgucaccacuuucagagcagcacuagaagaagaacagaugugacaagcacauuaagauuaaagucguggauggaaagcauacggggcucccaaagggcacccacuggaggcaagagagguuccagacgcucucccacuuucugagcgaccagggccguccgaaucagguaccucaaagugccacuguccuggugccaccgccaccuucccaggaggugugugucaccuccgcaggaccuggaguuaccuugccugcucacuagagccaccucccuagagaaaucugucaucucaccagggccgccaaagccacuucacggggacuaccgccuccucuaggaggucuuacaagggccucuaaucuaagccgcaggaagcaccuucacaagcuuacagggccaccgcaccgggacuaucucccccgggaggucugugccaccucaaugggccaccaauguccccucccagggacgccagggccgucucaccggggcugcaggagaggcgccgaucucgccggcugguagcaucucgccuccgcgcgaguccucggcuccauucgcagccagcguggccuguggagucuggcuaaggccagcgacacacucacuacccagccucggaggccguaggacugagugccacagcgacuuccucucgaugucucacugguuucuuccucucagcccagagaggcccugcccgugcagccgccggccgugcucuguuccucccccuccugaccggaggucggaacggcc

SEQ ID NO: 191452 - RNA, 72893 nt, Homo sapiens
gggucccuggucgugccugucagagaggcuggcggcagugguggcucucccggcuggguugucagucagugagaggagggggaagauggcucaccgggacccguucugcuaggaagaaggggagcagguggugcugcuacucgggaggaagcagagcagccuccgucgcugucgcugagagccucacgagucgagguccugcagguggagcuccggcagccgcccuggugaguccagccgagagacccacgccgggcccccagggcguccggcaacggauaacuuuuuuuugucagggaggagccggggcgaggcggcggcgaggacaggaccgggacuuugucccuggggccgcggcuccacuggggguaacggcucccgcgcgaggcgccaugggugggugcgaggcggcgcggggcgcugggggcggcuggcgggcgggugggcugcggccggcgcugcucgccccgaaguugggcgcagccugcccgcugccuggagggcggcagcuuugugcgcgcgacucgggucuuuccuucccggcgaggagcaguccagccuccugcugugacccgggugccgccgccucggccccaccggccgccccucugccgggugggccuggggcgggagccccccguccccucccugccgcggcggaugcucuggccucugccuccucucccacucgcgcccucuacuucggcgaggccgccacuguccguccggucugguggccacaauggucacugucgaccccccgcccucgcccccuggagagcagcguuggcccgagucggucuuugguccccugcagggcggagagguucagacagcagccacgcuuccuuccuugguuauuucgcugaagaucucuucuugagcccuugccccuucuuucuaugaguuauuccucuccugaggcucauuuuaacauacucgggaauccucggggguuuggcugaaaaugguugcauuaaaacacccccaaguuuguacgcuuccccgaaauuugcugucugcccgucagcuugcacaugugugcuuugugaguuuagacauuccugaaagauuuuaauuuugccuaagugguuuaguacugcacagaaucugcucucugagaaauacacuaucacaagccuggcagccgcggcgcucuucagguagggggaauuuguuccaccggcagcuacuucuuaucucagagacugcccuacaggcaguagggccaagcugaccuuuugcaaauuauuuauccuuggaucacacaguaguuuuuggagcaggugggccaccucuuugguucauguaacacuuuacaguuugagguuuucagcuuucaaaucuuauugccauaaagucagaaagacugggaggcuuguuuuccaugaaaacauucuacugcuaacauccacaggcaccccaccucccccgacauuuccaaguauuuuuuuuucuuuaggugaauacauuuuaagguuuacaggaugaauaguagucuaaaccaccauauuuuugaagugcaggcaaagacaaggaaggaaaaacauuuaagaucugcuuggccaauaguggcuucaaagucagcuauucaaauaaucaguucaaucaaaccaaguggcaagggggaaaagcaucacauauuuaggaaacaaauucuggauuuggcucguuuauccuuauucgauuuauugaaauuaccaugagggauuagaaggauuagaaaccuucuuagucaucggcauuagcaguaccuggauacagacacccgauaaggcauuagcugggucagcguuuauccuugcucugcuuccuuucauuguuguauuucuguuuuaugaaauuugcucuggguuguauuuuuuagacuggugucuuugacggugaguuuaaauauauguacuguuuuauucagcauccuguugccuaauauuuauuuuauaauggaucuuaagaaauuuuaagaaaucuuaguauucaagaccuauuuugggguaucguuuauauuuuauaaaugauugaaauuauaucaaacauaaauuuauuuuuucacucuuccaggcugaguagguacuagggauacagaaaugaaugucauagcucuugucuucaaggaauuuacuaucuaacauacaagauguuaguaacauuacaguaaauuaacaauuauaauacuauguagucagugggaauagagauaugccuaguguaguaggagaguuuagaguaggagauaguuaacuugccuugaguguagguggaguugggagcacacagccaaguugugaaggaugauaugauuuugccaagugcaggagguaaguaacuucccaagaggaggauauaguaauugagaaggcaaggaggccugagaaacuguggcaauuuagauaagucauugacaaugacgagucagugucaauugacauuggcaguugacaaagucaauaacauugacauugauauggcuugaaugcagggguuaguaggaaauggugccagaugaagauagugagggugguagagggccagaucagggaaugguauccuuagcuaaagggauuggauugaacgugauagaugagaagccauuuauuggauuuguauuuuagaccuuuacuguggcagagugagggaaaaacuaacaaguccuaaucaccuaugagaagaaaggaggacucaggacugugaagguuugacuugggguucuguugauggaaaugaggaacacaaaaauggaaggaagaugauaaauucuguuuuggcuauuuugaauuugaggaagcaguggaacuucaggcgaagauauagauagauguuuguaucuguggaugugaaaaucaggauuagagagaugauuggggguugaauugaagcuauauugauuuaguugugaugaaaugacucagggaaagccuuuagccuggugaaaguggcagccagagaacagacucucauaaauagcagaaguaggaagaagaauugucugaaaguuagaggaauaguagcuagcaagguaggaggaccaucaggaaagaugccaagggcggggagauuuuccaguggaggaggaacagguuaacaauuuugaaugcuguaaggaggugucaaguuaggagagggccccagugaccacugaauuugucaggaguccauagguaacuuuaacaagaacaguuuuaacugaguggugguucagaaaccaggcuucagaagauugagaaagaaugggugugauaaaguagacaugcuuaagugagacuuuucaagagaacugaaauaaagaagggagaaaaugauagcuauagcuuucauugaguagugguucucaaucuuggcugugcauuuacaauaauguaauaauaauuuacaauaaucucaggaacuuuaaagaauuuuguuuuccagagggaaucccuauaccaauuugguguggggggguguugaacccagauaucaauauuuauuucaacagcuuuucuauugaaguguaauugacauauaguauacuacauauauuuaaaguguacaauuugauauuugacauauguuuauaccugcaaaaccaucaccauaaucaaaauaauauucaccuccaaaaguuuccugugugccuuuauaaucuuuuccucuuauccccaggaaaccacugucuacuuugugucauuauugauuacuugcauugauacuuuuuuauaguuucuuaaguaauuccagugugcagccaugguugaaaaccauugcagagugauauuguuugagggaauguuauguuuguuuguuuacaugcauaaggaaagagugaguagagacaaguaggaagagauucuuaagcaauucaggaaaugagauaauuauuggaacuaagacccugaggagauagaagugaauggaauucagagcuuuggcuaguaagaaaggaagacauuccuggaagcaacaucucuaagaauauaauguuaaagacaguauauuucuuuguuaucaucaucaaaguuggcauauaguauccaaauugguucccugaaguacuucugaaguacuuuaaaaaauuagagagcaucuuaauauugugaaaauggauaccccucagaacaauuccuuaaauggagccugagaucccuggcaucaucauguaaugcuuugucauuuuuuggaggggagcagauggaauuagcaguuugacuauugcuuauuguugagagccaaguccugccagagucuuuuugcccuucucagaguuaggcugcauaucugcacuaaggaaaaagaacauuuaacacuugaaaaucuccuauuuaaaguaucuuugcucagaagaaaucuuguuugcuugcccuuuggauauaugccuuuuaaauacacuggaggauaaaaucauuccucugucuccuaaaugagacagagaagaguugugacuagaaguucucaaaggcucacauuuucuaucuugagaaaaguaauaccuauccucaccucaccaccuuuuuuuuucuuuuuaaaauuucuggcucaggauuuggauauaggaaaaaucugaguccugcugguucugaaguccagggcuuguuccucagccuugacucuuggcuuucauagggggcugaaaacagaauagcuuauccaaauauuauuuggcauuguaacuuggucauaaauagagaggaagugaaaaguuuugucugauugucuucuagaguucugaaaauuucuuucauugugauaaagaauuaaaguaugauucuuuucuagagaggaaggcaucccuaauuuuggugcagccuaaaagaguggaaauaucaauguuagcaugauauugguuauuauuauugucacagccuuauuguaaacauucuauaguuucuuaauuacuaauauaauaaucauuguaggaaauuugaaaaauucaggaaagcauaaaugguaaauaacacuuauaaugucuccacccagagauacuuauuuccuuuaugaaauaucuauuaguguccuuugucuauuauaauacuggagauuuuuaaaaacuaaguuacgagagcucuuuauguauacaaacuauuaggcuuuugucaaauuacauugcaaauaauuucccuaguuugucauuuuuaucuuaauuuuguuuuugaugugaauuuucuuuuuaaacagauugcuaacauuuuaauguguuuaaaccuaucaaauuuuucuuuuaugauaccucacuacuuagaaagggcuugcauuuccaaauuaugugacuauucaccucuguuuccuuauauuaauuucacaguuuuuaaaaaaauuuacaucuuuagucuauuugcaguguauuuuaauguagagugaugguucaguuauuuuaaugcuguuuauugaacaguuaucgucuucagagguuuuaaauaccaaaucauguguguauacucugucugucuauagauauggauauaugacuuuuucuagguuuuucuauuuaguuuaauugggcuauuucuuuuugcucuaguaauuccaaacugucuuaauuauugugaguuuuuaauguauuucacuaaaugguuuugugaauacuuauuauugucuuugucaaaacauuuucaguauuucucauguauuucuuuauucauguuacauuaaaggcaguuaggauccuaaaagaaccucacuggaauaucugaguuaauuuucuagagaaaguuguacuaucucuauuaauacaauguuaucauuuauugaagucaucuuuuaugacucaaagauguaguuuugaguuuucuucauguauuuuauaguuuguaguuuucuucauguggguucugcccauuuuucaagugguauauuugauauuuuaaaacuuauugauucuauugggaauggaacucuuaaaauuauuuuauaaagaggauuaaguguaccugauggaacauagaaagauggcuaauucucguauacuguuuucuaacuggucauuuuaugaaacucuuaauucugauaguuuuuauuguguuuuguaguaacuaaauuauagcauguguaaagcgcgugaaugauuuugucuucuugcuaacacuuaauccuuauuucuuuuucuuaggacauugaucagaacuucuagaauaauauuaaguuauagcagugaacagugaggauccuuggcuuauuucucauuuaaauggaaaugccuuuaggguuucacaguuguguguucaaaauuuuuauuuaugguauguuaaggaaauagucuucuaugccuuuucagggggaaccaagauagauauucaguuugaucacaugcccucuuaauguaccuugagaugaucauaugguuuuccuucuuuuaccuauugguugaugaauuguguuagauuuccaaguagcuuucaucaaacaguugcuguuuuagggauaaaggcaacuugauaauagcauaucucuuuaaaauagugcuauauuugauuugcuauaugagauugaucuuuaguauuccuuuuguauuaccuuuuuaagguuuugauuucugaauaugccagcuuuguaaaaagagagacugagagagaagcuuuccauguuuccauuuuugcaugugcucuggcaauuaaucucuuccuuggaagauuugaaauagauuggcucuaaaaaugucuaggucuuuuuggacugaauacaauuauaaagaucuuaauaugugcuuguguacuaaguauuuugcauaauuaauuucauuuagucccuauauaacuuugugaggugaagauuauuauuucuauucuacagauaaacugagacucagagguuaagacagucguccaccaucaauaaaguacacaaaguuuaaacucaauuucuaucugauguaauagcccauguuuucuaaucaguaccguaauguuuuucuuaauuaggacucuuucuucaccccauauuacugagaaguaaauuuaaucauuuuauuugagcaucuuauuaaguauuuuuccucuuugcacacuuaguuuuaauuuuugguaacccuguuauauuaucacuguucuguucuguguugaugugucaucuuuugcuauuuuaauaaauacugugaucuuggagugaggugggauagggugggggaacuuaaaauuguuguucauauaaugcacuuaauauaauuuacauuuuaauucguugaguguucaagaucaauuugcauuccugaaucuuguuuguaccuuguaagaauguuauguuaaguguaccacauacaagagaucaaagaguuuuggaaacacaguacuuuuccauuuuaguuugaauuauuuuuguugugagccuugcaucaggguagcuuuuuaguaguaauguuaagugauauauguuuggugugcguuuucuugaacaaagagucuuuucauaguugacaaacauuaguugcuuucucauauaaauacauagaauucagucauuuguacuugacuuaaugaaaacauaauauaugaguuauuaaacuguaccaugaagauuagguuuuagcuacuggaauauuuauauuuacuauuauguugagugauguauaggcuuggaaauuuaagagaauaauguaagccuuaaaagugcuuaaauuggccgggugcgguggcucaugccuguaaucccagcacuuugggaggccgagguggguggaucacgaggucaagagaucgagaccauccuggcuaacauggugaaaccccaucucuacuaaaaauacaaaauaauuagccaggugugguggcaggcgccuguagucgcagcuacuugggaggcugaggcgggagaauggcaugaaccugggaggcagagcuugcagugagccaagauugugccacugcacuccagccugggccacagagcgagacuccaucucaaagaaaaaaaaaagugcuuaaauugggaaagcagucauaaacucuauauuuaucuuuuugaacucuucuguucccucccuuuaaauauaaauuaacauuuaauuaauucaguuaggguuuugguuauaaucagcacacccagacugcacuccccauucccuuccuauggggacaaucugacccucuuaaaccugccagacacaugcaugcucuuuuguucuaaauuucaagguuccugcugauuuguuaaucaguauaugucacaguaguggacaaggugacaaauagcccccgcagcaguguacacauuaguaguuaagaaaagggagagacuguuuuggaaaaucaugaaacuucaagugaguccugauagggaaauggagaggaaggugaaaauauuauagaaauggaugggggaagaagggaagauaaaaauguguaaaucaaauagauuguuggagaaauauagaaaauuggaagaaugguuacaugggugguagaaccagaauauucaagucagugaggucaagaaguagaguuucagaaaggaagacucuugcuucagguuacagaagaacaaccaccauagagaaagagcugauagaguugucauuuauaaggucauggagaguagaugaugagacccaaauuuauacuguaaaagggguuaaggaauaaauugauggugagcagcuggaagugcugguaguagauuaagcuacuaaaucagaaaguuaaucagugaagaguaaauaaggauggaguaacuagggcauuagaaucugaugaagccuuacuccugugcccccucuuuucagaacuauaagaucauaaaauacauucucaauuguccaaaugauuaauauuuuguuagugauacuuagagguaucauucauugaguaccuuuuguuugccagugcuuuauuugcauuauuuuuaauccuuaaaacaucccuaaaagacagauguuauuaucuaucauucacaguugaggaaacugggacuuagaaaguuuaaguaacuuguugaaaauuggcccggguuuuuuggacuccagagucagcauucuuuucauuaugccauguugcuuccuuuauuuauugagcuauauuaaaacacugggggcuuauaagaggaauauaggugggauuccucugcuuguagaaaguaguagaagaggccgggcgccguggcuuucaccuuuaaucccagcacuuugggaggccaaggcgggcggaucgcgaggucaggagaucgagaccauccugacuaacacggugaaacccugucucuacuaaaaauacaaaaaauuagccgggcaugguggcacgugcuuguagucccagcuacucaggaggcugaggcaggagaaucgcuugaacccgggaggcacugguugcagugagccaagauugcaccauugcacuccagccugagcgacacagugagacucccucucaaaaacaaaacgaaacaaaaaaagcaguagaagagaaauccuaauuaugcuugcuguaauuuguguugacuauauuuuuauuuaaaauguuuuuauaaagggaauccuucuaguaagcuucccuacuauacuuauaauaucuaauuuuuaacaauugcuguuauuuggagaugagauuuuuuuuuuacccaugauaaugauggguugagaggaaaggaaggacaggccaagaaaaagcauguaaagaaaaauaagacuaaaacuuuuuguuuucacuaugagaacaucaaauaugucauacaauuuuagguugcaccucagaaaggccagccucuucauggaaaucauauugagcuagucacaagaugguaauuaaagcagaugcucuccaugucaccagauuauagagcuccaaagaauuuauuguaauacagugugauuuacugaauuuagguuucaucaaucaggaauuaguuauuggugaaagggucuaagcagauguuugguuuuucuauaauaaacccuuucuucaaaaacaauguguaauugaaaaagaaaugcuuaaaauacuuuagggauuaaacaaucuuauaggacuuucaauuacuuugggaggaaccaagauagaaauuuuugcucugcuaauuuuagccucacauucagcuacaaaacaacgucuagguuacauucugcuauacuaguauaagacaguauuauugaaaacuuuaucuuaaaaauaauuuuauauuucagccucugcuaaaacaaauugacucuuagcccaguuaauaugaaucagcauggucauacugaacuauuuauuucugcuuugguuacuauaauguuuuuaaaccaagaaaaacaacuauauucauaauauccacauaguuucugauuggggagaaucaaauagaauuuuguacagucaagaucuguuguuuuuauuauuauggcccuauuagcacacauuaccaccauuaacuguguuuacuuacauuuucucauugcacuucccucuuugcccuacuauuuucuguugaacaucugagccucuauuggcagaccucauuaaaggcugaaagucucauuccaacauauuaaagggcagcgacucccucuaagacauuaacucccaacuuaguuggaauuugauucucuuaacauuucugucuuucuuuguccccaacauuguaaaaaggaaagcacuuagaaugcaaagaacuuuaaggaaucaaaguagagcugugcuuuggaaaccauauuuccauaugcuguuauguuugggagagaggaaagagggguuauugauagcaaaaugauugaaagauaauguuuacauugggcuuucuuuuacauuccuccucauuuuuucucauagcauuuauuuauuuuauuuuauuguuuauauucugauuuaccuugauuuguuuuaaaaggacuuaaggcacacucauuucugcuguuuuagguuuauuugucucuccuaauagacugugaauccccuaagucagcuaugucguauucauuuuuguaaaucuaguaucuaggacauaguuggcauuuaauaguuuaugaauaaauggaugauauuuaaccaccuuaauauaagaaaaaaaaagagccaggcugguugcugaacccuagcuuacugcagcuuuagugguauuaugggcugcauugugucccauccaaaauucauaaguugaaggccuaacccccaguaccucagaauguagcaucauuuggaaauagggucuuuagagaggcaguuaaguuaaaaugagguaauuaggauggguccuaauucaguaugauugguguccuuguaagaacaggaaauuuggauaggcuguauagaaggaggacaaugugaagacauagggagaagaccgccaucuauaagccauagggagugaccugaaacuauucucucagagcucuaaaaaggaaccaacccuccugaaucuugaucuuagacuccuagccuagagaacugugagaaaauaaauuucuguuguuuaagccacccagucugugguacuuuguuacggcagcccuagcaaacaaauauagguggcuuuuauacuuggauguagcaaaaucucaaauacccuuaauuugccuguucccaagaaauaguuugccaaggcuaaugucaaagccucaaaaauuuauauacuuccccuagguaaaacauggaagagaaaaauuuggauagcuuaaugaagaaaguaauaacuauuugccuccuccuucaccuuucccaauacagccaauggcaagcaacuggcuaauuccuuaauuuaauugaauuuguuuaguuuggcaaggagaaaguguuuacaggguauuuguguuccuagguguucaagagccucucccugguugcuucuucaugguagaaaauggaaggggaagacuaaauaaaauacuuuuuaauaugauguugauuugagcuaauugcuuguguauaaucuuagucacauuauuuuacuuguguuauagucaacaggggcaaaacaguauaucuuuuacaugcccauugcugugguaguugcuguacccuuugaucaucaacuagucauacugaguugccacagugguuuuucagcauuuuucauuacaugcuguagccgcaaacuauauguauauauauauauauauauauauauauauauauauauauacaauuuuuaccauuauuucuucuugacaauuuuaauugaguuguauaucaaguagugcuguguucagucaauuuuuauagugcuuugagaugcuuugugaagagaaaauuucaaacauauacaaaagcaaaacauuugcucuuucaucguuuggaggcaguuuucccagaguucugaaaguaggguaaacuaaauuagagaacugaacaaaggucucagccccagaauuaaaaaaaaaaaauguuugccauaaagcaaaggaaaccaaaaccaaacagaaaaccucugacuuaggggcaaauaagaauuuuggucuaauuuuggcauuucaacuucagucacacccauguuuuuggaucacucuuguuaccaguauguaggcacugugguaaauaccaguugauagauuuuucucaucuuuuuucuuuuccuucauuccaacugagaaaaauacugcaaccacaugcuagcaaguggcagagcugggucuaaguaaauugaauacuuuuucuccaguacccuaccauguucuuuuacuacccuauaguucucaaccuggcugccaaacacaaucaucugaauaauuuacuuuucccuagcaauuuauuuuaaaaugaaaauauccuacuuuucaauuuagaaugaaaauauuaggaagaagaaaagaguaaaccagaguaaauuauuuaugagacaagggaaagguuuugaacuguuuuaggugccauggguagggauugcugauagcauggugauuagaauggggucuuuggaauugggcugcauggguucuaacccuaacuuaaccacuuugguagugugugaucuugggcaaguuacuucuuuaaguguuagcuuucuuuuuugugaaauagagguuauguuaauuuaccagcuaggauggcuaugagaauucaauuaaaauuccaauaaaucgcuuagcauagugccagaaacauaagugcuugaggaauguuagucauuaucacaacauuaucuauggacaucuaccauugcuauguaugacacauuuggucacauugaguguuuuccagaccauauucccaaugaugccaguuguguauggacagcaaaggaucccauggucaaauacauuuaggaaaauauuucauuccaaaugcuuuucuuagagauuaauaauacagauuuagcauauuaaaggcucugaaaaguccuuugauaaaaaaaaaaaaaacuucuuuaacuuugucaaguaguuaguuaaauuuucacaaggaaagccuuuuuuuucugcuguccuccgaggucugucuucauguggcuucuuaugcagaugucuaucccucagcucuuguagcauggugguugccuucuaagagggauuauucaagaggacaggcccuagguggaagcucuuauuaagucucuccuugcagcaccuugcuaaauuccacuggcaaaaacaugucacuuugccaauuccagcauugauguggaggaggacuauacaaaggacuaaauaacaggagagaucguuuguugaaggucguaaauauaauaguaauaguguaccacauauuuuuaaaaaauguccaugauauauuaggugaaaaauaaucaaguuuugguagaaugugauuguauuuuuauguuaaaaucaaaauauaaauggacuauguauacauguauguguauauguguauauauacauauguacauguuuugauagagcagauauauuuuguuugguugagcagauaucuauauagauauagauagguaccuaucuauauaaauauauuauuugguugauaucuuuuucuugguugaggagauauauuuuguuuugguuuagauauacugcucaauauuuuuaagaguagagaguuuucagaacugcugauuauauagcauauguguagaaaaaaguuugaaauaauauaaaguuaacaguauuuucuuuugaagagugggauagcagcagugagaaggaugauuauuuauuuuaauuauguggaaaagauuuaaguguggccauuuaaaaaaaucucccguaaagaaaaauauuagcagggaugggagaucgguuuucucccuagguguugauaguuuuuguguauguuuuauuuucuuucuugguggaauuuuuauaaucuuuuauaguugcauagugagcagaacccuuguuuuaaacuuuucauuguugauuuuguguauuucugauaauuuucucaugauggcccuugcaauuauucgucuagaaaauguaaggugcuaccuugacuuauuuuccucucgucuauucccugcuuuuccuuugccaucuggauuacaauugccuugaggacacagaucauauuuuacuauucuuuugcuaauggugcaaacuaauagaaacacuuugcauuauacucagcaggcaaucaagggcuugcugaauuauuaauguugcaauuugaacauauacuaguauugacuuuuugcauauacgaccucccauucuauguuuguuuuugcuacuucuguuucuuugcucuuacucugacucugcccagccuacugucuggauaaauuauaugaacgggcugucgacuugacauccuguucagugaauauguagaaagcauuucuaaucaccauguuauuuaauaugcaauugugugauaaucauguuaaugaaugugauugagguaauuauuauaguucagcacuuuuacacugaucucuuaaaaucuguuaacauaaacuuuaucauuuguauguuaguuaucagggcuuacugaaguuugauucacugagguaauacuugaaucacuuaguaugugcuguaauuauauuuuguaaaagguggugcaaacauuuuggaaagcuuuauuucagcaauaacugcucuuguagauuuuuacccaauauuaaauguaaaauaauuuguuugugauauuuuuauauuuagugaaauacauaacauauuaauggacuuuuaagauuucuuauaacauucuaauaagagguuuucuaagucaagauuaucugcaucaaucagucuuuaaaauaaucagaugaugcuguuuugguucacagaugcagugccaguucucuccuggcagcuuaccuugccaaugcaugcauuucauuaauaagagccccaaguuuuuccuagguaggguguaaaagcugaggagugaaaggaagguagagaagagaagcauaggcaaagacauggagccuggaguggcauggauuauuuuggagaauaguguuaaguaaaauuuggauagguaaauuaugaccauauuuuagggaaaguuugauguagaagauuugugaggucugaugucaugguguguucaggagaaaagaaguuucagcaagauuauauggcagcaacaugcauggugcacuggaaaagggaagaaaucaggagccagaaggcugugugaucagcagaugcagaggaaauaagggcccagacucagggcguugcuguggagauggagagcagaugguaaauuugacgggcauuauaaagggugaaauuuauucuucuauucaauaaauauuuauuagauacuugcuguauguuacuuaugcuuauaguaucuggacugaaauuugccuguaguuacuaauacaguuuaaaacuuaaaaauuauguuauauaauuuuuauuugaaaaaaauuuuaaaaaauguugaaccacugagucaugugcuauguuaaugucaauaagaagugcucaucguagugccauaguucccagagaucucaccauucugucugcucuuaucuaaaagaaaucuaaauuguuaauaaauuguacaugaucuuagucaaggcuauuugaaugcuggcucaaaaaagagggagaauauuugcaauagaaauccaagagcaguaacuguuggccucagaaguuucauagcauucuguuugcugcauucuuuuggucaacaugguuauuaaaaaauaguucuuccuaacuucucuuauuagaguccaaaucagauauccuuucccuggaaaaaauguucuucugaaguccuggaggaucuugucuaugaccauaccaccuugaacgugccugaucuugucugaagucauggaggaucugagaagaacaggaagauagaaaugggaaaugagaagaaagaacuucuuaccuucuaauuguucuagcuuuuccaacagaaacacacugggcugguugccacagcacacugauaucccaacaugaucuuauuuguccuugggguaggcaaaagaugguuuagccaaaaaccauuuuauagaguaaaaaccuauguucuauucuugauaaucagacacuuguuuugugauuuuuggggaaaauaggccuaaguaauaggccuuuggaaagacuucccaaaccucucuuacuaugaauuauauuacuucuccuggugccuugagaggcagcuuuauuuacuugaugaccuagguaggcagugaggcaucaacacuucuuuuuaagcaacagcacauauacuguccuccuucacaauugauuggucaguuucuaagcagcaaaauccuaaaauuaaauuaauuuuauucuguaacauaaucugaacauuucucuccauucuguuuuccugaaauucacccaggaauucuugauaaucuucugguagcgcuuaauuuaacuacagcaauggccucauugcauaggagagaaguuuaaaauuucgugaugugucacaauccauuuauagaaauuugguugcucuauaaauuuauagaaacuuaagcuucauaaugauauauaaaacaaaugguuauaaaaaguuuuauaguaguuugucguuagugcuuaauggugaaggggaugauguaaaagauaggaauaaggaaauuuuuagaguuuuacagugaaaguuacaaauacuuuuaaaauauucuuauaaaauaauuaaaauguuauaugucucugaugacaacacuaaaagauaaauuuugguaauuguuauuaauaacauaaugugggaauugaagaauaagacauuugacuuagaaagguuuuauuguacauugaaaauauaaaaaauuaauguuauacagacuuauugggcuagugaaauacuacauagacuccuagcaagccuucuaauguaauuuuaaauauucugcuccggaacauguuuggcaaaaauaggaaguuaguuacacagcaggaaacauguauuuuaauugucucuuuuaucuuugagaagaauaaaguuuuuacaaaugcaaguauauuuugaauauuacuagagaugucuaauuagauuuauaaagcuugcagaguuauauagucaagucuuuggcauagauguuaauagguuacauauuauauaugaaauguggggguggguuagcaacuuguagagagccucuugcugcuugcugguagagagaaacaguuuuuaaaucauuuuguggccaguuugcuuuuuguccuaucuaagcuuuacugauaccuuuagucagaacuguuacucaucuugaagcccagggcuaauggaaagaauuuuuuuuuuuuuuuuuuuuuuuuuuuaacaauuguacuguacgugguaaggacaaagaaaagcuuaugucagcuaguaaacacuguuggcuuuuuaauuuuuuauuucuuuaaauacuuauccuacaauaguacuccaaaccucaccaucacacaguauacccauguaacaaaccugcacauguaccuccugaaucuaaaauaaaaguugaaauaaaaaaauuauccuauacuuuauagaauuccauuauucucuuuccuacauaaugcauugauauuucaggauucauuuuuaauguuuguauauuuuugcuucuuuuuuuuuuuuuuuugagacggagucucacuuugucauccaggcuggagugcaguggucugauccuggcucacugaaaccucugccucccggguucaagugauucuucuaucucagccucccaaguaccugggaucaccugcacaugccaccaugccuggcuaauuuuuguauuuuuaguacagagggguuucacuguguuggccagucuuucucaaacuccuaaccucaagugauccuccugccucagccucccaaagugcugggauuacaggcgugagccaccgcacccagccauacuuucucuucuaaagauauucuuacuuuuauaguuaaaaggaacuuaccaggggccaggcacgguggcucaugucuguaaucauuuugaaugguacuugauauucacaugacgucguguugauguuagcuuagaucaaggcagugcuugcccgguuucaccacuauacaguuacucuuuuccucuuuccguacucucuuuuuuugcaagugaauagcuauguccagugcacucucaaugggggagcaaggacuaagcucuaccuccuggaagagauagugucuacaucuguuacugggaauucuuccguaaggaaacuuuaucuccuauucucuuauuuauuuaaucauuuauuuauaugaguauggccucauguauguuuauuuuauacuuuggguuauaaugcaguacuacauuacuuguucuguugcuuggauuguuccagcuuuggccauuggguguucuuucagguuggcuuaauauuuaagaguauaaagagucccuaacccaaauguuugaaaacagguggucuaggcuaugaucauagacuuugaucguaggauugaguagcugaggcagauaggaagaaaauauuguaggaggagaauucuaggaauuaagacuucuaggaauuuagacuucagguaagaaaaaaaaucaccaagauuuaagcaggaguuguuugaaagcaugacagugagcuaggagcuaagaucauccagaaaugaaggggagggaccgagcagggcaagggcgugggguggauugauugauagaugauggugauagaguuucaaagcagcuuuggguggaugguugaaggaggaagagaaugaucuugagugguaauaagaagaaaggagaacaccuacuuuaccucuaagcccagugguuuguuucagggaugugugaggaaaugcaaucacuauuugguaagcuugcaugcagggaaacuagugucucaugaaaagaagaaagcaacauuugaagaacuguugaagauguagaggauuuugcugguaauagacuguaaauuccagaggacccauggaaguauaucguccuuccagaauuaggaugggaugggagaugggagcaaaacagaagauguacaaagaguuaugaugacuagugugugagaugagugucaucuaggugucuguagcuucuuguggugcuggacauaaacagagaugaagggaauaaagacuuuaguccugguggaccuaaagcagacagugguggugagacugugaaaguuucaggauagggaggcaugucauagacucccuuuugaguucugcaggagacagagaaguuuggggaggaacaauuuuauucugagcuugcaugcgugcuaaacaagugaguguccaugugagcucagcuauacaaugagggcucccauuugaucucuaucaaguggaagauaagagacccagggcugacugguguuacuaauguauaauauacauacagaaaaauguacaguuuaugaaauguuuagcuuggcaaauuuucaccaaauguauacacuugaguaaccagcaccuagaucaagaaacagacuguuaucagaaccgacaagauaggccccucaagagcagccacuaucccaacuucuaacacaaauggauucguuuuaucuguucuugaaauuuacauaaauguaauuauauaguauguacucuguuuuccugcauucuuuuauccaacacuguaacacagauauaguuuauucauuaaaaguuauauuuuguuguauagaauuucagauauuguacaguauacuguaauuuauucguucaacuacugauggacauuugguuuguuucuaguuuuugacuauuaaaaaauaccugcuguagccaagcaugugguacacuccuguagucucagcuacuugagaggcugaggugggaggaccccuugagcccaggaauuugaggcuacagugagcugugguagcgccauuacacucuagcccggguaacagagugagacucugucucuaaaaacaaaacaaaaacaaaagccuauugcucagaugaacauuuucugaacauagcuuucagagaacauauguccucauuucuguugaguauuaacauggguagaauuucuggguucguagaguauauguauauauccucaaguuuagaggauauugcuaaagaguuuuccaagauauuguaccaauuugcauucacauuagcugugucugaauauugauugcuccauaucuuuuucaacacuuggugugaucuuucauuuuagcuacacaugcguacguguguguguguauguguguguguguguguguguuuguaugguguauuucacuguggguuuuaacugacauuucccugaugacuaacaaaguugagcacguuucaugugcuaaguuuccauuugaguaagugauggucuugauuuccuauaggauugucuaccuuuuuucuuaauaauuuaugaguuccuuauauauucuggauaugagacuuuugccauguauaugaauugcagauaucaucugccacccuauggcuuugccuuuucauucuccuagugguaucuuuuggugaguagaaauucuuacuuucaaggaaguccaguuuauccuuuuccccuccuugugauuagugcuuuugugccucuuguuuaagaaaccuuugccuagccuaagauuaugaaaguacucucuugcauuuucuucuaaaagccuuaugguuuacuguucacaauuagaucugugguccaacugaaacuguuuuuauuuuugcauacagcaugaucucuagggucaugguucuuuuuguccuccccauguagcuauccaaauaaccuagccccauuuauuauaaagagcauccuuuccucacugaauuucagugucauuuuugucauaaaucaggugaccauauaugugugggucuguuucuggccacucuauucuguuccauugguuguuuucuauucuucugacagugccaccacuggcuuaauuacuauaguuuuugguaaguuuuauacuaagcuuugcuguuggaaguccaggucccacaguucuguuguucuucaagacagcccuugacuguucuugguuccuuguauauuccucuugauuucuuuuaauuuuugaaaaauuaaccuuaauuuuaacuggagaguuauuuugaauuuuuguaaaaauuuuaccuccccauuucuauguaacuugauguagugugguuccauuugugauaacuuucuguccuaauuuauuaaacaauggaauucauacaaaagaaaacuuuugugcauuuauauuggcuuugcuuuacaaauauacauaacaacauaaaaaaaguagauacaggcagacagaaaauaacaguaagacaaagagaauugguuaugaaacucacaguauucauaauauaaaaacaaacaaguuacuccaaaggagagauuuuccuaguacugaaaacuuaagaugugaauuuucuagacucuguuggcuuuuaaggaggauaaaugucaucuagcagugcuuugguaacauuuuggacauaauuucaaagcccaguuucuccaaacagacaguucuauaaaaucaauaauacaguacauauaugugguuuucuguuagucugacuugauccaaggagaaauauuuuuuauuuuaaaaauaaaaugcguauuacccaaguaaucuuuuaugagugaaugaaugaaugaaugaccaaaaaauguuuuaaucauguuuuuuuaugagaauuagacagcaggaaccuuagaauguauucuuugacaagaaccugcguuguucauuaaggcauaucuggauacuuucguagacagcugagcagaguuuauaagaauuaauaauaauaauaauauugcauagugauaauaguuuguugccaggaauggaaauaacugcuuuuauuugcauuuuaaaauguacuccucacaauaacuccuugcaaauagguacugucauuaucccuauuuugcagauuaaaaaaaaguaaggcaaauauaucuuacccaaguaaguaauagaaucagaauucauuucuggcuacucuaccuaaguuucuacuaccuuauaaugcugaugaaaauuaaguagcuuaaugaaggauuugugacugaauuuggaaguuaggaaauucagauagagcucaaguuuuccgucaggaaauaguuuccaagucuacucccauacaaauggauagguaaagaaaaauacguuguauuuugacaaacauuuugcuugagauaaaacuguucugcauuuccuuuagcuuacuucuuuaaauuuauacuuaaguaaaucccagucuucugcaucacuguugucaaauauggucauuuugaauauugucacuuuuacuuuuuaaaaaaugaacauuacacuuucaagaaaccacauggcuugccuaguuacuguuguaaagaacugaaauauaagcaaauuaaauuacuuuaaugcuuucuauaaagucaauuuuggaugcgugucuucuuauauuuucacaauuuugaaauauuuucugcuuucuuuuaagauaaaugaucuuuuugaaauuauuuuauugaaacuagggaaaaauguccaauauguuuugcagcuggcauuccugaaaacuaaaugaaaauuggagagccaauuucaucauguuaugauauuuauacuuuugucaaaauucuugcauuuuaaggcuuguuugugcacauugguuuugaaaugaauuuaguaauuuauguuugaaacucauuucacaaauaugaaguaaaaacuuuauaggauuaucucuguucauaguaaucugacuaaauaaaauauauucaaaacguuaacauuuuucuauguuaauuuucagguugaagguuuagaacagauguggaaaaauguuuacuucagagaaagggguuguggaggaaugguugucagaguuuaagguaauauuuacuguucuacuauaguaauuauauuccaaggaaguuuugucuggcguuuaaauuccagugauuuuuguauuuuauaugacugaaaggcuaaauaucuguggaaguauuuucuaucaaaucucaauagagaguuauuuacacauaguaaucuuuucuaggaaauugauuccuuuuuucccccaagugguucaaagaguuuauucauuuguuuauuuucuuucuuucauggcaauaccacaaaguaguuaaagucucugaauguugaugucauucuccagcgaccaucagugauucauugucaaaauguuucuuccaguuuggagggcaguggaacuggggugaccaacaaugaggagaggaugggaagauauuugcucaacuuuauaccagugaaucuuucucuaguuggcuaacccaguggcuauauaagggguguaugaccuuugauuaguuaaugaagaaaauaaaacauauuuucuugucucaugagcuuuucucuaggauagcuaaaauaguauuucuuuaaucagcuaauuacuuuucucuguccuuaugugacacauaauuaugugcacuugcaugaucaugaaccacaggaaugaagaguuugggcugcaacuaucaguuugauuuuguccagcccagucagcccaagaccuauaaggacaaaguuacagucugacaaagucaggcuuauuggcuuguugcauugagagagauugcccaacagacaccaugggaccaucucaccaaaccaaagaaaagauaaaauuauaguaauuuggaggaaggguagaguuuaggugaaauuuaaaugaaacgguauucugguagacucaaaacaaagcagggcuauuuauaauggggugaacaucuggucuggccuucaaaguagacccaggaucuuguugucuugaaaacuacaaaguuaauguagauuugaaauguuauguucagaaacuccauauuuauaucucugcaccuggguugaaaaucaaggcugcuucucuaugucaaagugacuucgaugcucuaggcaagagugggauguuuuguucuuacugauacauguucaacaacaaacuuuuuuauaaucugugauuuuagauaacaagucaucuuaguaaguaagaacuuaguagucacucaaagaaggagauuguuaugacauuuuucaguugcaguguguauuuaggaaaagcaccguuuccuguuaauuuuaauagcuggccuuaucugucucuuuuaucuaauccugaugaauagcugggcagacuuuuacuuucucagcuuuuauagccaugaauugagcauccuucuauggauuccccaagucaucaugaagugacauuagaauguuacagaagugcuuucuacauauuuuaauaacuuguggccagaugagguggcuuaugccuguaaucccagcacuuugagaggcagagauggaaggauugcuucaggccaggaguuuaagaccagccuaggcaacacagcaagacccccucucuccaaaaaaaaaaaauaaauaaauaaauuagcugggcguguuggugcaugccuguagccccagcuacuugggaggcugaguugggaggaacacuugagcccaggaauucaaaguugcagugagcuaugguggcaccacugcuguccagucuggugacagaaugagacuuuugucucugaaagaaaacaaaacaaaacaaaaaacuuugauuaaaucuuguguguguguguguguguguguguguguguguguguguuuccugcuuguguuaucuuugugauuaaaauagucuguuaucacggcuuuuuuuuggcagauugauggaaauagucaaguuuaacaguugaaugcuauuucuucuagggcauucuuauguuaaugaugaaguaaaauaugcaaaagcaaaugucgacagcuauccauucuuuaagaugggaguuguggaaagagagcauguuaaaggguggguuguaggggugagaucagcuaguaagguaaaaaauggaaaaccaugacugaucuccuucccuuuccaucuguuuguuuauucccuuccccuccugguuuggauauauagacaccuaggaagugcaguaccgaggagugaggggcagagcagcgguuaacagcaguagugucugaggaaguaggugguuggggugaagggcugcagagguggcguguagaagaauagccagaguaguuacauugguagauugguuacauugagcaaauaaguugauugaagaaauaaguaaauauuuugaggauaaugggaguuagauuucuaucugucugaaaaaggaauuacaaucauggaacagcgaaagccaagaaagaacucuaagguguuguguuggaaucauuaugaacucauggguucuaaguaugcauaugauacauauguguguauguaucuguacauguaugcaugcauauaucuccuagcuuuguucacugggaggaccuagaaacaauggcacccuggucgcagugaguacacuaagcucccagaucuuguuuuccaaauaccaucuuccacuacaagaaaccagaguaugaauaaauaggaaauauuauuuaaguaauauuuuaucaauauaacauauuauguggguaacaauauuuuauuaacauuuuucauaaauuuaaugcaagcauagggaaacuuuuccuuuaggaggagagagugaaucauggccugcaggaaauaaaauguaguuuaaguaguuucuccugcccaaccccaagauuaacuuuacccaauuuugaaucaauuugauauucaaauguuuuaaauuaucuucaaaucuguauuauagccaguucaaggagggauauuucccauuccuugguuaauuugguaggcauuccugauaauuauuuggaguguuauucuaaauuggguuaauguguguuguauucagcucuauguuugacaaagagaagaagguuaucaggcaaaaucagcagcauaccagagguaauagaauauagaaaagugcuugggaacaugucugcuaaguacuuuuaaaauuagaguaacguaucucuugaaaucucugguguuaaauuacauauuuuuguuaaaauauuuaagaaagguuuugguuacauacauauuucuagaaaagcuucugcuugauuguuuuauuuaauaaccaugaugcuaauaaggccaagucaucaugauugaguaagugaacugaaagaaacccuuugacuuaauucuaauucuccccaagcugguuuuaugauguugggcauaaccucuccgggucucauauuuucaucagaaaaguuaaaguacuguaagugguuuaugaagaugauuuuuagcucuacacuguugcacagucagucugaacuccuaaccucacccaacaucucucagauguguagagaugaaauuuuugaaauugaaaauuugguaaaauuauucauugucugcucuagcuauggacucucauuaguauuuucuuuuuuuaaaauuugagacagggucucacacugucacccaagcuggagugcaguggcacagucuuggcucacugcaaccuccaccuccuggguucaagugauucucaugccucagccuucugaguagcugggauuacaggugugcaccaccaugcccagcuaauuuuuguauuuuuauuagagcuggggucuugccguguuagcgaggcuggucucgaacuccuggccucaaguuauccgcuugccuuggccucccaaauguguugggauuacaggcgugagccaccgcgcuuguccuauuuucuuuauguaccaacuaaaugauuagucuaggacuucauuauuuuaagauuucaugaauaguucaagcucuaucuuuucaaagauuuacuuauaaaauauuaucuuucagauuguguuauuuuuguuacugcugugugguagauuuaucuagcagauuuccagacuccugauuuuuuuaaauuuucugauaguugcugaaucucaauaugugacucaaaaucaaaucuuaugugugauguuguugaauaggauuguuuuaauuacugguucuucacccaucuguccaucuucauuaauucucugcuacucaaccccuaucaccuccuuacauuuuugaaaaaccaucugucaaaugauacuuuaguaugaggcaucugucuucaaauuuuguuguuguuguuguuguuuuuugagacagagucucguucuguugcccaggccggagugcaguggcacuuucucagcucacugcaaccucugccucccggguucaagcgauucuccugccucagccucccgaguagcugggacuacaggugcguggcaccacacaccuggcuaauuuuuguauuuuuacuaaagacgggguuucaccauguuggccaggcugaucuuuaacuccugaccucgugauccaccugccucaggcucccaaaaugcugggauuacaggcgugagccaucgcgcccagcgucaaauuuugccaagaauaauauaccaacauaauuuuccauuaggugcuuuucaacuccaguuaugccuucugaaaugugagaaagcuaagcuaguauuuaagaaggucacuaccuuugaacuaguacagugugagaaaauuuaaauguuuuugcuauaauaguauuuaaauucauuuggcuccuuuagaucuuguuuuuuaaaacaccauucaugaacacaacauuuucucccucucuacagacaaaauuaacuuuucccacauucauuaaauaaaaugaugacagaauugugaauaaaagguauuauuacugcacuaauauuuaagauacccuuccuuucauuuaucagugguagccuggguccaugguauuuuccagagcuugucuuuucagacaaacagcugucuuuuugccuuuggguguuucacagaaaauauuuuaccucgugacggucagcuaguauauaagcugaacauuguaauucauguuuuuaaugaaugaucuaguuuuagccuagaugauauauauauauauaaaguaguaaucuuucuauucacuaauuuuuuuaaacauuuauauuuugguucauuuauucuucaauuuuauaguuagauauauauguuagacauguauacacaguauacauagacauguauacauguaacuauguauacauaguuacauauguuagacaucaauguguuuuaaauauauauaaugcauuuuauauauauaaauuauauauauaauuuagauuuauuuuuauucagaggauuaggaaucugcuguuuauuugacuguuauucccuuuuauauaaauucccccaguauuagguuacucuugaucaaaugacggaaauggaauguugccucgagaucuuuugugucauacuuuugaaauauugaagaaugccuuaaucucgucuuuauguaagcaguugcaguaaaaccuuuuuuucccccgucgggagaauugugaaagguuuccaaauaguccacauuugcuugcccuucugguaaauaaaacucucuuauuaaacuuaaaaaaaauucuauucacuuauauaucccaaggugaaauaugacccacuuuuaaagaaucuaccaaaguauaagcaauggcaauuuucauuucuuauuuuguuuaucuauaauauguucccucagcaaagauuugcguaugagggccuguggugagugcugugguugcagagaugauaagacaguucuugcccucaaggagcucacaguaaagugaaaaugaaucaaaugucuuuauuguaaaaauuuaugcuguuuaauuuaugcacacauccaccuauauacuaaucauaacccauauuaaauuuugaaauacuaggauaugagacauauaaggaauaauguauguuuagagugaguuaggaauauccugagacaugguaucuacugcaggauuggcaaugacugacugaaggaaguaauuugggugagagagaauaaugacuuaggaaacagauaucgcugaggagggggugugcuccagaaggaaagguuuuuaucauuaugauaaugaaauguuuuuauucagauuucccuacucuuuuauucaaaaucaucugacuuacuacuggaguuuuaucucuucccauuacucucuggucaugguguuuguucugaauaggugguucuggcaagcugugacuaguugucuguauuuuaaauggcauuaggaaaauucguuuguugguaguguggauaucuuuuucucuagcucugaaaagucuaaauuuucccuucaauugguuaaguagaacagccuucucaugcucaaccgucagaguauguaacuccggaguuaauuugacccugucucauucuguuacccaggcuggaguguaaugcugcaaucauggcucucugcagcguugaccucccaggcucaagccaucuucccaccuuagcuucucgaguagccaagacuacaggcauaugccaccaugcccagcuaauuuuguuuguuuuuuuguagagacgaggucucacuauauugcccaggcuggucuugaacuccuggggucaaucaguccuccugcuucagccucccaaagugcuaggauuacaggcaugagacacugcgccuggccuauauucccaucucuaaucccaaacuaugaucaaagaugaaguguugauguuaguuuauguccuuguugauaagaggauaaaguauauuuuuuguuuuauuuugaauuuuuguugagauauaauuaauauaagauaaaauuuacuaauuuaagguaaacauguuuaccuugccuugguuuuugauauauucacaguguuguacaaccaaugccagcaucuaauuccagcacauuuccaucaccccaaaaagaaacuucauaccuguuagucacuccuaaucuucuucucccaucugcaguccuggcaacaacuaauuuacuuucugcaucuauggauuugccuauucuggacauuucauaaaaguaaaauguauuuuuuuaaauuuguuuagacauuaccagaaacaucuuuaccaaauuaugccacaaauuugaaagacaagaguucuuuaguuucaucucucuauaaaguuauccaggagccacaaagugagguaaguacuuuuaugguuuauugugcuaacaguauugacuugauugauuuuuaauuuuuuauugugaaauagauauaaagggguaagaaaauguauauguuuaaagaacaauacugaaaugaacucuaguguaccauuccccaagccaagaaauauaauuuauuaccguauuccagaagccaucucugaacauuuucucucuuuuucucucucgcuagagguagcuuugaaaagucuaugucacugcauuucauuuuauucauucagcaaguauuugagugcccauuaugagccaucggcuaugcuaggcaguagagaaucaaauugaguaacacaugguuuuuauccugaaagaggaaagugggagaaaauaaguaaacacaugguuucaaggcaauccuuaauccagucuacggauaagcacaaguuuuccagguggcaagguaaaagaauauuccaugcaguggggauaguauacggaggcucagaaaaugcaaggcauuuaaagaauggcaaauaguuuagcccggcuagugccuuucccagucuuuccucuugccccacuaccacucuuucuuuuuucagauggcuaauuuagauuuuuuuuuuuuuuuugagacagggucucauuuuguugcccaggcuggagugcaguggugugaucauggcucacugcagccuugaccucccagguucaagcgauccucccaccucagcacccccaauagcugguacuucagucgugcaccaucacaccuggccaauuuuuguguuuuugguggagaugggauuucaccauguugcccaggcuggucccgaacuccugggcucaagcaauccauccaccucagccucccaaagugcugggauuacaagcaugaggcacugugccucacuagcugcccauuuaguuugaagguaauaaaauaaucuauauuccagauucugcugcuuguaaauccuaccauucauaguagaaauagaaaaaaaauuggaaauaggaugaaaaguaaaaagguauggcauuuggaaaaaggugaauaggcuaaugcaguaguuaacaauagaggguaaggcugugauaggagcugaagcuagaaagcuagguuuaggacauaaccauggugggccucaaauuccaucuuaagcaguuuagacuuuuuuugcacugagggguuaggaagguggcuauguggaggauagauuggcaaaugaaaagauggggaaugcaagaagacuaggaagcuaugacaauagccuaggagggagcuguugagaaccuaaacuugggcagcgucaggaggaguggaaagagguaugguagaagagagggaucugaaguacauaauuccuuuuguacuugaguuugauugauggcaugauagacucuaacagcagauucagugguaaaguaacauauccuggaguccaguccaauauggaucuauguaucucugggaugaaacuaccaaaauugagggaggcucuucuuuugaguaguuaaccucuuuuggaggggguauagaauaucccacuccuacugguaauacuauaaugcguaucaugaauuuuaggugcugaagggauuagggaguauauugacaagccaaaaaacuuuaacuggaauaacugaauugaagaaucauauuugucuugucucuuccuucuucccaaagcuucuuaacuuguauagaaugcacagguaggcuguuuucuugaaggauuuuacuuuuuaaauauugagugaaagcuguuuuaagguuuuccauguuugguuuagaauuauauauuucaccaaauaggguaaguauagccauacgcuuuauguuuuuuaacaaauguuguugaucauuuauuauuuauuauuuugagaagcuuaaaaauuauucugucaugaaguauguuuuaacuaggcuacuuuggaaaguguuuguaggauaaauuuaugauuggcuagauuaguuuauagcauuccuuuuauucagauaacucuagugaauauagcucuaaugguucagagcaguguuucucaaacuacuagugaugauggaccaguuuuuuaaaaaaauuaucaucugucacagacaaauauguguaucugaaauacaugacuaacaugaacucacaccaugugugaggcaccacacaaauuugauauucccuaacugauguauacucugauaaaucugcuaaucacucacuuggaucuuguaacaauauuaaguugcuauaaaaguuuauaaauauuuccucucaauuucuauauuuauauuguuggagauugauaacaguuuguggaugauccucaggaccacacuuuccgaagcauugguucuggucuugcauguuaguuucgugcuuuuauucugguucauguggugaagacuguguguauucuguauucuuaaaaaaaccacucgcucuuucagauauauuuggaagugcuucuaaaauauaacaguguaaucuacuuuaacauuuuaaccucccuuuugcuguuuagaauauuuugugucuaaauuugaaaauauuccuaacaaguugauauuauuauuuuccagaauuuuugaaauuugagauauuguuucugguauuauuugaagugcaacaaauuuggcauuuaaacuucacuaauaguacuuuuucauuauucaguuuuauucauuuaauaaauauuuauuaaacgcauuuaaugugucaggaaccacuuaggaauuaugagaacaaaauagacuaaauucuugaucuuguagauuaaaacuuguuuucuaguuagugagaagacauuaaacaaauaacuaaacauauaauacuaugucaguuagugauaaagcuauaaggauaaauaaaaugaaguaagggaaauauguguugggacugaggaaguuggcgauugaaucaagauccaaacgaauuaggaguugggguggaaucaggggcaagagccuuccaggagagggaacuguagguggaaaggcccugcgauaugugauguguucaagaaacuuauaaagaggcaguuuauauggguacagugcaguuugcuuaagcggcgcuuuuaguugacuauaacuuugagacaggccuaugaguagagguugauacuacuuaagucuguuaugaaaucagcuguuuuuugaaagaccuacauaaagucuccuuggaguucuaggagucgggaguccagagaguggagagguccgguaccaguagcugcugguuccugaauaguaguguucuccaacuuuuccguaucuuuuucuuacccaauguuccugaguaauuguucaauacaaaaaauuuugcaagauuuuccuucuaaauuuaccaaaacuugacucuuuuccugcuuagucauuaaagaacauuuuccuuacuuagucauuaaagaacauuuuugagucaugugccuguuaccacuagaaaucucucuuaggauacagacuuguuacuuaugaaugaauuguuguaaaaauccauuugcagcuuaguuguuucagaacucaaaauuuauuuuacaauggagagaugacacauggugacuagguucucauuaaacccauaaaagcccauuuaacacauauaaauauacuugagguacagucucucuuaauaauacuguaaaaccuaaccaccauaaauaauaugguuuccaugaaaaaaaaaaaacauuaaaaaaugcaacccagacaccaggaacacagcagguucuaaugcuccuuugcuugcuucaaauauagucaaguuagauaugucagacacuguccguauuucccacacuguauaucauuuuauucuuccugacauuuuucagguauguugguaaagaagucaaaauaccuggcuccaggucugacccuugugagucaugugauuuuggucauaguggauagccucuuugucuuaguuuccuucuguggaaaguguggauaaugauauuuuacccuccaguguugugggaauuuaauggguuuauguauguguaaguacuuuguaaucugugacacacuaugcagauauugauauuuaucuguacuaauuucaaaugcauaauuucaucuaaucuuguugcaauauauuucuaccuccccuuugaaucugucuuguuauauuuucguauggcaaaaacucuaaauuuuggauuuuaaauggguuauaaagccuuuugaguauguuuugauuaaaauuauguguucauacaaacugucuugaauaaaauuucaaauaagauuucauaauuuugcaauguuuguuagacuaucucaauugauuuagcuuucugagggauuuagagaugagggagggauguuaugccacaauucaagauuauugauguggguccgcaaagaaaauuuugaaaacuccacccugaaagcuaaauaucccuaaccagucauucuuucuuccagccaccucuauccccauuccaaauuccuacgcuaaaaacuuuucuugcuaucucugaauggcaugacuuuaccuccugccccucuguuuuucuguuaucuuuccauggccacaguggacaucuguugcccucuaaagaccauuucaagaguggagaaaguauuccuuguggaagauuaacugucagaaguuagguaauuuuucaauaggaaagacuaguuugacuuaguguuuauugaaguauaacuuuuguuauaccuuuuauaaacaauauugacuuuaauuauauucaguuuacauauuucacuuacuugaaaucaaaacauccacuguaaauuaguuuuuguucauuaccauuauugguuguagaaaaucuguuuaguauauuuaaauuuguugccuuaggugagguauaguucauuggauauauauaauaaauagccugauaauuugcuugaaaaaucaguaccuugugaacaguaccuugugaaucucuuaacauauuugauuaugacuugugugcaaucauuguauaugcuuuaagagaauacuuaccuauaagagggucuuaccuugccuaucugauuuuuuaaagcccauuauaaagauacagucagcucuauuaacuggauaauguugagaguguggugggagaggaaaagguuguagaugacuccaaauuauguuuaaaauaaaauuacagcaauauuuagauuauccagggccaauuaaucaugguuacaauaggguucuagauccaggggagucuguaguuauuuagccccccuauguaccaaucauuccugucagaugcugucaaauuauaaacucaggaggcgggagauaggacaguaacuacccaggauucccauucaauuucuucaaccccauagucaauccuuuauauaguggcauguguuuuaccaggaagaaaggauauuuuaggaagaaacucccuacaacuuagcuauuuuaagaacuuaaaaagauaugauuuuuaccaaucugagaaaaccuuuuauacuucauauaguaguuccauucaaauacaguccaguucuugaauuaacauuuugucuuucuucuaguugcuagaaccugucugucaccagcucuuugaauucuaucgcaguggagaggagcaguugcuucaauuuacgcugcaauuucucccagaacuaauuuggugcuaccuugcagucucagccagcagaaaugugcauagcaguggaugcauugaagcucuucuucuagggguuuacaauuugguuuguauuuaauggaguuaacaaaaucuuuuuugacaaaaucaaauauauaaccugugcaacugcuuuucauuuuaauaaagcuaguguuuguuuuuucauacaccaaaugacucauagcccauucuuccaaauauaacuuucuggggauugggagacauacaagcguacauguaauuauguaacuuaccuuuauggauugauugaagguugaaaaucagaccauuucauuucuuuuauagagauaucugaaaauaucaguguugcauuuuaaauuuuguaaacuuaaaguccauugucuauaaaugaucuguuucugaccuucacagaaaguuugggagaaaagauuuacucuaauauucaccaaucauaguugcauaaaaucuagacugucuccagaguguacaacauuauuuuaacauacggcuugcauuacuaauagaguuuauauguuaauucguaugguauucuagauacuuaaguuuuguaccuuucaaaauagaaaagaaauauaaggucauuuucuucacauauuucauauuuaaaugauuacuucgcuuagcaaauauaacuuguuacaugaguaagaucaaggauuauuaagacacuguaucuguaucucagccauccugaaaauuuguuacauauguuuuuuaaguggaaggauguacaguuuaacuaccgguguugaugaauaauaauggauuaucaugguuuaagguuuuaacuuaaaauuccuuucuauucaggucuuuuucaaaaaaauguuuuagacuauuuaaauuuaguuuguaaauuuguguguaagaaaguauguauuuuaauauauuuucuuucacuucuauaggaaauaguugacaaacagggacauaccaaaguauugaguuuuacgauuccaucuuuauccaaaccaucuguauaccaugaaguaagugacauuuuaucacaguaaguuuauugacccuaagcuuugauauugccacaaguuauaaucuaguuauuuaggaaaaaaauugaucaauuuauuaguaccugcaaaaguauaaacacccacaaaguauuuacuauuuccaaauugagauaagaaaucaaaauaaaugaacaucaaacuaaaaugugcuaauaagagaucuauugaaaguauucuuuuugaaauauuuuucccucuuccugauggauggcuacuuguguguguuggccggcgggcagggggguggugggugggcaauuguguauuuccaugguagaauuugugaaauuaaacuaauuuuuauuucucauuugugguuuguuuuaaaauuaguuauuaaaucuucgagcagaaaauuugguaggcagccuaaauauguuuaagauauaugauguucgugguagcuauuuuagugguauauauauauucuauauaucaccuuuucagcagaauagcuuuuuuuuucuuuauucaaaugucuuuucucuagccuuccagcauuggguccauggcucugacugagagugcacuaucccagcaugguuugucaaaagugguauacaguggaccucauccucaaagggagaugcugacagcacagaaucgguauacuguggggauaaaaauucuuaucuuaauccacuaauuuuuuaagaaaauuauuucaguagacuuauaaauaauguuuaaugaguugugugugacaauuuauuugaauacugagucauuuuauacaagagaaaaacagaucuagauuugucacugugcuuugcuucaggugucagcuggaacacugaauuuuaaagacagguuucauauggcuguuacuuggaaagucuuuuuuuccuuguaguuuuucauuauuggugugcuuauacugugcaggucuguucuguaacauuguaucucuccccaaggagugcucucuccccuauuauaguugacuucuuagaauucuaaagauuuguuaauauucuuuuuguuugucuuuagguuugaaguguugacauuccuuuuguuguguuacaaugcugccuuaacuuacaugcccaguguuucucuucagucacugugucaaauuuguucaagguaaaguaaaauucaagugcuucuaauauugaaauauaugaaucuaugauugcuagucugguacauaccuaaguuauuuuuguuuuguguaaucauuuguuuaaaacauuaaauaaguuaauguaaagcucagccuacccaacacauggaaaguucccuauaauugauagucacaaaaaacaugauaaagggccggaugcgauagcucaugucuguaauuucagcacuuugagaaccugaggugggaguauugcgugaacccaggaguucaaaaccagccugggcaacauagcaagaccccugucucuauaacaaauuuuaaaaaaucagcugggcaugguggugcacgccuguagucccagcuaccugggaggcugaggugggaggaucacuugagcccgggagguugaggcuacagugagcuaugauugcaccacugcacuccagucugggcgauagagcaggacccugucucaaaaacaaagaacacaaacaaaaacaacaaaaacaagaacaucaugaagaauguaaagcugaauaacguuuaaauugacuauuuaaucagaaaaggauuauaguauauagcuaaaugauagagcuguuaugaccuuucaaguuuuggcaugugguuggcuucuuuuuguuugcauuuauuuauuuauuuuuacugugcucuaauuuggaacuaagaaauaaguaagagauacugguucuuaaacuuuucuuguuaaaaauaaauugagccaagggguuauaaaauaaauuauauccuugaguauaguauauucacauuuuaaaaauccugauuuaaaagaguaguuaaugauaguauguaugguaugauuuccugauugguugaauaugaccagaauauuaacaaugauuaucucuaguugguggaauugugguuuauuuuaauuuucuccuuugugauuuuuuuugugauuuucuaaauuuuugguaaugugaauguuacuuuuuuuaaaaaggagaaacaaaacaaacaaaaaugacagauuauuccccucgauaauucaaguaaauaagagauauuauagaacuaaggaacauguggaauaauuucuauuugaggaauuuauuuagaaaaugcaacuuauccugaguguauuaguccauuuucauacugcuaugaagaaauacccgagacuggguaauuuauaaaggaaaagauguuuaguggacucacaguuccacauggcuggggagccucacaaucaugguggaaaguaaaggaggaacaaaggcacgucuuacauggcagcaggcaagaaagcauaugcaggagaacuccccuuuauaaaaccaucagaucucaugagacuuauucacuauugugagaacagcaugggaaaacccaaccccaugauucaauuacccccugacuggguuccucccacgacauguggagauuaugggagcuacaguugaagaugagauuugaguagggacacagccaaaccauaucacagaggacgggaucauugagcaauacuuagaaaugaaaugaaaacaaaauaaacaaaaaaucagaacuugauacugaauaggauagaaagccaugcagaaucagcagaggaagagaauucacaagacaaagggcuugguagagaagauagagacgugaagucuuucagguguuuuccaaauuagagcauaauuacauuuccuaaccuuaaaagaugguaccagugguucaucucucccacucaccaagucguucuaagauguuuuuugcuuuaaauuguuuaaaggcagaaauguccggacuuuugaauuucacagaucuguaaaaucucaaaaaagguggaacagcuggguuauuuacauaaguguuggcaacuuuuuauuuugccaagucauuauauuguaaaugucuaccaucaacauuauuuaacaaaagggagacuauuuuaauaucaaaaaggugggaggguggaagggaaggaaaauaauuuauaaguuaaaaaugggauaaguuuagcuuuccuugcuuuucguuucacuauggucuagugaaaacucuguuaucgacuaaaauggguauaaggaccaacauucagaaauacugguuuaaggaguaacaaugcagcaauuuucaccucuagaacuuagaacacacugcaaaguccagguccuacuuugaagcaguguauuagaugguaggauccaggaaugccuauauauguauauauuuguauuuuuauguauuauauauaaauguauuuuuugaagcuccauagauguucuaauacagugcccaaccacucuugacguuucccugaaacuacugacggaaaaguuagaaaagaacaugugucacugauuuuuagccuaucuaacucuaacguaguacauucuaauauacuuacuuuuauauuaugaguagaaaauugcuaauauaccaauuuuaccugaccagggaacugaauaauucuucaacagagaaugcaaguaaaaacuggcuuuaaaaacaaagagaaacagauuauuuuaaaacuagcuauaggauuuuggccaaggaaguuuugguagaaauagaucaauuuaugccacaagagaaauuaauuucauguaaauguccaccagcugugaaaaaaaacaagagugggggaaaagaucuaaguaauuuaaaagacuuaagcuaucuaaauaaugcuaacucuuaacuacaauguguuauauuagaggaacucuaucaaauuuaucauuccugucauuuuuaguuguuuaugucuuuaaguuuucauuuuagauucccuauugacuguauucucaaugauaaaauccaguuauuuauuucucuuaccuacuggcuuucuuaaucauuuaucagauauucuaauuaggagguuuuguacauuucuaagaugaauagaaaagaauuagaaaacacuuuuguuaaucauguuaagccuaguucauaucuauggaaagaaaauugguuacagaacuguggugauaaguaaguuagaaaugguuauaccaguuaaaguacaagagcuucuuaaugaucuuagcacuaacacagguuuuccugaagaugaaagugauccugcuguuacaugggccaucuaauccuguuugccaugugauaguuguuuuagauugcugcucaauuugguugaugacuauaccaaaaugauugacugggucaucuaggagaaaggauacauaaauacaaccagaaaaaauucaugggauagaugaacuagauucagugacaaauguguuacagucuuuuuuuaaucuucugauuuuaauuaguuaugaaaauaauuaaaacaaucuugaacacuucccacccuccaccuaugcucacacaaauucauucuacugagcaaaaaucuguucaguuacuauaagcuuugccuuccugauucagacugauugauggccagcuugauagccuguuuucuuccuacauaguaugugugaacaacuugaagaagagaucugacagcaagcaagagcuaaacugaauaagcuauagucaggaagcuuuuguucucugcuaguacuaaauguauauggcacuaugaaaagaaauauacucaccaaugcuacaaauaaguuuugcuaguauaugccagaguccucuaaguuugaggaaaugauuucuuucuguuggacauuuaauacaagacuguuuaacaaauggcuuaucuucuuuuuugauguggaauauaaauauuaagaaugaaacuaugcucagcuauuaaguugaauucucucccauugucuaagggacagcucugauuuuguuuagcuagugagucaucuaacugacgaaccuggauauggauagcugugaguuccugaucaguguauuuguuucuguguaccuguaaugaaucccugccucuccucacuucuaggucaauuuuucugaccaccugaacagauuguuuucugucaauuaagggcagcuuuguuacgaguaagccauuuugcuccugacuaauaaaauuuauauaaauauaaagcacuuaaugcagcaucagccacuuugcuaucaucuaguaaaugacagcuggcauauuauuguaccccaucagugagcacacacauucacuauggaugcacauaagucauugcuuucauuuuuuuucucaccuguuugcuaugacuguaucaacaauucuagagcauaucugauauaaggucauuucugguugaaagaaccuauggcaaauuuuucaauugcuuguuauuuuauuuggaaacuucuuuuuaccgguauguaaaucuugcccauccuucacaacccaacugaaauaaucuuuccuccaacuacgugagcaugauuuuugugugugaucuucacuugagaaacaugacagaagaugcagacuuuauuaagcucuuaaagagcagaacaagcaggacagaaaagugcucauuacuauucaggcaauucuuccacuuucucuuuucuccuuuccccuuuuucuauucuccuggucuuuuccucuccacuucucucugccccucuuuuuuuuuuuuuuuuuuuugugagauggggucuugcucuguugcccaggcuggagugcaguggcacaaucucugcucacuguaaccuccgccucccaggcucaagcaauucuugugccucagcguccugaguagcugugacuacaggcaaaugccaccaugcccagcuaauugcuuguauuuuuaguagagacaggguuucgccauguugcccaggcgggucucaaacuccugagcucaggcacucugggggccucagccucccaaaguguuuacagaugugagccaccacacccggccuguuuccccuuuucagccaaguuucuacucacuagccugaugaucuggagauccgauaauaauaaucugauaauaauauuauauguaauauuauaauuauauauuuauauauaaauauauuaucugaauacauuuauauuaucugauaauuaaccuuucuuuucuacuuuugguucuggucuaucaugaauaaauaaacucacuggaaugggucuuccuaaucauuuuaugguuuguaacugaggcuauauuaacaaucccaaaaguuuauuuuuauucuaagaauaacacacaugucucucaccagagaaugagaaucacaacaagaguuuuucucacuuacacauugaugcuaagaacuucuccaagaaauauauugaccaaauacaccuuccggaaaggauuuuauuuucacaugccuugugaauuuggcagaguaaauuuaauacagacauagcuguuauggcacucagcugcucuuuuguaaggacauacccuuauguuuggauuugugaagggaaaucagagaacuucaggacauagccgugaugaacagaggagccaggcauucauguggcauauagcuuuauugcuuuguuuuuuuggcauuuaaauucagugaaggguauaugggcaaacaauauccuugaagauaggaaucagaaaaaaccuaauucagagaauucuuaaguaccaaaauaaaggaguagagaaaagagaugccauuaccaguuaaugaugcagagggauaggacuagauuauuuugggucucagcucaaaugauaccuccuuggagaggcuuuccgugaccaucauuccuaaaguagcacuuucccacccuaguuuauuuccuuguagcacucauaacacuguaauuaccuuguuuguucuuuugauauagacugucaacugcuagaaacuucaagaggucaggaacuuuuuguucacugcuauaucacaagagcuuagaagugccuggcauaugauagaaccucaauaacuguugaaugagugaaugauagaugagcucuucaacucagauuuaugauuugauaaguagaguuaggauuaaaggaaauaauuggauuuuuacuuuuaaaaaaucuuucauugguaaauaaaaucaucaguuuuaguuuuccuaguuauaaaacauuaacaauuugcauuucugaauaaacguuuaauuucagccucugauagaugaucacuuauuuccuuacaaguagcuaguauagaaaaugagagaaccuggaauuuuauuuccuuuguaaaucuuucauguguguugguauuugagagaauugucucuguaauucuuacauaaaguaaguuuaaaagaugagugaccauccuagagccaugcaaauuuuuuuuuaguuguauaauaacaacaguaacuuaccuauguucuguuuccugaacccuauacuauuuccuuccugauuccuaaaccuguauauucaauccaggaaccaucucugucaacaugucccauagauaccguguaaguuuuaggacucuuccuauggcaaccaacugauaucuacaucaaacuaaauuauaccgaaggggccagaugcgguggcucacaccuguaauccuagaacuuugggaggccgauguggguagaucacuugaggucaggaguuugagaccagccuggccaacauggcaaaaccccaccucuacuaaaaauacaaaaauugccagauguagugguggggugccuguaaucccuucuacaugggaggcugaggcaggagaauugcuugaacccgggauguggagguugcaaugagcugagaucaucgugccacugcccuccagccugggcgacagagugagauuccaucucaaaaaaaaaaaaaccaaaaaaaaacacccaaauuuuuguaccuaggaagagcagucauggaacuggccucaggauggccagacguuggcucaugccuguaaucccagcacuuugagaggccacggcggguggaucacuugaggucaagagcuugagaccaaccuggccaacauggugaaacccugucucuaauaggaauacacacacacacacacacacaaaauaaacaggugcggugugggaggcuggggcaugagagucacuugagccccagagguggagggugcagugagcagagauugcaccacugcacuccagccugggcaacagagugauacuccaucuuaaaaaacaaacaaacaaaaaaagaacuggccucagggucagcuggauccagagacucagauauuuuuaggauauucccucccaucucaucaucuucauuuguuggcacuguacuuuguuuuugcagauaggcuucuuccaugugguaagaacagugaccucaggcagcuaaaggcuuacauuguccacuuuuuuuuuuguuuuuuuugagauggagucucgcucugucucccaggcaggagugcaguggcgugaucccagcucauugcaaccuccgccuccuggguucaagcgauucuccugccucagccucgugaguagcugggauuacaggcacauggcaccaugccaggccaauuuuuguauuuuuaguagaaaugggguuucaccauguuggccaggcuggucuugaaaccugaccuugugauccaucugccuuggccucccaaagugcugagauuacaggugugagccaccgugccaggcccuuacauugucugcuuuuagugaccucagcagaaagaacuucucccagcuucaguauuaaaaacauccagcaaagggggugacagccugagacuucuacauaccccuauagggccauauuggguaauacaauuggaagaguacucugucagguuaaauauugcuuugguuguauuaacacagauaaacaaugauaacuuaaaguagauauuuauuucucucucacauaaaaguccaagcugguagguggucucagagguagauugcuuauguuuccaauguguucaaguugcuucugucuggggauucugccauuuccuaugguauugcccuuguugguauggucucagaucacuacuauuacaucugccuucuauccugcaaguggggagaaagggagugaaaggcaaguagcugcuuuuuagggguaugacauagaaguuuuuuuagggguaugacccggaaguuucaccacuuugguuaauacaccauugucuagaacuuagucacaugaucacaucuaaaugcaaggaaagcuagaaaauguagucuguaguggagcggcuggcauuccuagcuaaaauugcugggggaaaggaagggaaugugacuuauauguauguauuauuacaaauagauauggagguagugaucucuguaauagauaguuuuauuagcagacucaccauaaucaugugauuauucuugauuuuauggggaaagacuaguuccuaaagggaagagggauggcagugcuuuuaauagaagauagggaugguggcauggcagacaaaauugauacuauaccacgguaccuaaaaaucaacauaucugaaacaguauauuccaguguuccuauuuguucuaacucaguuaaugacaccgucauguggucagcuauucaaacuaaauguggaaauaauuauccacucuucuuauuucuuuggucucaccuucuuuauacuuccuagauaugacuccaaaccuacccuuccuccuacccaccauuaugucuuguauucaguccuccuucaucucacuacugggauccucaucccacccaucuccaguuucaaugaacucuuccaauauagccagagugauguuaucggaagaccaaucugauuuugguacuccuuugcuuaaaacaaaacaaaacaucuuuaguugcuuaccagugucuacgugguaaaaccuagcagguuauaagauauucauguucuggcuccaugaugugaugagcuucucuaguauuuccuaguguccuagcccucuauccugcuaaaauauccacagucuccucaaugucaugcuguuucaucccaccucugccuuugaacuuuccuauguuuuccacuuggaaaaauaucacuuuuucuucaagacucaauucaaaggaaucucuuuucugagaauuccucucugacucuccgcuucuucuaccugaguuuaccauucucuccuuuaccacaucuugaacuuguucauugaaaauauuugcuuacuacacagucuccaugauuagauugugagucccugugggagcuacauccaucauguauaucucuagagucugacacaguaucaaucuuuaauaaauauuuacagaaugaauaaaugaauuaacugaaaauuucuuucauccaucgguucucuauuauuuacaaccauacaaucaucccuaucauaacaaugugagauguaagaaaguaaaauuuuuuguuugcuucuuuaguuaauaagaguaacaggagucucuauucuaguuugggcauacauuuuuguaaauucaaacaaaacuugaguuuguuuuauuucacaugcagcuaauuuuucuguuucccugcuuacuuuuuacucuugguucuaaaaaguucugggauccucuaauaucaaaugcauuuauguugauuuuuuaaaguugcucugaauuaaugacauucuuggggaauauuuuugaaauggucuguggcauacuuagacauuuuaaagugaaggcuuagauucauugaguaggggaaauaacuuuaaguucuagguagucagugcgggggaagagugaguaaauaauuacaaucuauuggcuaguauuauauuaagugaagcucauauuauaucaagcauagaauauuaugugaaagcaucuauuuucuaguaaauuuauuaaaaauaaaaacuuacuguuuauuuuaaaaacagugcaugcugaccaacguggugaaaccccaucucuacuaaauacagaaaaaucagaugggcaugguggcacaggccuguagucccagauacuugggaggcugagucaggagaauugcuugaaccugguaggcagagguggcagugaaccaagaucaugucacugcacuccagccugggcgacaagagggaaacuccaucucaaaaacaaaaacaaaaaacaaacaaacaauaaaacagugcauguuggucagaaaguucaaaaauacauguaaauauaaagaagaaaauagaucuauaaucccacagaucagagauaacuaugacuuuuuaauguacuuuuugcagugacacacacuauacgccuauuuguuuauugcaaaaugggauuaugcugcaucuguuguuuuggacaguuuuuuuucccugucauuuaaauagauuuucaaaacauuauguuuaguuucuauaguauucucugaaugauuuauauaauuggucuccuguguuggacuuuuagguugcuuccuuuucguuauaauaaaugcuccuuagcuuuaguacuccuuaaauauuccucacuauaauacauauuucuggagcugagugugauaccuguaaucucagcgacugggaggcugaugugggaggauuauuugaugucaggaguucaagaccagcuuggacaacauagcaagaccccaucucaaaaaaaaauuuuguuuuaaacagcuagguguggugacaugcaccuguacuggggagguugagaugggaggauugcuggaacccaggaguucaaggcugcagugagccaugaucaugccacuacacuccagccuaggcacacagcaagaccuugacuuuaaaaaacuaauaauaauaaauaaauauuucuuuguuuuuuuuuuuuuuuuaguuuccaugucuucuuuuuauuuuuauuuuuuuacuuuaaguucugggacacauguaccgaacaugcagguuugucacauagguauacaugugccaagaaauaaauauuuauuuacaugucauuuuguuuaugguaguuucuugaaaaaaaaaaaguaaaaucuauugaucuuucuuuagcauucuaccuuuggugucauguuuagguagcaugcaaagaguauguaacuauuugccuauguuuuauuuccuuugugguuuuuaaacauuaacgguuauaaucuaucugaaguuuauuaugguauacugcaugaaguuugagucuaauuuauagaauuuuuuuggauccugcaguuugugucaagaacuuugucagaaauuguggaucauaccacacaucuauuuaugacaaauagugccaaguuucuuuugucuuucuuucuuucuuuuuuuuuuuuuuuuaauggaaucucacucugucacccaggcuggagugcaguggcucgaucuuggcuuacugcaaccuccaccucccagguucaagugauugugcugccucagccucccuaguagcugggaauacaggcacaugccaccauacccagcuaauuuuuguauuuuuacuagagacaggguuuuaccauauugaccaggcuggucucgaacuccuggccuaggugauccaccugccuuggccucccaaaguguugagauuacaggugugagccacugagcuugggcagugccaaguuucauguaguagguuuagcaguacccaaaaauuauugguaguuaauugaccaaaauuagcgaacuaaccaguaagugaaucugguucauuuacucuguguaucaacauaccucagcuuuauauguuuuuuccugguauaacuuacucaggaauguauuacagacaaauguucuguuuggaaagauucuuuguuucauaaauauuagguuuguuaugaaaguguaccuaguacauuguuggcuuauaaauguuaaaauaaaucaccuaaaauuuuaccaauuuuagaaauacauuuauuuugguuuuucuagaaucuguguuuguggauauccucgacaacauguaagaaaauauaaagguauaaguagcaggauaccaguuucuucaggauucauggugcaaauguuaacagggauuuauuuugccuuguaaguaucucaucauaugcgaaauaaacauuuaauuucuuuggaaaauuauagucuguucaucuauugucacuauauuauaaugucaauagauaagugauuugcauacuuuuugugaaauaugaagaucuugauaauaguuuuaauacuuuaaaacuauuaucuuaguuuaaaacauaucuuuuaaaguucugaagaauuucuaaccaacuaaaacacuucaucaucuuucuuaaauucaaggacggaaugaaaaucaguaacacuuaaauauauucauggucccuuucuucauuuuuuuuuuugcuauaauuuccaaauagcuuuuuuuccucaagaaauauauuuuuccauugccagaaacuuuagcucuuaaaaaaauuucagagccucuuugauuagaaauaguuuauuauuagcuuucuauuaguuucuaauauuggcgcucagucugucuuaccugaugacuuggguacuaguauuuuucuuugaacccuaucuuuuacuuuauaauucucuuauuauauguaucucauuuacuuugcauuauauucacuugauacuuuuaauuuucucuaguagaguauaaacuuuuugaagacagaauuuauaaacuucuuaaaggcagaauuuauggucugugggcccagucuggccugaugccuguuuuugucaaguuuuuugcaauacagucaugcguguuuguuuauguauugucuauggcugcuuuuguguuacaauggcagaguugaauaggugagacuguacggcccacaagccuaaaauacuuauugucuggcccauuaagaaaaaauuuucugacccuuguguuagaccauuaauauugucccacaguucuuggaugcucugaucuacuuuauuuuaucuuuuuucuuuguguuucaguuugaguaauuucuguuagcuauaucuucagcauuuauggauuuuuuuccuugacuagaucaagucuagaaaggagaccacugaaggcauuuuucaucucuguuaccguguuuuauuucuaaccauuucauuagacucuuucuuguaguucccgucucuuugcugaaaucuucaucuguucaugcauguuguccgucuuuuccacuagagccuuuaguauauuagucauaguuauuuuaauuucccaaauaacuucaacauuuaggucaucuaugaauuuaguuccacugcuugcuuuaucucuugacagaguuggucuuguuuguuuugcuuuucaugugccuuguaauuuuugauuguucaugauuuuguuuagcaguaggacaguagagacugagguaaauauuauuuaugacaggaaaugggcaugccucuucuaggcugcuaguggaauuauuauaggcagaagugaccuaggauuggguuuuguuguuaugguuacccucagggcaccaucuacuucaaauuccucuagugcuaccugguacuuagguggagagcuggauugcuggaggguuuuucuuaauacuccugcuucguccucagcuuucagccuucucuguaugccuccacugcagauagguuucuuuccauguucucaccccuuccuccagcaguacaguucuguugcuugguucugggugugcacuagccuggugguggcuggggcgguggugggguugggugggggggcauggaaauggggggagguaguguucucuguuguccugguccagccucaguuuuaggcugaucccauguccccgcaucucagggaugggaguuucucaguaguccugccccuucagugaugacccccacuacuuaucucagcauagaaugagagguuuuuugcuuuuuuuuuuuuuucuuacccucagagccgaauuggucuucacuuguucgcuggggggugaaagggauugcugcucuuuccccaaaggcuuuaaaauuuuuguucugugugauaaaggcaucuggcuggcucuuuguacuuuucucacaggagugguuacucuuuuccuucaggccuauaccaucaagggcaguuuucucugaccugcccuguuucuaguuuuucuugugagugccuaaaggagauuuauggcgaagagccugugguggauacaggcucccacuuguaugugcuuuuagagauucuguacucuccugcuagcccaugaguuaccuuuuagcaauuuggcuucuaggaauuuguuaagaaaauuagcuaaauguuucuuaccugcuuguauuguggcccaucucuccuuagaggcaccugucucccuuuaggguuccggcuauguggaagcccuuguuaccucggcucuuugauggauucuugagaauuuauaauuuuguagauuaccuggcuuuaucuuguuuuuauggugggagcaauguucuugccaguuuuuaggccucgcuugcacucuugauguaauuuauaccucuuuauuuuguuggaaguugaucaagccacuauaucccuguucauuuuuguaauuuagcugauuuuuaggaaggguuuggcauaucuuugaaaauuaugcauacacacacacucacacaugcacacacacacacaugcacagacacacacacacaugcacacacacuuuuucccucaaguugcucugcuauuugcaacauguagcaaauacacuucuaagugauuaucagaaugcaaagaaauaacuacucaggauacugcaagccacacugguaguagauucucauuaaaaacugugggaguuacagaauaauuuggccauaaaguguucugaacauuuuucuaagguauauaauuuauuauucucugauuugcuuugaaaguauaaaaugcuuugaaauugccuuagcuuuuuuuauuucuguucuauaaauagucauguucuuuagagaagaaauguacaucuauaaaauuuucuuugcuauuaauaggcauuuagaugcaauugaaaggaauucaaagauuuaaagauacauuuuuaagaggaguagaauguuaagcaaugugcuaauaugaucuuuuauuuucuucaguaaagauaguuucucauuguauuuuguucaguuauaaauaauuauaauuucuucauuuaauucaucuaauuuuauaguuauaauggagaaugggaucuagcucaaaaagcacuggaugauauuauauacagagcccagcuagaauuauauccagagccauugcugguaggugccugacuuauuuauguaaauguuauaauuuaagauuucucaauuuagaacuauaaauugagagccauucauaguuuauuaauaugucauuaauacucaguguauucaugcucuuguuauacauggaaguuuuauaacuuagaaaaguaacaaauaauuuuuuuuuaaauuuucuuugagacggaguuuagcucuuguugcccaggcuggagugcaauggcacgaucucggcucuccgcaaccuccgccuccuggguucaagcgauuuuccugccucggccucccgaguagcugggauuacaggcacgugccaccaugcccagcuaauuuuuuguauuuuuaguagagacaggauuuauucauguuggucaggcugaucucaaacucccgaccucaggugaucaggcccccucggccucccaaagugcugggauuacaggcgugagccacugcaccuggccaaaauaaaaauuuuuauuagacugacuuccuagacaccuaacugucuuuuuaacuuaugagaauuguucuccuuaacauacuuuagcugcauuuauuaauuaacauuaggcauuuggaaaucuaauugaauauuuugaaauuuuuaacuuuaucauuuacauauuuuuuuaaccaugaauuucccucuuagccuccuauucuuaucuuagaggauuucuguaucaucuuauaaaaugcuugggaagagccucuuuguauaagccuguuuagcaucauguuuuaucgaaggguuagauaauauaucugcucuaucugcucauguugaucuuaaacuauauuuuuucuccuuagguugcuaaugcaauaaaggcuucauugccucauggucccaugaaaucuaauaaggaagguacaagguguauucaaguugaaaucacaccaacuuccucucgaauaucaagaaaugcaguaaccagcaugucaauaaggggucauagguggaaaagacaugguaagaaauacguaacucuucaagucaaaccauuguugauucuuuuacauuuuucacuguacuuauggugcuauaacuucuaacuucaguaaauaguaaucuggaagaaagagcuguggaguugcccuuaacuccuaauuuauuaucuaggagcaauaggcaguaagaaaaauggagccccuuauguuacacauaugaaugaaaauguauuuaaaaaucauauucaauuugaaauuguuacuucaguaggagaauaaggaaaaugcauuuuaaaauuacucauacauuuugggcuuguauucaaaaguauuugcaaauguuccuuaauuaauauuucugauuucucagugaacucuuaagcaagugaauuuacauauugaaguagaacaacuaauagggacuuuaaacacuuugucugcacuuucugguaaagaaugccauaguguugacgcaacacuaguuguauuuucuugaaguuaauuuucuuucaagauucuguguauguguguguguauauauauaucccuucuugucugcuucauuuuauuauuuuaaaauuuuauuggaagucauuuucauucacuauggcuuuuucagugcuuucccauuucccucccuugucuuuuaauuuauuguucuuuauuuaauuucauauuauuuuuauaacuucccuccuaccuagaaguuauuguagugucaacaaccagucuaagaaggaaauuaucaccuuccucagaagguaaccauggugggaagcaaaaagcuacuucuuuacccuaagcaaacguguauauuagagguaaaacaaaauccauucucuauuuucuucuuccuguaaacugaggugaaaauaauaguuccuuuugguauauuugguacugguuguguugugguuucuauagagaaaaugggaaaggagaagaauggagcuauuuaugguaaacuagaaaguuggugaugagaacaguugccauuguuuucacuuaaggaaucuaggugauuguaugucagaaaacaauaaugauuauccagcuuaccuagugaucauuuuugguguuuuuaaaguguagcaauucuugaaaguuccauaggaaaguauaaaagaggcggugauguuugccaauagcaaggcaaauuauaccaccauuuaaaacauauagucuaaacauacuucagcuucuucagugaaaauuaugcuacugaauggggcuagauuacagguagaaaguaauuuaauuagauaugguuuacccugagguugguuuuucuguuuuggcauuaaugugugagaacaggcacggaggcaaugaagcagaucauagugguuacuguggccauaauugcuucuaagcuacugcuacaggaagcacaagaaugaauuuuaauuucuuuuccacuuuccuucuugcuauuuagguagacauauugggaauuugggagagaaauguagguccugcaguuaaaaaugugaaauauugaugcucccuuguauuugugcauauguguguauaugagagagaguaugugugcauguccaggcguacauuuaaacaaggaggucuguacccugcaacaaaauggaagccauuucccagacauauuuuauaggaaaaaaauuacaaaacaagagaaaagacugcuugaauguauuguuucuagcagauucuuacauaucuuccagauuguauuuuggcugccacuugagggguuagcacucugucuuaggauuguacccucauuaaaguagcauucuuaucaccuguaccccuucacaauucuaacacuugggaaacucuguuuauuauaacaauaaagucacagaugagaauauagaagugaaugaacuauaaaaaguaagucacaugcauggaacagguacagaauacagcuuagccuuguuuaucacucuucuuuagugugaauucccuuuauccaguggacucuaaaauacucuuaaguccuucuuauuugccucuacagguagguugcagucuccucccuuuuuaggguagucuuggcuuucccuucuagagcaguaaaguuaccauguucggcugaauuugaaagguuucuauuuuccauccucaugguccugcuuccuacuugaacacauuguuuuucuaggcucucuaacaggcacuggcuuccuguggggaagguagacaccuuugcuguacuucuuagauauauagacaauucucaaauuauaaauagauuuuuaaauuuaauuuuguuuauauauaaauuacaaauuucucaaauuauagauuuuuuaauuuaauuguguuaauauauaaauucuauuguuaauauuuauauauaaaucaaaacaaaauuuguuuauacauuucuuuagaaacaauguuaaagggcuuguagaucccagggugagccacaacagccuuuuuaucucauaauguuucugaaacauaggacuauagaauguaaguucaguuuauggcuguaugaaaauacauuuagaguuucuauauuuaauggaacucuaaauguguuucccauuccacccacucauaucccuacuauucccucaccacaccaacccucacaguaggacaaauuucuucccaaacccucagcuguaucuaucauacaguagaaacaaggaauaucccaccuuaagccaguggugaugaggauugggaaaggagaagggacgagaaccaugaacuuuaagaaauauucuuuuuuuccucuuucuccuugccucuuuguuuuccuaguuuuuggaaagaagaaagcaauuggcccuuuuuucuuuuuuucuguuggagcucuucucuuuuucuuuuacuuauuugucuuuauuuauuauugcauuuccucuaauuucuccucuuucuaucuuuucuggguagaagagggaaacgagugaaugagguuuucucauggaagacgccaaguaaaacuuuccuuuuugcuuuuuuuuuuuuuuccaucucccuuuaccauaaaagaauauacguaauuaagccaugugaauguacugguguguuugcauaucugagucaccaaaaauuauuacacagccgacaaauacauuaaauuagagcaauuaauggauauuuauucucuuuuauuaucaguaacagaagaaucuuucaauuuucuuuacagcccaaucucacauuguaguguuuuuaaaaugaauuuugaaaaguuuuaauuguuuacauuuuaaaauauuuuaaagcuauccuagaauguauuuuaggauucuguaacgcuucauagaucugccauuuuuuucuuaagguuaagaauuauucacaacauauuuuaauggaaaguauuauaauggaaguuuaaaaauuacuuuauucuuaacauuucuacacauuucagaauacgcaucucuggccaugguuuugcuguuguuaucaauucaaguuucuagaauuguauuuugaccaguccuguuauuugcuuggcucuguuuuuuauuuuuauuuuuuuaguaaacuuuauuuuuuagagcaguuuuagguuaacagccaaauugaguggaaaauaagagaguucuuaaauaccucaugaccccacauucauagccucccccaguauaucaacaucccgcaccagagugguacguuuguaaggaccuauaauuuaaauuuugaccagacagugcauccucaugucaauuaaauaggaugauuuuuaaagaaagguugguuuuaacugagguauuauuuuggagagaucuguuugacaacuaaugguguguuugcuugauuugccccacuuuucaguuuaaguuaaacaauuguauggacauggcuuaacuuaauguguuuuucaaauuuuuuaaacuuuguguuuaaaucuuugagaaaauucuaaugacuucauaauuuuaugucaguaaauauguuugggaaauaaaauuacaguguagaauugcugcuuucgacuuuuaaggaacauaauuucagaauuaaaagcuuuauguguugcuuauucuuuuaugcguauuguguuuaauuuagucuauagauggcaaauaauucaaggcaaagguguauuuuuucaaacauagauuuucaagucaccuacaaauugagggcugucuagaagucauaauuugaaaguaaaacauagugggagaaagauaauaauaaaauaagcuuuaaaaagcauucaauaaguuuagagaagacugaauagauuaugaccauaauaaaagucaaaaugaaaauuccaguaagaaaaaugagauaaaauuuaguaaaauaauucauuaauuuuucaaguuaaucauuaaaauucaauuuugcuuaaauauuuauuuccuuuuaaaaauaaaaagaaguuaaaggaaaauagaaaguuauuucuuuauaauuaugcuuuaauucuauagucauucuuaaaugucguuuccaaagauaccuucaucaucuaccauuucagcuauuuuaaaaagccccuuuucuuaagucccugaaaaguucucuaccacuccaguauucuaguauacaauuuauacuuguuuauuuccuuguguuuuuccauuccuuccuccuuuucuagagcaaaucuaauugcuauuuucucucuguucacgacaacuacuacuaccaugauuacucauucuucuuccacuuuuuaagaaauuauccauacuuggaacaauguaagagauuuccuccuuucuuucaaaauaguuauuguaauacuagucauucauucuauaaaaguccccuaauuaaguuauaguuccaaauaaugagugcuuauauuuuuugccaacuaaucaaaaggcuuauccaguggaaucucgauuuuuuuauugcugcccaucauucuucccacuugugccuuugugagauaaugagacaaguaagugaaaacauuugguauacuuuaaagcacuacauaaagguagauuauuaauuaagaacaguuuuguuuguuuuacuagcuacaaaauaaguauauucuuaauaaguuuuuauuagcuaguuugcuauucaaguuguccugugauucuuuaguacuuucccaaaacuguaaguuuuugaaacuuguaauuuggauuuucucaauuugaguuaaacuuguuuaguuugaguauagcaucaaaugcaaaaauacacguuauauaauaguaacaauuacuuuaaagauuuuuuguauguucugugauacuggaguauaguacucuaacuuuauuaucuaacguguauaucacuauuacaguaaggauuuuaaaaauguuguuauuguuucaaucccaaguuaauauaaaaauagaaauuacauagacaaaauuuauguuucuuauuuauguacaguuauaacuguuugcaacuaguagguaucaauaauaaaaggaauguuuauaaacaagauacuuucaauguuucccuacuuuugguccuggcagauguuaaaugguuuauuuuaauaacagugcauuuaauuauuuucaguuaggggauccaagaguacaaaauuuuaaguaguaaaaaagaauuaaaaguagcaacuguauauauuucuaagucuucuaacuuaaugaugcaaaauaaguacugcaagaauuuuagaauauuuaauuauaugcaguguuuaugugaacaaucagacuaaaugaaauuuauguaguugaaauaaaaagaaaguacaguuucauguuguuaaagcaguuuuauugcauuuuucagcauuuaaaauaauugcuucucuuuaauggaugccaucauauuuaaauaaaguuaaaugauuauaacagaguucaaagagauuuaaaaaaaacaaaaaagugauuuguuucauaauuugcuuauucagugguuuaguacuagcuuguuagaugaaaaaagaaaagaauaaaagauugcaauucauaucggaaaacauuuaaaacugguuauugauuuagaaaauucuaauaaauuucugcuguauaauaacauugauaaagcaaggaaguacuaauuauugaacaaaucugaaaaauuauaauggguguauuuuaguaaauauuauaaauaauaauuguuuauaaauauuuuuaagcauuuaagguugucuuucuagauauuacaaaagguaaaugguaauaaaucuugaaauggaacauuuauuuuguaaaucugauuuuacaacuaugagaaaagucuucaguugaggagaaauaaaguugcuaacaguuaagaagcauuuugaaaaacaaagaaaugguaauaauuuuaaaccccaaaguaguaaacuuuacagaauugucuauuggaaugauuuuuacaucggcaauuaaaaauuuauaauguguauguuuuuauuuuaaagguugucuauacuuauuaaggaaauuuagaaaauaaaaaauuaucuggcaguuuuauuuuaaaaaauguaaauacuuuuaguaucauuuugagaagcuccauuacuuucagauucuaaaaugcuauuugaggaacagauuuucuuucccaauauagaagauaaaacauuuggacaaaaauaagcauuucuuucuuaccaaaaauuuugugaauuuuaacuggcauuuucaauguggaacuuccauggaggacaaaauaaaauauuaggaaauauuagauuacucaaggaaaaaagacauauuaaccaaagagcugaaauacauugauauguuugacacauguggauauuaaguuugagagaggaaagaaagacuguguacagaauccugacuuagacaauuuuugaggaaaacaaaaaaucucauuuuauuuccagguaaaaugaaguuaaaaaauuuuccagccagagacagaauuauuggucucaugaggcaaaaaaacuuguucguaaauuauuguauucuacauuuuuacuaagggggacuuacauaaaucuugcuguaguuaagaaaguuauuauuuuuuauuauugauuauugagcacuccuccuuucuccaccuuuuuaugagcauuugcugcacauugcacaccaaggaagaaauaagcuuuuacagguaguuuuguaauagguguugcugaccuguuuuuggucugugcuacguggucaugaggaucuguaauaaucauaaaggauucaccugguccugcagcggccguauguugcaauucucuauuggauuuuauuuaaaacuugagacuuaauaaagaugacaaaaggaguuacugagaguaauugaauccaccucaauaaggagaauucugucauuuaccauguauacaacuaaagcuaaagaucugacuguuuaucucuuauggaaacugcugauagcuccuaacuggugugucuauacaaauugucuuguuccagacuguuuuucuguaugccccaggcugcucuuuucuuaccuagaaagacuacuuacugcuucagagcucagauuuugacaucuuagucuuuguuuuugcccuugcucagagugcagcccuuuaacugcagggucccauccuguguuucugugauagcuuuguuuuccucuaaucugccuuguaaauacuggcccagguuaagcauugccacagugcuauucuuuaugacuugggacacaguuuaugcucaguaucuuguguuacgcgaaugugacuucuauugauaaaaaaggcuaguaaaguaugaaagauaugcaaauaguuuuuucauguagcugucacuggccauccacuguaaucacaauaaaauccagacuucgugcuauggcauaugugauccuggugauaugaccucuugacuacugcuuugaccucacuuuaagaccacucucacccugguucauuagacuccuucauucuaacacuucaacguacuaagccauucugccuuaggggcauugucuaguuauuuggaguauuugagcugaaauuugaauagugaaagguauguugacuucccuuacuccagauuguuguguggcuagcaguuuuucaucauucaaaccucagcuuaaacaucucuucuucaaagagguuuucccagaccacccaucuaaguacuuuuauccccuauuacccuacuuccucuuucccaucuuauuuuuuuauugcauuuucugcuauuuaaauuaucuuguuuacuugguuccgauauuacagugugagcucuguucccuuauuauauagugagggaagaaucuaucuuuuuggcuguuguauccccagcaucuaaaucaaugucugacauauuauaggugcucaacaaauuucaguugaaugcaugaauaagugagugaaugauaaagaaauguauaacauagggugagcaaguuguucuuucuuuucuuguuuuguugaagaacaguauaacaacaugauaguaaacuagauuaggggauauuuacuuauaauuccaguauuuaaagaauuuucauuuaguuuuuucuaugcauguauguuuucaugguuguacucuauuuaaacuuuuuugguauuuuguuuuuguuuaguuaauauugucagacauuuucccuaguucuccuaguaaauacaguuauuuuaauggcuacaugauaucacauugaguuaauauuccaucauuugcuuaaucauucuucuaauauguuaagaaauuuguuucugaguuuugcuauuauaaauaacacuguaaggaauagcuuaaugaauacagauaacauuuuucuccauugaacagaauauauuauaaacauaaaaugacuauauuaaaggauauuuguucugguauggcauuuaaaauaucuacaucucauaaauuguaaaagaauguguaugacuuuguuuugggguuuauucuaaguuaaaguauuuuucauaauucauguaaaaaauuguaugaugcagacaaauaauaaauuauauuuuuaaagcuucagcuuauuauuuucacaaauaaguuuguaagcaccccaugucagagccagaugccuuuagacucaaaguaaucugaguacagagauguauaaauucuaugaauaaauaaauuauucuuuuauuaaaauucucaccuuuaguaaauauggcagccauaaaacaaauaaaagcaaaagcuaaggugguuuuguaagugacauaauaaaauagauauuugggauuauaaaaugacauuugagagaaaucacaacuuuucgucaucaguuuuaauaauauuugcaauuugcuucacuuuuuuucuuaaagcuggaagaaauuuuuuugggcaaaauuauuugaguaccuuugagaacuaauuuggaaaugucuauuaaaaguauucuuuaacuuucauuucuacauguggagaguuuaccuauuugugcauauaggggguuacacaaauaaaauauauccugagaaguuucuuuuuggaucuuuuuugagcuuuuugaauuauuugaagucaaguacuuguuuuuuguuuuuuuuuuaagguguggauuaaucaugacuccauuugcauagauuguuaaguucugggaaaaacaaaaucuauuuuauuaugcauuuauauucccuuacagcaucuucuauauaauuuucuuaaagaaaggauuaaguucuacucuuuagcuauauaugccauccucuggauaacauaauaaaaaaauagauuuuaaaaaugaucuuuuugaccuaagcaucuugcuaaaccuacauuuagagacggcuccuucacuuuuccaaaacaaagaggcuuugcuuuucuuugccauguaaaaauucuuauuagcauaagcuauauguauuucauuuauccagucaaguaacacauucacagcuuacccuucucaugucuucuguauguuuucucacuuuuauuuauucuaauaauuuaaucucauaacagaauauucacucaauucaucaaaaaaagauguauugagugucuacuauauacaagcuacuuuuccagguacuagauacauaguagugacuagaugaaaauuuuaaaaacuccuuccucauggaacuuaggucuaggaaacaagauaaauaaauaauuguagguuagagaguguuaagugcuaagaagaagaaaaaaggaagaggguaugugaaacgugggggcuauuaaaacuuuggauggguugaccaagggagacuucacuguaaaggaaauuuuugaaaaagaugugaaguaaggaaaugagccauucagccaccaggagaagacagcagccaggacagcaguaagacagugugggugggaaugucgggucacagaguuauauagggaaagaaguuggagagcugauagagagcaagauuagguaacaaauguuuguuuggauuacuuaauuaucuuucuuuauucuguaguuuuccugagaauuauguuucuguucuuucuagcucuguacagaauuacuugcucuucuuauaaauuuaauaagcaguuuaaaaaaucugccauuguuaaccauuuuugagugauaacaaguaucaauuaauuagguaaagacuuaugcuugugggaaaacacaugaucuuauuuuucuacuugccauuuaauuccaugauuuuuuuaaauguaauaucauuacuucuugggcugcagaccuuuauucugauaaaagugauuacauuucaguugcgugguacugcuuuauguaauauucucccugucauuuucuaguuuuucuugcaaaauccugaauuucugccauugaagcaccacuuuagauuaacagcuuucauuggcaucucuuaaaaaauugacccaauuaaaaaaauacacagaccuaaacucaagaauuauuacuuuccuaggauuucuuccagacuuuuauuuucuccggcucuccauucaaaguaaauuguuugcuuuuuguaaaauggccaggaaucuacaugaauaaauuaaaccuaacugugggaugucagaggauauuuaacucaaacggacucgaaugaagaguuagaguuaguauuuauaguauguuagaagagacauuugaaguuaaaagauuuuacugguuagcuucccccacugaauaguuguguagcucuuccugaacuucaguuuccuugucuguaaaugggaaucaaauugccuacuucagaggcucacuaauagauuguuuugagauuacaauugaauaauauaugugaacacuuucaagaaagcgacuuagggcaauucauuguaaguauuguucuguauucuauuaggccuaugcuuagcuuuuaaaauuuuauuaaauuuuaauauucauugccuuuuuuaugucuggauaauuuccgaaguuugauuuuuuuuggacuggagaucccuuuaguagaucuuuugugaaacagcuuccacaauguaaauaaacaagucuuggcugucacuccacagugccauggcgauuuuaucucaguugcagugaccucuggcauguaccucaauaagaauuuauuugcccuaacuuggaagacaguuguuagcaauuggaaacaggcuugguuggagguuuuuaguuucauuaauccuuuauuacagagcacccagaagcagcagugcacuacuaccucaccaacauucuucagccuaucuaggaaauaaaaacuucauuuagagaaccuuuagucaaaagccuaugaagcacuaauuuaggggaaauaauuacaccagcauguuggcucagcagugcgaggcaccaugaagcuuugaggaggggcucccagaagugcauauugcugcuggguauggaguauccaaggcacccguaacaacuuuuaucuuaaguuuuuaaaauuugaaagaaucagaauagagcagugguucccagacuuuguuacacguuagucaccuggggcuuuuaaaaaucuuaugcccaggucauaucucacacuaauuauaaauuagaauguuuggggguuggagccaggcaucaguaguuuuuaaagaugcucaggugauaccaaugugcagcuaaguuagggaaccacaguaauauguggcucuggccuuuguucuuuuacuaccuguuacuguuucucagccuuuagcaucauuagugggagucugauaauccuaucacgaaaguauuugaaaauaguaggugaugucccauaagcagguuuguggucuacaguuuuuaaaaaguauaugcuguuuuacauagucuuauguugcuuugaacuuuguuucacuacugucaccuucuagguauauuuauguuacuuuuccccauuuacaugaauaacuccuuguaacauuaugccuuucuuauuuaagaccagaauaaaaucaugucuacagguauuaacuaguuaggaguuuuguuucuuuguuucauuuauaauggcuguuuucagauaaagggcugacaacgaauuuguuuuuccaaauccauuuuuauuuuucucuagucuaguaaugaacuaaauuuaugaaauugguaugagucugaauaaaucaacugcuuaacuauaucacagccacauuaauacuuacuguuaauaauagaugauguauaugugagacaaaaacuauaccugugccauuacuaaccaugauaucauauaugaauaagcauuuucccaaauaucaugguuuauuaagucagucucaauguagccucauaaaaaauagaauuuuaagaguacaaaggggaacuucuguguggcuugguuccuaauguugacaaaagcuaaagguuuggcuguagauccuugaacauuugccuaagacuugacauaaauucagguggucaccauauuaucuuaaaaacacuagaaaauuacccaaagaacacaaaaagaacaauuuaaaaacaaauuuuauuuugauuuauuagaaaauuuaucuuucauauuccaugugaaaugugugugugaaaaaaugcagaacgugaauugaugcucugugaauuuuuuguuugucauuuaaaauuaaagaauaugacccuauugucucuggugcuaucagaguauuauaaauuauggaaauuacuacagugcaaauauuuggcuuaauucauaacauucagucaucuaauuuuuguuuugagucuuuugcuuuucucauuucacguuuuuguuuuguuuucauccaucauuuugucuuaucaucuucaauucuagagcaaccugacaacaauaaugaugcuacugaauugggcauccuugucauuccugagauuagugucacaaauguggccggagagagaaccgggaauggggaaaaaggcagaacacuaggagagauugaugcucagcauauacagggugugcaggaaacagccacagauccuagaacugagagcaaaggcuugccagagaucaggaggcaaaaaucuguaagaaaaaugauggaggauggaauaaacucaccuggcagagugcaguuuuagcagagcacuuuauaacugcacuccaagguaucuuaaggcaaagggccacugaugcauguuaagcagcaguugcacagucacaaaaauuuugcauguaaucuaauccaaaugcaugaauuaugcaccacauuucucaaugacucuuaauguucuuuggaaugauuauaccuuuaucgucuuugaguaaauuuuuaugaaaacugaggcagaaaauuccuucuaaaauaauuuucugcuuauguuuggaguucuaaaauuacuuuuucggcuuugucuuuuugccaucuuuguuaugaaggauaauguguauagaauuuuauguuugagcuugugauauuuagagucuagauuuuuuuaauuugauaaaauaaucuacaauauagaguacaaccuucuaaaaaagucuuuaaaguauucuaauaccaauuuuuuaaaaguuccuugguaagagcuuugauuuuauacugcuuugcuacugaaggagaguucaccccuaguuuuacugcgugauauuucuaauuguuucuuaucuuuugcaugaauaggagaauucuuucuaaaaacuuaaugggguaugguuuauggcaugcuuuuuguuuaauacacuauaaauuacugucauuuaauuacagugaaguauuuuugacauuuuauaauaaauguuuugauuuauccuuugauuuucuauaaucuguugcuuuauaaauuaugcuaaagcuuaauuuauguaaagcauaacugauuugguguuaaucauuuaaaaagauugcuuaaaauacuuaauguuaauuaaucuuugucauuucuuuguuuaggaaauacagaauuaacaggucaagaagaacugauggagauaucugaaguugacgagggauuuuauuccagggcugcgucuaguaccagccagucggguuuaucaaacaguagucacaauuguaguaacaagccaaguauaggaaagaaccacagacggucaggaggaagcaaaacuggaggaaaagaaaaagaaacuacaggggaaucuugcaaagaucacuuugcucgaaaacaaacucagagagcccaaagugagaaucuugagcuucucucuuugaagagacuuacuuuaacaaccagccaaucccuaccuaagccuaguagccaugguuuggcuaagaccgcagcgacuguauuuaguaaauccuuugaacaagucaguggugucacagucccacauaacccgucaucugcuguugguuguggggcugggacagaugccaauagguuuuccgcuuguagucuccaagaagaaaagcuuauuuacguuucagaaagaacugaacuuccaaugaagcaucaaucaggucagcagagaccuccuaguauuagcauuacucuguccacagauuaauuaguaacauauuuuucucccauaaccuagugaaccuggaaauacaacuuugcuucuuuaugaaaguacccugggucuuucauccguauuccugacaggagcccugaugucuuaaauucugaaggcuccccugacuuuaugaagggaagauugucuagguugcaguaaguugaaauaugguuuuguuauuucuugauuaagauuuuuuccccuugguuugagucuuuuuuuucccuccucuuauuuguuauuguugcccuaagauugucagugacaauaaauuuugacagguugucuaaucaaguugguuaugucucaugugagguuguaaggugguuuuucuuguuuugguuugguuugguuuuuuaauagcuccuauuuugauggcuguguguuuggccuucagagucaaagggagucugcauguaugggaacuguuuuauagagaauggggcagaggcacaacuccaggaauucucuagcuccuggucaggaagccaaucugaaaacaggcauguggaaacacaaaaaugauguguaugaaaagcaccugaugaaaauauuuguaagcagaucaucuuuaugauuagaacaauuugcucaaagcccuggaaaaugccugguaacccagugccuagaauauuauaugauuccaggggauggcuagaggcauuucuguuguuaucucugaaacauuuuuauaucaaaaaucagauugcugguagguguguuguuuugaaguguuuuaucuggauuuagcaugugaagaucccuuucaauuauuaagguauaauaggcuguaaagcugauuuacccuacugcuggacuuuggaaauccuaguuaguuuggacuccuauaauucagagcauacgucauuggaagacuuccuggaaaucaguguaaaucuugcaacauagcucucaagauaccacuguauaauauguaauuguuugucugcaaaugcauuuuucaucuauaaaaugucaugaaagaaaauaaagguagugaaauauggacaaaggacauuuauauauuaacuaaaguuguuuauguuuguguucuuaaauuuaaaacacgaagaaaaagaaaugucuuucuuguuagugaacaggccuguuuuaaauaucuuaguaugauaucaaaagaauaaucaauuuaguuaccucccaacuaaaaaguaaaaaugaaaaagacgacauggcagaaguugaaacaaacuuguauguaucuguaugugaccucuagauggaaauaaaaguuugauguuugcuagccgugguccuuuuggcuaugguugcgguuccccuguaaagcaaauguacuuaagucaucauucagagugagagagagaaagcacggcugaggcugagucaguugaccguugaggaagaccuaaggagcuguccaguucuuggcucuuuuucacugugacugcacagcgguuuccuucuucauagucccuugcuguagucaccaagagagcaugcuaguguuuuccucuuguuccugcuuaugcagagcucagauauaugaaaaauuuguaugcuuugaaggcugccaaagcauuuauacucuggacauaguuuuaacugcaacugcuuuggcuaccaguuuaaaccgaguucuucaaaaagcaugaacucguuuucauucauuagcccuguuuacaauguggauuuugacauaaaugaauuugauuuucuuuuagcuccaguaacagaauggaauaagaucuauugccauaaauuguaguuaagaacuguaaggcaaucgggcagugaaacuugauauuguauuaacuuaauaggaacccuguguacaauuuaaaauauuuguaaaauaucacugugaauuuacagaugucuuuuugucauucuuuaacaaugaauuuccccugugcauaguuauuaauaguauugguauuauuaaaaacuaauuuggcauuuuaagauuggcauuuuaagcaaguugaggugcuuaggaaacauuguagaauaaguuuggggaaauguuagcugacagagcugagagaucagauuuucauguucuaucacuguaauggaaccucauuuagaccucucuagaccuuugcuagcuguguggucugaggaccaguaaguaggauuggcauuaucugguaucuuguuaaaaaugcagaauuucaugccacucuaggucuacuaaaucagaauuugcauucuuaacaagguucccaagugauuuuuaugagaagaaaguaucagagugcaaacaaauuacucgucuaauauguagaauucccaguggucucacagcccuagaucaaaugugucagacacuagaucauuauaaucuucauugguuuugacagcuaauuaauuaguuuaauaauauugacauauggcuucuuaaguauuugaauucuagauugcuaaugauccuuauuuuugcaguaaaaaaguaacacuuuauauuuuucuuguuaacuauaaauggaaucagagcuguaaaugccugaaauuuuaagugugaaaaggggugccacccuuuuauauacugcacaacaaauuugcauuuguauauucuuuuuaaaaaaucucugaagacuugcucagugaaaugguucugauuuuuugcuucaaaugauuugcacuaauugauuuucuggagagcggaguuacguuaacaacaaaauucuuuuauaguuccuuugauacuauuucaaauaaggauuacacauugaaaguuuuuauagaaauuaugaaaauuggauaaucuuaacuaugguaaccauuacuauuauccauacuacuuucuccccacugaacuuucaaauuugaaaauugggguagcuuuuguaggucacuuucuuauaaagaugcugauggucacagaucuccuaaguauccagaauaauauuuuuaucaugagaaggauuccacacaaaauuggggucuugcaccccauauuucagaggaucugaacagaaauuguggcuucauugcacauuuuaaaucucuauagauucuugaaaucacccaaccucucacauuugaaaacccaacggccuggaguauucugguggcacuggagccagcacuagcuuuuuggaauccaaguggggagagaaacaaaaauagacuuuucaagggacugucccagacuacccagggcaaaugucuucccuucccuuccugaagccacaggaaagcacccuggaguccuuuguauaccacuauggaaauuuuuaaggcaagcucucaagacuugaagaguuggaauucucggcauuuaaaugaugccugaaguuuguuuugaaaaagcaauauuucauugcucuuuucaauugugaagcaacugcucagcaaauauuacucauuuuuuuaaaaaguugaauuaaagggaaauauauuuuuaaaaccaaaauagaucaaaaugaucccaguuuuaagggauuuugccuauuuuggaagaauaaaacuaaaauguuaaaacuguugaauuacagagaacagauguacucugagacauaauuuuaaacaaauauuuaaaauaaggcagguuaacauuugcguuuaggcacaauaaaucuguauuaaagggaagcacaucaaggaaauauauacauguugaauaauguaacugaaaaauauuuuuuaaaaaccacuuaaaaagaaaaauaauuugauggguacuuuaagcauuguagauagaaauuaauguauaauaguguccucccagucuuuguaugaaaaauuaaaacucucuaguccuuuaaugagcaugaauuuauacuucuacauuuguugcuuaguaaaauuauacucaguacuuugaguuauucagauuuauguuuaauauuguuaaauucuucaucagagagcauaaauauauugucuucuauacuuuguaacuugugcauaucuaaagaaacuaacaacgaacauuuugggagauguuuuuguguuuuuuuauaguagaguuuuagaguacauuugucuuaauaggaaguuuuuaccauaaacccaagauuuuauuucacguauuguugcuuucucuuauauggaacuuauuguguaccucuuaccuuuauuucuaaucauuuagugauacuaaucuuuucauaguaaauauauuuguuucuaauuguauuccuagaguuuacauuccuaaagaauaaacgacgacuuuggcuauuuuuguguguucccuaccuucuuaaggcuauggaaauaaacuggaguuuaguuuuuugaauuuuuguauauuuguguaaauguucuccauauguaguacuuuauacaacaaguguugccucuuguuuuauugaaauaaaaacugaaaaaaaua

SEQ ID NO: 191453 - RNA, 19185 nt, Homo sapiens
acguaaccguucaagcaucccuccuucccaggacacacucaaagcgucagagcgguccgcucuucucaaguccuauuggcucaaguccaugcgucucauggcacugccgggugagaggcggaaaaaggccuucccaggcgcgagaagaugacgucacaguagcccggccgggcgccgagguugccuuagggcucucugcccaguaacaggcaucgaacggugcagacugaagacgcccuccgucagcgacgccgucgcaauggccauuugucaauucuuccuucaaggccggugccgcuuuggagaucggugcuggaacgaacaucccggugcuaggggugcaggaggaggacggcagcaaccgcagcagcagccuucaggugacucuccucugaauccuccgcgguaaccgagccgggaaggguccgccggcggggaccgggcgucccgcguguuucccgcugcuggugaccccaacgugcccgcgucgcggccuugccggcccuacugggcccugcacaacguuuuuaaaccgaggguuuuaucuacauauuauucaugugguccguuuuuauugagcuucugaggaccuggguuugggccuggaugcuugugcgaaacugaguuuuuaaaucggaaguaccuaucgaaacuaccuuguagguaaaugccggaauugaauauaauuuuuacuaaguuguuuuuucgagggugaggcuagcagcuugggucagaaucaggacuucauuuuggagaagucguggacuucuuugaaaaaaucuaauaaaaccggccgggcgguggcucacgccuguaaucccagcacuuugggaggccgaggcgggcggaucacgaggucaggaguuugagaccagccugaccaacauagugaaacaccgucuuuacuaaaaauaccaaaaaaaaaaaaaaaaaaaaaaauagccgggcgugguggcgcgcgccuguaaucccagcuacucaugaggcugagacaggagaaucgcuugaacccgggagguggagguugcagugggccgagaucgugccacugcacuccagccugggcgacagagcgagacuaucaaaaaaaaaaaaagaaagaaagaaaagaaaaaaagaaaaucuaauaaaaccuauagagccauaccgcaaaaaugcaccugcucauaaauuuggggugaaauugggaaugugggacgcccaguuaagggcuauccgggaggugaggaaaggagaugcgggggccacguugaucuagucccugggccuagaucauugucaaagcuuuuuaucuucaaggaaaggagagauuagacaugaaaccuuagaacaacacaagauuuuuaaagaucggguuaauaauucggugcugucucccuuccuuccccuccuuuagggcuauucaucugaccuuuauuuuuuuauuuuauuuugagacggagucuugcucucucagucaggcggcucacugcgaccuccgccucccaggcucaagcgauucuuaugccucagucucccgaguagcugggauuacgggugcccgccaccaugcccuugauaauuuuuguauuuuuaguagagacaggguuuugccauuuuggccauaccggucucgaacucgugaccuaaggugauacucccgcuuccgucuuucaaagugcugggauuacaggcgugagcgaccgcggcgggccucaucuaaccuuuaaaccuuguauugcgugaugguuucacgucugaucccacuucagggaagacaguccuuuuauuuccuccacaauuaaucuagugaaauauuucagaccgaaaauuaggacucaugucugaugaaugugaguguaaacaaaauuuggcagacaaauuguauuuagcucccagaaacaaaugaauguuucuggaauuauaaguaugaagaccaaaagcaauguaaaaaaaaaaaaaaaaaaaaaaaaggaggaagugaguuucuucaguuguaucaucccccagugaauuuggaacuuuagaagaagaagauaccauuaacuucuacuugagggaucuggucuagcaaucuccacuuuuuuuuuuuuuuuuuuuaggguaguuuagaguugcaggaugaacuuucacaacugggcaugugugucauucuaacuuuuaauauaauuaauggcuuaucucuuuauucagucagaaacaagaugaauuaccuuaaucuuggccccaacuaggaagugaugaguaaaugagauugcuaaaaugauuuuaaaaaacaaaacaaaaccaauauauaaagagaggagagaaucuuuuuggcucauuuugauauuuaugaaauauuggaaagcugguagaggaacuacaugcauucuguacacauguaaauaccauguauaaucucucugugaaaauagguguguagguguuugcccagagaaaagacugcgucaaauagacuuaagcaucuguacaaaaacagaggguagaauguaaucuuucauauucgagaaacuuuaauucaauguccauuuuucagccuuuacuacaguauagggccuggugggggagcaaagaaugauaaaaacccaaguuuuuauccugaaggaguuuaugauuuaugaugcaugccuucugucaacuuuuaacuaucaagcaguuguucauuuaauaagcuuugucagcugaauuuaguaauauaucacuauuuuucuauauuauuuucuucucaaucucaaacaaaaaugcaauuggccacuaugugauuuguugauauuacaaccuaacuacuguauauaaauaaaaaaugaagagauugucauuuaaaaugaguuuaaauguagugcuuguugaaucuuucuauauugucuagacauacuaagauauaaugaagauuuuugagauuuuaaagaacaguugcugggcacaguagcucaugccuauaauuccagcacuuugggaggcugaggcagguggaucucuugagcccaggaguuugagaccaaccccgggcaauauggcaagaccuuaucucuacaaaaaguacaaaaauuagccagacauggugguuugcgccuguggucccagcuacucaggaggcugaggugggaggaucgauugagcuuaggagguugagguuacagugagccaagaucaugccacuguacuccacccugggcaaaagagugagacccuaucucaauuaaaaagaaaauagaaagaaaaguugcuaguaaaauuauuuuguuuuauuguuuauuuuagguaauaauagacguggauggaauacaacuagccagagauauuccaaugucauccagccauccaguuucuccaaauccacaccaugggggggcagcagagaucaagaaaagccauauuucaguucuuuugauucuggagcuucaacuaacaggaaggaaggcuuuggauugucugagaacccauuugcuucacuuaguccugaugagcagaaagaugaaaagaaacuucuguaagugaaaguuuucaggaaaauuacuauccauuugcuuauguuuuuucaccuacaaucuuuguuguuucucuuuuuuuguaacaucuuuucacaauacaauauuuucuuuaaaaaaagaaauaaugcauuauuuuuaaaucagaguagcaaaaagaagaaaaaucacccacaauucuaucacucauagauagccacucuuuugcuguguauuacccuagauuuuauuucacuuaaaaauauaucaucuuucuauaauaguagagugccuuccuagggguaauuacgcuuuuuccacuuuguguugauaacacuauauugugaauaucuuucuaagauuaguccugcuuaaguucauucuaacuuacaaguccuuuacaaaguaugauguaauuuagaacaacuugugaacuuggaggucauuuuaccaucucauuuauuuauuuauuuauuuauuuugagacggagucuugcucuguugcccaggcuagagugcagugguacaaucucggcucgcugcagccuccgccuucugggcucaagccauucuucugccucagccucccaaguagcugggauuacaggcuccugccaccaagccagcuaauuuuuuguguuuuuaguagagauaggguuuuaccauguuggccaggcuggucuugaacucuugaccucaagugaucugccugccucagccucccaaagugcugggauuauaggcauaagccaccauacccagccacauaucuuauuucuuucuaaaacuuuuacuuggauuauccuauucaaacugaucucauuugauuuccuacauuuauuauggaguagauacaugacauuucuugagaauauuuaugguaaaauuuauggcuggugucaaaacaaugcuuggcuaucuguaauguucucucaacucauggugacuaggauggaauuuaaauguaauugguuagucuuuuacuuauccuaauuaaaucagaaccaguuguagacauguugagucauauaccauauacaaccgauuuuuuuuuaaguaaaugagcaaacaaaaccuuccuuucugcauuuguugcaauucuaaauuuaauacaguuuucucugugauaauucuccuuuuauugacauagucuaaguagggagaaacuuuaauuuagagccgaaucuacccacggcauuaccacagauuaguuguauggaugugggucuguuuccccuguugcaaaaugugagaauuagauaaaaugaucucugaaguccuauaacccacuuuuaaaauauuaugauucuguaucacguaagugguacuuuguucuucccaguuaaaugauuauugauguuugugauaauuaacaaagauuaaaguuaguauuuuagauuuuaauuccuaaaaaaaguaugguaucuaugauaguauuuauguaauuacuaucauaaccaauguuacauaucauaccaaugauaccauaugauaugguuacauaucauaaccaauguuauguauuaacauugguuaaugggucaguguauuggaaagccaaacucauuaacuucucugacauuauaauacuauuuguaaccaugaaauauaguucacacuucuauaaacuugugcuuuaaagaacacucuucagaaaauauaauggaaaaguauuuacuagaauuuaaauuuucaguuguggaaaaccauuaacaauaaauuuuaccaagcagcuaagaagauccuuuacucuuuuuuuuuuuuucuuuuuugcagggaaggaauuguaaaagauauggagguuugggaaucaucagggcaguggauguuuucuguuuauucaccagugaaaaagaaaccuaauauuucagguaacugaaaaauugugcauuuuuaaaguauguucuaaaacuauuauuuucuaaaaccaaaagaaugccaaauaaagaaaucaacuaccaacuuagcuacaacuaggagaguuugggcauuguuuaaaguauucgaguauucuagccaaacuucauaauuuagagauuaagguuggagaauauagucuuuuaagacauauaguucuugggagaaaacauuuaaauaaagcccaggaagagacucuacguucuugauucccuguauguacaacuuuggaaccucuuagcuuccuguugugaauagaagagucauccugccugucauuaaggccuuggcugccugguucuguucuuucuucccugucuuuccuucuaagaauaguuguguugagaccuguucuggagauaauguuuaaaugugaggaggcuuagcugggcuacagggauagcaacuuuuuuuuuuuuuuuuuuuuuuuugagacggaguuucacucuuguccuccaggcuggagugcagugacgcgaucucggcucacugugaccucugccucccagguucaagugauucuccugccucagccucccgaguagcugggauuacaguugcccgcuaccacaccuggcuaauuuuuguauuuuucuagagacgggguuuuaccauguuggccagucuagucuagaacuccugaccucaggugauccgcccgccacaggcuccuaaagugcugggauuauaggcgugagccaccacaccuggccuggaauagcauuugcuuuagaauauucucugucucucucucucucucuggccuggaauagcauuugcuuuagaauauucucucucucuuuuuuuauuuuuuauuuuuauuuuuuuuuuuguccauagucccuaagcccuuucugggcugaaaccuagaccaccgggcuuucccaagcccacucuggguguuccugggccuccguccuuuugaggaaacaguggguaccuugcaaaugggagcucuugcaaucaauaucgcagaaccuugggaucuuuccucugucucaguucuaguugcucauuuucugugagcauuugcauuacaacgcuucuuauuuauucacuuguccauuuaacaaauauuuacugaauuucuuuugugcuaagugcuaggaauauagugaugagcaagacagacaagaucccuuccuuaugaaucuuacauucuugagggaggaaaacaauaagugaugcaaauaaacuaagauaauuucagauaaugauauuuucuauaaagaaaccacaaaguauuaagcccuuaaucagcuuaaguauuaguacuugaguauuaauccauuccaaauugaaccuaaugccuguugcccuaaagcagugguucuuaaaauguggauuccugaauauaguugucagauaaaauaugggacauccgguuaaauuuaaauuucagauaaacaguguuuuuaguauguguacaugccauguaauauuuggggcacauuuauacuaaaaaaaguauuuauuguauaucugaaauucaaauuuaacugggcauccuguauuuuuauuugcuaagucuggcaacuuuaucccugaggcccuuuuaggaguugccugaguucaaaaauauuuucugauaauacuaagugauuaauugccauuuuucacuguguugacauuugcacuguuggugcagcagcauugaggaguagaacuacuuguaucuuagcaagaaucaaggcagaggcaauaaauuacuaguagaugucacaauaaaaaaauguuuaaugccauuugaacuuaagaacuuccuuuaugaagagauaaaaauuauuaauuuuguuaacccuugacccugaguacgcaccuuuuuaguauucugugugacaaaaugggaagcacacaaaaagugugucugccccaugcccaagugugaugaacaaucuuguguaauuguucaaguuggacugagcuagccacuuuuuucaaagacaauauuuauuugaaaggaaugacaacuaugguuauuuagaagaaaacaguugauaguguuuauugccaaugaaaaaaauuaaaacuuucaagcaaaaauugaaauuacggaaaacuuugucaucgugagcaugauggcuucucaguacuuaaaaucucuucugauuaaauggauggcaacauucacaaaugugagggccacacgcagcagcucaugccugucaucccagugcuuugggaggcugcggugggagaauggcuugaagccagggguuugagaccaccuggacaauauagcaagaccuugucucuacaaaaaauacaaaaauuagccugaguaugauggcauaugccaagacucuuagcuacucuggaggcugagguggggggaucacuugaguucaagaguucaaaguuauggugagcucugauggugccaccacacuccagccugggugacagagcgagacccugucucuuuaaaaaauuuuuuuggcugugcacgguggcucacaccuguaaucccagcacuuugggaggccgagguggguggaucaugaggucaggagauggagaccauccuggcuaacacgaugaaaccccaucucuacuaaaaaauacaaaaaauuagccagacauggugguaugcgcccguaguccuagcuacuugggaggcugaggcaggagaauggcaugaaccugggaggcggagcuugcagugagccaagauugugccacugcacuccagccugggugacagagugagacucugucucaaaaaaaaaaaaaaaaauuuuuuugauguuguauaauaacgugccaauguuuagaaguucugcauaacucagugaacuggcauuuuucaaaugacuuauaugugauauuacaaaauuaugcauggcugaaaguccauucuacaugcaugauaaaccagugaauguuaauauaaugccacaaaaaguucauuaguauggcuugagucuauguuauaguuaaccuuuaaaaaacuaccacuuguuaaguuuugguguaguaucaaagaaaaauguccacaguuauuugaaaaagccauuuaagucuuccuuuuccaauacgugucugugugaaugcccauuuucuucauacacuucagucagaacaacauauugcaacagaaugaaugcagaagcauauguaagaauccagcagucuucuauuaagccaaacauuaagagauguauaaacauaaagcaaggcuauucaucuuacuaaauuuucauuuuuuguuuuggaaaauagcuuuuucauuuauguagauaaguaauuguuuucuuacuuuuaaaugaauuaauacuaaguuucucaguuuucauuucaaaugugguaauuaucaauguaaguaacccuuguaaacaaacauucuuugggguccuuaaugauuuuuaagaauguaaaggaguacugagaccaaaaguuugaguacuucuguccuuaggcauccauuguauuaauaaauuaacuuuuuccaugcagcuauaauagaaugauacuacuuuugucaauuuuggcuuuuguugccauugcuuuugguguuuuagacaugaaguccuugcccauacauauguaacaaaccugcacauugugcacauguacccuaaaacuuaaaguauaauaaaaaauaaaaauaaaaaauuaaaaaaagaaugauacuacuuuugccccauuuugcaagacuugagaaaauuaucacucaaaucauuuucuguguucugugguuuggaugaggaauucugguugagcacagcuggaaggaauaggcaauuaggggaacaauauuucuuuagauagagugguuaucuauuccugggagacaguauuggaaaugaguccugaauaaagagaggguaucaguuaugggaagauuuggggaaaacauuccuggcaguaggacuagcuauugcaaaggcccugagguaagaacaagguuggcaguguuuacagacuaguggggccugaauuacuggaggagaguaaacaagggaaaguaauaugacaguaaggccagagagauagccaggggccagaucauguugggccuaauugcacugggcaggcagccaugaagaacuuuaagcaaaagagggacgugaucugauuagaaaaagcuaacucagcaugcugugugaggggggagaaaggucuguugggagccguggcaaaaguagagauagggagacaaguuagaagacauugcugcuugugacuagaguucauagcagugaagacagaauuggucauauuuggguucucuguuggagcuugaacuggcaggaugcugauuaacuagauauagggaaagagaaauccaaggugauuccuaggguuuuuuggccugagaggucaguaaagauggggaagacaagucauuagaaggaauccagggaaacauuuagucuuuccuuuacucugaagcagguguccuuggaguuaauaauaacuggauuacaaggaauucuuuguagaaaauaucuugaacauuuuuugccuuucuuaguaaguuugcccaauuauaaaaguuacagcuuuugggccagaugugguggcucaugcuuguaauccuagcacuuugggaggcugaggcagguggaucacuugagcccaagaauuugagaccaaccugggcaacuuggcgaaacccugucucuaccagggugugguggcacauuccuauagucccagcuacucaggagguugagaugggaggaucacuggagccuaggaagucaaggcggcagugagccacugcacuccagccugggugacaggaaugagacugugucucaaaaauaaaaaacaaguuacagcuuuugcuuuagaaaacuuggaaaguacagaaauauauaaauaaaauaaaaauaaccugauaucacagagguaacuacuacauuuuaguauauuucuuucgaaacauauacacacacaaacauauuucuuguuuauguauacaauugacccuugaacaacauaaaguuuagcggcacugauccucugugcagucaaaaauccacguauaagcuuugacuccccaaaagcuuaacuacuaauaacguacuguaagagaaaagaaaauguuaagaaaaucauaacggaucaggcgcgguggcucacgccuguaaucucggcacuuugggaggcugaggcggguggaucacaaggucaggaguucgagaccaaccuggccaauguggugaaaccccaucucuacuaaaaauacaaaaaaaauuagccgggcuugguggugcaugccuguaaucccaacuacuguggaggcugaggcaggagaauugccugaacccaggaggccgagguugcaguaagccgagaugaugccacugcacuccagccugggcaacagagcaagacuucaucucaaaaaaaaaaaaaaaaagaaaaagaaaaucauaaggauaagaaaauauauugaccauucacauaguggaaguggaucaucauaaaagucuucauccuuauugucuuuauguugaguagcagagggauagguggguguggucuugcugucucaggaguggcagaggcggaagaaaaucccuguacaaguggccccuguacaaguggacccuguacagcuguguguacaguugaccuuugaacagaacugcaaggguccacuuguacagggauguauaaguuguucuauguguguauauauguauaccuauguguccggaauugguggguucuuggucucacugacuucaagaaugaagccacggacccucgcggugaguguuacaguucuuaaagacaucguguccggaguuuguuccuucugauguucagauguguucggaguuuauuccuucuggugggguccguggucucgcuggcucaggagugaagcuguggaccuucgcggugaguguuacggcucuuaaggcggcccgucuggaguuguuuguuccucccaguggguucguggucucgcuggcuucaggagugaggcugaagaccuucgcggugaguguuacagcucauaaaggcaauguggacccaaagagugagcaacagcaagauuuauugcaaacagcaaaagaacgaagcuuccacaguguggaagaggagcugagcggguugccacugcuggcuggggcagccugcuuuuauucucuuaucuggccccacccacaucgugcugauugguucauuuuacagagagccaaguggucuguuuugacagggugcugauuggugcguuuacaaucccugagcuagacacaaagguucuccaaguccccacuagauuagcuagauacagaguguggacacaaagguucuccaagucccaaccagaguagcuagauacaguguugauugguguauuuacaaacccugaccuacacacagggugcugauugguguguuuacaaaccuugagcuagacacagagugcugauugguguauuuacaauccccuagcuagacauaaagguucuccaaguccccaccagacucaggagcccagcuggccucacccaguggauuccacaccagggccacagguggagcuacccgccagucccgcggugugugcccacacuccucagcccuuggguggucgaugggacugggugccgguggagcaggggguggcgcuccucguggaggcucaggcugcucaggagcgcacggaggugagggggaggcucaggcauggcgggcugcaggucccgagcccugccccgcagggaggcagcuaagacccggcaagaaauccagcgcagcgccggugggccggcacugcugaggacccagcacacccuccgcagccgcuggcccgggugcuaagcuucucauugcccggcagggccagccggcagcucugaguguggggcccaccaagcccacgcccacucggaacuccagcuggccagcaagggcccuggguagcucugguugccacucgcgccucucccuccacaccucccugcaagcugagggagccagcucaggccuuggccagcccagaaaggggcucccacagugcagcggugggcugaaggucuccucaagugccaccaaagugggagcccagguagaggagguacccagagcgagugaggaaugugagggcugccagcaagcugucaccucucaccuauacauauauacguauacauauauaugauuaggaucauaaucuaguuuuucuuuguuuuuuguuuuguuuuguuuuuuugagacagaguuucgcucuuuguugcccaggcuggagugcaguggcgccaucucagcucacuacagccucggcuggccuuccggguucaagcgauucuccagucucagucucccgaguagcucggauuauaggcauaugccaccacgccgagcuaauuuugguauuuuuaguagaaacaggguuucgccguguuggcccggcuggucuugaacuucuggccucaggugauccaccggccuuggucucccaaagugcugggacuacaggcgugagccaccgcgcccggcuguaauccaguuuuuuuuguuuuugcuuuuguuuuuguuuuuguuuugagacggagucucgcuuuguugcccaggcuggagugcaguggcgcagucuuggcucacugcaaccucugccucccaaguucaagcaauucuccugccucagccucccgaguagcugggauuacaggcucaugccaccacacccggcuaauuuuuuguauuuuuaguagagaggggguuucaccauguuagccaggauggucucaauuuccugaccucgugauccauccgccucagccucccaaagugcugcaacuacaggcgugagccaccgugcccggcccuaguuuuauauucuaauuuuugcuuucaguuugucucugguacuaaaaauauuagaaugaacacccuuauacauagcaaccuuuguuuacauauauaacuauuucccaagguuaaauccuauaaauuguauuauaagucacaggauaugaauguuuuucaggcuugugaugcuuauuaacaauuaucccucccagaaaacuuguaccauuuuaauucccuuaacgguaauuuaggaaaugauacauuucaccacauuuggaacaacaguaaauaccagcuuuuaaaauuucugccagucugauaaguaaagcauuuuaucucuauuuuaaguugcauuuaacuuuauuucauuuauuuacuauuugauuuuuuuugugugugaauugccuguucauuaucuuugcccaaauucauuuacuuuucucauuuauuuguaagagcuauuuguacauuagggcauuaguucuucucuugucauauauguuaaaauugcaauuuuccuaguguaccauuugccuuguaauuuugcuuaguauaguuucuggcagaauuuuuaaaauaaaaguuugaauauaaauguagucaaaucuuucuccuguguuuguuguucauucuacgccacuuaucuuuagaaaaucuuccccauuuaaagaucagaauaaccaacuauauuuuacuguaauuuuacacuuuauuaaacauuaaguagaguguaggcuuuaaguuucuuccucaugguuaugaaaauuuucuaaucaacauuagauauuuucuuguuuagcaccucuagcuuuacuaucaaaauuauuggcauuuauuuuaaagauuccgauugauuccucacuucagguuuuacagacauuucaccagaggaauugaggcuugaauaccauaacuucuuaaccagcaauaacuuacagaguuauguaaguuuguuuccuauuaaucuacugcaauaacagaugagcucuuaauuacugcuuucuuuaucguggcuuguguuuuggcaaaaccgaugaggucuaugaucuuuuuucaggaguaggcuauuuuucuuuucuauauuauuuucauugaauuugguugguuauuaaaaugauaauauauuuuuacuuuaauaauuaggaauauuacuauuuuuauuauaaauuacccaacagucaaucccagaaaugaaacccuuuuaucauuugacagauauuuauugaacaucuguuagguaccaauccagugaugaaugcuagaaaaacaaaguuaaauaagauacagucuguaauacagauuaacauccucauauaucaaauaucaaaaaaaauuaaaaaucuugacuagaauaaguugaguaccugaaggaagcaguuuaaaugcuguauuuuucuguuucuacagucaugaucaugcauuucaacuaguacauguauucaccgcccauccaaauauaacuaacuacgugcugccagguacuugugauacuaaccagaugauacaaggaguugaacgggagagggaacuggagcuggcauaucuuugacaaauaggccaagucaaugcaaauuuugcaagucaugggccauaaaacuguuacauaaaccuuuugugauuuuggcaaagaaguaugugaaguuuuuauugaagaaacuaacuuaaacauacaauauugaacuguuauuuuucugucuuccguuuucagcuaaauucuguccaacguuuaauaaaucaauggaggaacaggguaaaugaacugaaaagucuaaauauaucaacuaaaguagcuuuggugaguaugggagaguuuucuugagggaagugucuuaccuauugcuuuuuugcagaggauauuuuacuuuagauuuggaaagcaaaacaaaaauuuucuaucaagaauuaugauacacacauucccaaaauagcaucacuuaagagucagggucuugaaauaguuuucucuguguuccuuggucagaaaagcagaaauaguuaugcuuuuuaaaagcuuuuuaggguaaaguuuuuaacuuugguagugcuaguuuugaaaauggcaaacuauuacauaaguuuaaguauuuaagguuaucuguauguaaaaagaaauuacuuugaacaguuauaugaaugcacauuuagaauguaauguaucguuuugcgacugaagaacacaguauguuccuugucuuaaacagaaaugccuuuggaagauauauacccaccugucuccaaagaucuauggucccgacuguggcaaguucauuaucuuuguaaauaaaguuaugauguuucuacacccauuaaaaaguucuuaagaauuuuauuuuaaaauaagauauucacauuuauaauuuuaauauuuccaauuucucagaugguuucuacucuguauaaggauaugagaguaaugucucccuacacuuagugaaugguugacagucccaacaccccaccccuuucuuaaauaugugcuuccugaauaacuagacucuugugcaagcuaauuucuuucaucuuuuaguucuuguaaugcuauuugaauuuagugggaccucuuggaaguagucuguccuugugugagagguggcccaccaucaccauggaugagagcugauggagaaaggauaacugaguccaaagaacuguggaacuucccucagggcuggaaggucccugcuccuugcuaacugcccagggccccuuccauagguuagaaugugggacaacccacccauagcugacuuaacauguaucaggaguucaugccuucuuuauacugaaugguaacccauuguauggauauaauuuguuuaucaucugccuguuaaugaauauuacacugagggagagaaaccagaccaaaaaaaaaaaaauaguguagaccaugugauuccauuuguaugaaacucuggaaaagacaagucucauuuguagugauagaaagcagacagagugguugccagggaccaggagcaagaaugcuuuugagggcugggugcaguggcucacgccuguaaucccagcacuucgggaggcugaggcaggcggaucacaaggucaggaguuuaagaccagccugaccaacauggugaaacccggucucuacuaaaaauacaaaaauuagccaggcaugguggcacacgccuguaauccuaacuacucaggaggcugaggcaggagaaucacuugaacccaggagagguugcagucucaaaaacaaaagcauucuuuuuuuuuuuuuuuuuuuuuuuuugaggcagagucucacucugucacccaggcuggagugcaguggugccaucucagcucacugcaagcuccgccucccggguucacgccauucuccugccucagucucccgaauagcugggacuacaggcacccaccaccacgcccagcuuuuuuguauuuuuaguagagacgggauuucaccauguuagccaggauggucucgaucuucugaccucaugauccgcccgccucagccucccaaagugcugggauuacaggcgugagccaccacaccggccaaagaaugcuuuugaggcuuccaaaugaaagaaaucgcuuauguuugcuuuggaugauuaagaaagucuucuugaaaggaaggagcaaauacaaaguuccuugaaaguaggauuaagauuucaguaagcagagaugaaagacauuucuagagcacagaacagcaagaacauaaaguacuuucagggaaugggaaauguuuaauggauuuuuagucauaagcuuuuaauuauauaauaguggaucuacuucgaguauuagacuggguauucuauaaagguccuuuuuaccuaauaucuagauuucuugauaaaugcagaucuacccuuauagacacugaaaaaaauuuaaaaauauuuuucugauuauaauaucugcucauuguagaaauuuagaaaguauaaaaaagcauaaauaaaauuuaaaucaccuguaauuuaucagccagagauaaucacuguuaacuuacuaauguacauuuuuuaugcauauucauauuacuaguugugauuauacuguuuauacaguauuaugucuuauccuuuucaacaucauauuaugggcauuuuccauguuaagcauuuaacuuugccuuuuuuaaugcacuuuuuucuucucuuuucuuuuuuugagucagagucuuacuuugucauccaggcuuucccaggcucaagugauccucccaccucaggcucccaaauagcugggaccacuggcuaauuuuuuauagagaugggggucucgcuguguugcugaggcuggucccagacucauaggcucaagcccuucacccuccucagccucccaaagugcuaggauuacaggugugagccaccacacccagccuuuaaugcacauuuuaaaaacuugaauuuguccauaaaguguauagaaaagauacuggagcacuauucaucaagcacuuuauuauuugcacacuuuuuuuuuucagcucucugauguaaaggauggaguaaaucaagcagcaccugcauuuggauuuggcagcagucaagcagcaacauuuaugucgccagguaagugauaaaguaaugcaggacuucacugauuuagaaaaauuagauuuuauagguuucaaauuacaagccugaaucgccauuuuaaauuaccuucguaaauucuacaaccuuccaucauagagccucaaagcauuugacucauuagacauuugugaaagggaggccagauugggcauguucuuugaaagacacuuaagcuuuagaaguacauuuuaggaaugaguuuucaggaguuucguagaaguacauagcuaugauagcagcaccuuugagaacuuucuugucacuguguauaacagcauagcauuguccucagguagcagcucuggugagguaaguagaaaccaaagugaaagucuauucccuagucccugugguuucuccuugggugaaggucgaucaaggugaaaaugggauuguuagcagaaaagacaggcagcaggcuuuaguggguaguucuagccucucauuuuuacuuuccucaucucguccguccaguaagcuucucaacacugaaacaugacauaaauaagaaaaaaagauagggggaggaaauaauugugacauuuuucugaccguaauagauuuuuguuguuuuuuuuguuguuguuguuguuuguaggcuuuccagucaauaacagcagcagugauaaugcucagaacuuuaguuuuaaaacaaacucuggauuugcugcugccucuucuggaagcccugcugguuuugggaguuccccagcauuuggagcugcagccucuaccaguucagguaucucuacuucugcuccagcuuuuggauuugggaagccugaagucacaucggcugcaucauuuucauucaaaagcccugcagcuuccaguuuuggaucaccuggauuuucaggacuuccagcuuccuuggcaacagguccugucagagcuccaguggccccagccuuuggagguggcaguucuguggcugguuuugguaguccgggcucacauucucacacugcuuuuucuaagccauccagugacacuuuuggaaauagcagcauauccacuucucugucagccucaagcagcaucauugcaacagauaauguguuauucacacccagagauaaacuaacaguagaagaacuggaacaauuucaauccaagaaauuuacucugggaaaaauuccauuaaagccuccaccucuggaacuucuaaauguuuaaaagggcaauuuuaaauacaaaaaagaaugauguuuaaaauugcuuugagugauucauacagagauguauauaugcauacauguauauauucauaaggaauauaagcuuccaucaauagugauuuuaaauuugauuuuuuucuuaacucuaaauauuuaaguaaaaaguaacaaaaacucugcaagcaagggaauuuuuuuguacuguaauuuugaauggaacugaaaaauuaugcacgaauaaaguacuuuucucaugccauacca

SEQ ID NO: 191454 - RNA, 96650 nt, Homo sapiens
gacugggcgagggcccugggccugaggaggcgcggccgccacugcgcccagcgccugcgcgacgccuggcugcugggccccggggcaguucagcccgcgccgcuccugcgggucggacuggggcuguggcgggagagaagaugccgcagcccgagucccagaaggcggcgauccugggcugcgggcaaggcggugaguacccucuaggcggcggccucccggcgucccucagcaccucgagagcugcggcggcggcggcgcgcggggccugggcaggcugggggcggcggcggggcagcgccuggcuccccgcggguccugggcucccgcacgcccccugggcgaggcucgugucuccgggagacgccgcugcccccgcgccucccccagcgucuccugaggcuuguucgcgggcgugggggcgaggaccagggcgcuggccucguuuucgcguauuuaggacggaggcacaccugauccugcagccucccccagcauuuccuaaaaugaaguccagaucaguauuguccacuuuuuaaaauuaaaagugcccagaaauagaauaguucacacauacacaaaacuagggagaauaguguggaaggaaauuuaaucucgggaccccaaaucacuaagccaaagucaagcugggagcugcgucaggcaaaccugccccuaaguuuuguuccuaagacagcugcaaagauaaaaagccacacagcucccucacccuuuggccaggaggaaauucgcuguggaccuccacaucuuuacccugaaacaguuguguggaauugcacccuggcaguguaaauugacagcuugucuucgcaggugaggaacagggacagaacucaagucauccuucugcucaccugagacagaugcaugucugacggcuuccucugcccuguauuuauguaaaaaugcagauucacugagccagacuaaggcacaaguggcuauuccucugccugccccauggcguaaauuguguguucaguaaaaggcagagcagaggcucaaaagaauguagccguuugucucucaucuuacccaugaccuggaagccgccacuuugaguugucccaccuuuccugcccgaacuagucuauaccuguauuugauugaagacucauguuccccuacaauguauaaaacuaggcugugcccccaccaccuuggguacaugcucucaggaucucuugagggcagugucaugggccauagacacucauuucgcucagaauaaaucucuuuaaaaauuuuuuuauuagccgggugcgguggcucacgccuguaaucccagcacuuuggaaggccaaggcgagcggaucacgaggucaggagaucaagaccauccuggcuaacacggugaaaucccgucucuacuaaaaauacaaaaaauaagccgggcgugguggcaggcgccuguaaucccagcuacuugggaggcugaggcaggagaauggcgugaaucgaggaggcagagcuugcagugagccgagaucacgccacugcacuccauccugggugacagagcgagacuccaucucaaaaaaauuuauuuuuaauuuuuguggguacauaguaggcauauguauuuauagguacaugagauauuugauauggcauagaaugcauaaucacaucaggauaagcaggguauccaucuucucaagcauuuauccuuuguuagugcuacaaacaaccugcaaggcucuuguauugguuugaaccccgaugacgcaccaacaacccccacgacaugaggcgguguggagcaacaugcuguuuuaauaagcgccugggugcagacggguuuaugccuaaauggcaucagccccaagugaggaauggguuuuauaauagcaucagccccaagugaggaagggguuuuauaguccucuguaagcaggaagugucccagucugacguggcugcugcguaaauguguccggaauugguuccuuccaguggauucuuggucucgcugacuucaagaaugaagccacggacugucgcggugaguguuacaguucuuaaagaugguaugucgagaguuuguuccuucugauguucagauguguccagaguuucuuccuucugguggguucguggucuugcugacuucagggaugaagccgcagaccuuugcagugaguguuacagcucuuaaagguggcacgucuggaguuguuuuuuccucccaguggguucaugagcucacugacuucaggagucaaccugcagaccuucgcagugaguguuacaggucuuaaagguggcaugucgagaguuguuuguuccucgcaguagguuuguggucucacugacuucaggagugaagccacagaccuucacagucaguguuacagcucauaaaguuagugcagacccaaagagugagcagcagcaagauuuauugcaaagaaugaaagagcaaagcuuccacagcauggaaggggacccgagcagguugccgcugcuggcuccaguggccugcuuuuauucccuuauuuggccccacccacauccugcugauugguccauuuuacagagagcugauuaguccauuuuagagugcugauugcucuguuuuacagagugcugauuggucuguuuuacagagugcuaauuggucgguuuuuacagagugcugauuggugcguuuacaaaccuuuagcuagacacagagcgcugauuggugcauuuacaauccuuuagcuagacagaaaaguucuccaagucugcuacccaguuagcuagucacagagcacugauuggugcauuuacaauccuuuagcuagacugaaaaguucuccaaguccccuacccgauuagcuagacacagagcacugauugguguguuuacaaaccuuuagcuagacacagagcccugauuggugcauuuacaauccuuuagacagaguaguucuccaaguccccacccgacccagaagcacagccagcuucaccucucaauccccccccucuaaacaggacaccccaacugcuguugggaauuuggccaaugacugcuguagcuacuuccugcuggauaggggugaagaaggggcccugcaauuguaguguccuccagaggggaacucuuuaggccagugaaagggccagcagguugguccagggguccugguagaaguuuaguugagcucauuuggaguuccauuuguaagaccaucuguagcuugauggucucaauucuagaggaaacaaauuugaaaaggagguuaaaaauacagggcccgaaggcaaguaauagcaagauggcugccacaggaccuagaaaggggagaagccauguuguccaacuccagagguugguguaagaguuugaaaggcgucugauuucagaagccuuuuccuauaaauguuggguggcaucucauacuaucccugacugguuaguguaaaaacaacacucuuccccuaagaaggugcagaguccuccuuucucagcagugaggaggucuaggccucggugguuuuggagagucauugcugccaaagagucuauuuggaauuguaguuacuauccuuacuggauagauuuuguuauuucuugcaaacucucuugagaaauccuuugagagugugguaguaggauaaugaaguagguaaacuggcuauuccaguuccuguagcaguggccauuucuaacccuauagguagggguauuaguuguauggcucugcacugacggacuugagcuuugagggguacugauagggucugauuuccacaagauuagaaguuagaauaauauauguuuacacuguuaacuuuuagcaaacuuuacuuuuguugaaaaccuuguaaguuugggauuucaauuauucuuugcuauuaauaagaccucguucaguccauauuaacuuagaauugauauagauggcuccuuccugauucuguaaguacuuuaagguuuggcugagugcaaacagcucgcacauuugagcaaaccaauuauuaggcaguuuuccuaacucugcuucuacaguucccuuaucauuuacugaauaccccuugugucuuuuuuccuuaaucacccaggaggaaccaucuaugguccuguccugaagggaguuccuccuagaucuggucggaccuuuguaugguaguuaguuaagauuuagauccccuguuaggaaaccugcuggguuaaggauuuuugauaggaaggcuauggguugucaguggccucagugcuuuugggcuacgcccuuguuuacacugacaacaaggugguauuggaguguuacagaguuacagagaaggccuucaauuaucaguuauagguuuuaacuuuacuguggcuuuuaaaggaauaggguguaggguccagccccacagggucgguggguuuuuuccccgugugcggagacgagagaguguagaaauaaagacacaagacagagauaaaagaaaagacaagagguagaggaguagagucuucuguaaacucccacggggaaagggagacucccuuuccuggucugcuaaguagcggguguuuuuccuugacacugaugcuaccgcuagaucacgggacgcugguguuaccacuagaccaaggagcccucugguggcccuguccgagcauaacagaagccucaacucuugucuucuggucacuucucacuauguccccucagcuccuaucccuguauggccugguuuuuccuagguuaugauuguagagugaagauuauuauaauauuggaauaaagaguaauugcuacaaacuaaugauuaaugauauucauauauaaucaucucuaugaucuauauuuaguauaacuucuuauuuuauauauuuuauacuggaacagcucgugcccucagucucuugccucggcaccuggguggcuugccgcccacaauaggguacacuguuuuuucuuuacuacuucuaucucucuuucucuuugaugacuucuuugucucucugagucccucuuugucugucucuuccucucucucuuugccuuucuaugucucucucucugacucucucuuugucucugucucuuugacuuugucucuuucuuucucucugacuccuuugucucucacuuccucucucugugucucucucugauuuucuguuucuuucucucuuuccuuucugcuggucuuucccuuccucugccagccacuuaugcugcuguucuccccucuccuucccguuuugauggcuuuggcaguguaagacugccaccuccuuggguuuuugcacugcaugcaauaacuccaugguuuccuugugguauuuaauggggguucccccagagguuagaaacucccuuucuuuccauauugcagcacaggcauguaggauuagauaagcauacuugcuaccuguauacacauuuauucuuuuucccuuucccaguucuaaggcucagguaagugccacuaguucuccugacugggugcugguccuugggggaggaggcuuacuuucaaguacgguuacgucacuaacuauggcauaaccugcccuucguaucccauucuccacaaaugaacuucuguugguauauagauuaaggucaggauuagcuaaggggacuuauaagaggucaucucaggcagcauaagucuggacuauaauuuguuggcagucaugcucgauugguuccccauccucugggagaaaaguggcaggguugagggccacgcauguauguauuugaagcaccggucccucaaggaguagugccugguaucuaaguaggugguugucugauagccauaaacucccuuuggcacuuacuaugccauuuacaucaugaguaguccagacagugagauccuuuccuuguauuauuuugauagccucugacacuaggauggguacugcugcaacuacccuuaaacagugaggccagccuuuugcuacuacaucaauuuccuuaccuaggugugccaccaguugucagacacgagucugaguaaggacuccaagagcuaucccugcucucucugugauguauaaagagaaguuuuguccugugggaaggcuuaaagcuggagcuuguacuagggccugcuuuaagguuuugaaggcuguuucugccucugguucccauucuacuagaugaguauuugcccucugggucuccuugauuagaguauagaggggccuggcuaucuugcucuaucuggggauccauaguuggcaaaagcggugauuugaaggaacccccacaacuguuuuaaagucuuagggugaggauaagccaguauaggcuguauucguuccuugccaaggguccuggucccucuggcuaagauuaggccuagauauuugaccugcuguaggcaaagcugggccuuugaccuagaugccuuguacccuugauuagcuagaaaauucaagagaucuagaguagccugcuggcaugaggcuuccgaacugguagccaaaaguaaaucauccacauacugaaggaccagagugccuggacuugagaaguggccuagaucuugggccagugccugaccaaacagaugagggcuaucccuaaacccuuggggcaagacgguccauauaaguugggauguguggucugugggauccucaaaggcaaagagaaacugggagucaugggagucauagugcaggggaauacagaagaaggcauccuugagguccagaacagggaaccauucugcuuccucugguauuugagagagcaggguauagggguuggguacaacuggauauagaggaauuacugccucacugaugagucuaagaucuugcacuagacuccacugaccguucgguuuuuguacuccuagaauugggguguugcagggacugcugcauuucuuuacuaagccuugagcuuuuacauguuuaacaauauccuguaauccuuuaugagcuucaggccuuaagggauauugccuuugauaaggaaauguggugggaucuuuuaaccugauuuggacugggcaggcauuuuuugcccuuccaaauuguccuuccaaugcccagacuucaagguagauuccuuccucaaguaggugacaccaaauggguaacuuguuccccauauucauguagauaauagcuccagcuuuggcuaacauaucccucccuaauaagggugugggacuuucaggcgugacaagaaaggugugugaaaagagcaaagucucccaauuacaacugagaaggugggagaaauaccugguuacaggcugucccaggauuccucggaugguaauggaccuugaggacagucguccgggacaggagauuaacacugagaaggccacgccaguguccaggaggaagucaauuuccuggccuucaaugguuaaauguacccggggcucagugagggugaugacaugagcuggcgcuugcccgaggcacccucaaguccuguuguuggaucaucugguugggggcuucugacccagagaaccuuuguccuccggggcagugcgccuuccagugauugccucggcauagcggacauggaugaggggguggcuuguuucucguuggacaaucuuuuuuaaaaugucuuuguaaaccacacugauaacaagcccuaccgggugauuggccugcuccauuuucuguccuuucugaaccaccaaagguuuguuugucugagggccaugacuaaggcugcagccuuucucugaucucgcuuuuccuuuugggccuguuccucuuggucccuauuauagaacaccaagguugccagguuuaauaaugccuccagauuuuguucagggcccagggcuugcuuuuggagcuuucuccugauauccacggcugauuggguaacaaacuuauauuuuacaaucaauugacucucaagugagucuggugacaggggaguacauuuucuuaaggccuccuguagccacuuaaggaaggcagaaggauuuucuuccuuuccuugaguuaugguagacaucauugaauaauucaugggcuuuuuccuaauucuccuuaguccuucuagaacacaggucaacagauguuuacgacuccaguccccaugaucugagucaaggucccaguggggauccauacuggggauggcuugcuuaccaguagggaauuugucccuuucuucagcugucauucugccauuuacuugacuaagguaccagguaucuccaaacucucaggcugcagcuaaagccgcauucuuuucauuaaaggccuggguuugaucuaacaguagcaugacaucucuccaagugacaucgaagguuugcccuagaccauguaggacaucuguguaccuaucaggaucaucugaaaacuuacccaggucugccuugaucugcuuuaaaucagagagggagaaagggacauguacccuaguugggucaaauucccucucccuacaacuugaaggggacauaaccgauagcccagggguuuuugugguucuuuggagauuucuuugcuuauuuccuucugggcaggggagauuagaggaggcuuaucauuaauaggaaggguagcuauagggaggauaggauauggggguaagcugagagguccuccuaugggauguaaauugcaaacuuugcauaguuguguauucuccuucaaugaaaagaaagcuuggacauaagguguuucacuccauuugccuucccucuuacagaaaaggucaagcuucaggauaguauuguaauuuauacuucccucagguggccauuuuuccccaucagagagagaauaugggggccaggccauagugcgguaaaaaugagccaccucuuuuucaggguuugcgggucaaauuggucccaguggcuuaggaugcauuucaagggugagccuguugaugccugauuguuucccaucugaaagacaaaaccgcccgcaguuuugguuuguuuguuucucccccugcccaagaacccacaauggucccugaacccugcugaucggaauaguugcacucaccgaugcagcagcagaaacaccucuugcccaagaacccacaacggucggucccuggacccugcggaugggaauaguugcacucacugacgcagcagcagaaacacuaguuuuccuccuagaccacaaggaggaccgaggaaggucggauuuaguggcccuuaccaaugcauucucaaaaaucugcacccuugccuguccuccuagaccacaaagaggaccgagaaaaauuggauuuaguggcccuuacugaugcauucucgaaaaccuguuaggguccuaagcauucuccaguuaguauugggacuuuaccccuccuguaaagauguuaugccccaaaaaugaaguggagggccauauccugagggaggggagggaucuccagaguuggaagagugaugccuuuuuguccgcacuuauaugaauacaagaaugucauuucugaagcuccccguauccuagcuucuggaauagcuuuuguuaggccugcuagucugaggagggauccuaaaauuccggauaagacagucccccacccugauggggcuuugggcaaaaauuaugucuuucuaauuggugagcccgggugccuaaagaagguuaacagaguccuggaguuuauacuagaaaugauucuuacaggagaaacuagaaaagcaccagagacagggagugguuuccagaagcgggacuagccucagagaagagaggcaagagaaaguuuuucugacaagcauuaggacccaggaggcaagggucaggauagguaggauagaugggcgagucucgcuugggcaacaugacuucgagaguucugcucauggccacagggucaaccaacuuguugucaggaccccggagcugaauggcuuuccucucugucgacccucggcucagcccggaaguacaggaaaagcggaaagcugguuccaggcaaaccaacacucccaacuccgaagagucagggguuguuagagagcccuaucccggaaagccugacacccgugucuuuaguccagcggcugugcuagucaguuuuaacuggccgcuagucacuuuuaacuggccgacaggugccugguauuuagccaccgaauucuaagggaaaacaggacagaauagcaagugaaaggggucagaugguacucacugcuuggcaauagcgucagccccaagugaggauggggaagggguuuuacaguccucuauaagcaggaauugucccagucugauguggcugcugcguagugcccgcuggccucccucuugaucuucagggggugucuucugcccagcucucuucuugcuucugcuaacuugcugaugcaugcugcuggcgcaacuguccuugcgcauuuggacugggcuugaagagggaggaaguauucauucccuuaagcuuucaggcuugggggagaaucuuucacaacccaaugauacucuuuuaaaguuacuuuaaaaugugcaauaaaguuuuguugacuguagucaugcuguugugcuaucaaauacuagaucuuaugcauucuauuuaacuauauuuuuguauacauuaacugucucuccccucacucccuucucagccucugguaaccauuaucuagucucucucuccgugaguucaauuguuuuaauuuuuagcuuccacaaauaagugacaacaggcaaaguuugucauucuguguaccuggcuuauuuuacuuaacauaaugaccuccaguucuaucccuguuguugcaaaugaugggaucucauucuuuuuuuauggcugaauaguacuccauuguguauauguaccauguuuucuuuauccauucauuuguugauggacauuuagguugcuuccauaucuuggcuauugugaacagugcugcaggaaacaugagacugcagaccucuuugguauacugauuuccuuucuuuuggguauauacuaugagugggauugcugagucacgugguagcucuauuuuuaguuuuuggggauccuccaaacuggucuccauagugcuuguacuaauuuacauucccaccaaugguguaugaggauucccuuuucuccacauccucaccaucauucauuauugccugucuuuuggauauaagccauuuuaacuggggugagaugauaucuccuuguaguuuuguuuugcauuucucugaucagugauguugaucaccuuuucauacaccuguuugcuauuuguaugucuuauuuugagaaaugucuauucagaccuuugcucauuuuuuaauaggauuauuagauuuuuuuccuauagcauuguuugaguuucuuauguauucugguuauucaucccuugccagauggauaguuugcaaauacuuucuccuggucucuagguuucucuucacuuuguuguuccuuuguuguacagaagcuuuuuaacuugaugugauaccauuuguccauguaugcuguggugggguauuacuccagaaaucucugccuaguucaauguucuggagauuuucuccaguguuuucuuuuaguaguuucauagcuugaggucuuaagucuuuaauucauuucaauuugauuuuuguguauagugagagauagggaucuaguuucauucuucugcauauguauaucgaguuuucgcagcaccauuuauugaagagacucuccuuuucccaauguauguucuuggcacuucugucaaaaaugaguucgcuguagauguauggauuuguuucuggguucuccauucuguuucauuggucugugugucuguuuuuaugcuggugccaugcuauuuugguuacuauagcucuuuaguauaauuugaaguuguaauuugggguuagauaaugugaagucaaguaaugucauuccuucaguucuguuguuuuugcucagauagcauaggcuauucugggucuuuuguuauuccauauaaguuuuaggauuuuuuuuuucuauuucugugaagaaugucuuugguucauugguauuuugauagggauugcaucgaaucuguagguugcuuugggugguguggacauuuuaacaguauugauucuuccaguuggugaauguggaacaucuuucuuuuugugcgugcaugucuucaauuuuuuuuuuccuuccuuuugagagagucuugcuuugucacccagguuggagugcacugcugugaucuuggcucacugcaaccuccaccuccuggguucgcaugauucuccugccucagccuccugaggagcugggauuacaguugcccaccaccacacccggcuaauuuuuguaauuuuaguagagaugggggucucuccauguuggucaggcuggucucgaacuccugaccucaggugagcugccugccucagccucccaaagugcuuggauuacaggucugagccacugugcccagcccgucuucuucaauuucuuuuaucaguauuuuauaguuuucauugcagagaucauucacugccgagaccagcugggucauggagacccuuacccagcggcgcuagaggaauuaaagacacacacacagaaauauagaguguggaaugggaaaucaggggccucacagccuucagagcugagagccaugaacagagauuuacccacauauuuauugacagcaagccagucauaagauuuacuauaaguauuccuuaugggaaauaaagggaugggcagaaauaaaggaaugggcucuggcugcuuaccugcagcauaaguauguccuuaaggcccagaucgcuuaugcuauuguuugugguuuaagaaugccuuaagugguuuuccacucugggugggucagguguuccuugcccucauuccgguaaaccgacaaccuuccagcauugcgucaaggccaucacgagcaugucacagugcugcagagauuuuguuuauggccaguuuuggggccaguuuauggccagauuuuggggccuguucccaacaugucccccuuuguuuugcaaagugauaaaagcaaaggcagguuugucauggugagcuacuucuugcaggagucaggauccacaucugcagaguacacaaagacaacacagauuaaaaggacgaucauuguugaaaucacagagcuuccaaguguuuuucuccauuugaauagguuacuagcugcuaaucugucugcagcuccuucgagcacucuaguuccuggcauuaaggucaaguguggcugugaugcuuuaaauauuuguucuuuuaauuuugcaauauccaaagacaaguuuguagaguggccuucuagaugcuuuuuuauucuuuccuaaauuuugauuuuauuaagagcuauuaauaauuuccacaaauccuuguuuagcuccuacaaugggccauaucauuugagguugaggugccacuauacugccaugguuccagauaauaggaacucuugucauacuucuuaccauuucuaccaucugaccauuuuguucagaccagcugaacauaguguggccauggcacgcagacugaggugcaauucaagcuaaacauccccuaggggaccaaucaauuccauaggaaucacugcacagcaccucugccuguucugcaaugcaauuuuccuaaacaaguauguucauuuuuucuugccagguucaauuuuauuuauaaauagguuuuugagggugguaugccucaauuguaggagcagauucauuaugguaaauacugagaucagaaagcauguguaacugugucauagagugauugcauccaggcauuguugccagccaagauggauaaauaugcccaauaaguguaauuguucucugugucagcccuuguugaaggcaguggugaucaccgcuaucauuaaauuauucauugugacugguugucccgcuuuccucagguuuucuuccgccaucugugacagcuucuugaucuguccccagguggguggcuguguucgauggguguugcucaugacaguuggcauccuccucagcgucagucuugacauggcugcaaccggggguccucgggauucuccuggaaucuuuuccccagcaucuggcuuaugauaagguuucagguguuuugaugguauccaaaucggcuguugauuugguccuggagaaacacaagcauaaccucuaccccaaguuauuauuuuaccuauuucccgacuuuuuguuauugggucucuccaccaaaccaguuuuucugcuucugucuuugcagcugauuucuguagaugcuguucagcugcugauagcaucuggccuuuaggcaggcucaaaaaauuuaaaguuaagaaugcuagauucaauuguaugcgggcuguccuguaauccauuucccccuuucuguuuuugcaacugccguuucagggagagauucauucuuuccacuauggcuuguccuugagaauuauaugggauaccaguaauguguuuaauauuccauauagagaaaaauguagcuagagcuuggcuaguauagccugggguauuaucuguuucaauagaagcuggaaugcccaccacugcaaaauacugcaagaggugacguuuaacacaagcagaagacucuccugauuggcauguagcccagacaaagugagaaaagguguccacacauacauguacauaaacuagucucccaaacgagggaacaugugugacauccauuugccaaagagaauuagguuccaguucucgagaauuagcuccuccuguaaaagaugaggaacgcaccacuuggcaaguugggcaucgcuggauaauagcuuuagcuucuuuccagguaaugcuguaucugcguuugagaccagaggcauuaacauggguuaaauugugaaagugucuagcauuagauauuacuuuagcaacaaggcgaucagccauuugauucccuucagucaaagguccuggaagagauguauaagcccuaaugugagugauguaaaaagggugcauucuacuccuaacugcugcuugcaauuggguaaauaaaguaaucaguuguucaucuguaugaaaucauaacugagcauuuucaauuaacuguguggaaugaaccauguauaaagaaucaaaucacauuaauaggcauauuaaaagcagucaauaccucaauuacagcuacgagcucugcuuuuugagcugaaccauagggcaucugaaaaacuuuaccuuuugagccagaauaagaagcuuuaccguugcuagacccaucuguaaaaacauucucagcaccuucaauugguuuaaauuuaguuauucuagggagaauccaauuacuuauugugacugguuguccagcuuuccucagguuuucuuccgccaucuguggcagcuucucgaucuguccccagguggguggcuguguucgauggguguugcucgugacaguugggguccuccucagcgucagucuugacauggcugcaacugggaauccuugggauccuuccggaaucucuuccuuggcaucuggcuuaugauaagguuucagguaucuugaugguauccaaauuggcuguugauuugguccuggagaaacacaagcauaaccucuacuccaaguuauuauuuuaccuauuucccaacuuuuuauuaucgggucucuccaccaaaccaguucaaaaauucagacaguuuuguuuuaggaaaaugguuaucgagaauacccacaaagucagcuaaauggguuugccaaguaagacuauuuauaaaagcuugcuguauuugugccuuuaugaggacaauaauuuuuccaggaucauauccauguaauuuaacaauccgaguucugccauuuccuauuauaucacuaucagaguagugacuugauccaaauaaggaguuagaguccaugaauuagcauguggaagaaaaagccauucuaaguccagcucuuggacaguaacaccaguaggugaaugcugaguuggaaaaauuagcaaaucuagagucuucucuggaucuauucuauuugagcuuuauggacuugcuuuucaaucagcuguaacucugccucagcuuccuuuguuaauugccaagggcuagugagacuaggaucuccucuaaggauagaaaauagauuacucauggcauagguaggaaugccuagagcaggucauauccaauuaauguccccuaguaauuuuugaaagucauuuaauguuuucauuugaucccuacguauggcuacuuucuguggcacaaugguagugucauuuacuaagguccccaaguaggaauaaggaguaguagucugaauuuugucaggagcuguaauuaagccagcaggagaaauugaauuuugcaagugaucauaauauuggaguaauauuucuugaguggaggcagcacaaaguauaucaugcauauaauggauaauguaacacugaaauuuuuuuaugaguagguucaauugcuugcccuacauauaucuggcaaauuguuuaacauaccuuguggcaacacuuuccagugaaaacguuuagcaggcuuaagcugcagauuguuuacugcaagaauuguaaauacaaaccauucacaguccugcucagcuaaggggauaguaaagaaacaguauuuuaaaucuaugacuauuaaaggccaauuuuuuggaaucauagcaggagaaggcaaucuuggcuguaauguccccauagguuguauaacugaauuaauggcucuuaagucaguuaacauuuuccguuuaccugauuuuuucuuaauuaugaaaacuggagaauuccaaggggaaaauguuggagcuaugugucccuuuuuuaauuguugaguaauuaagucuucuaaagccuccaguuucucuuuacucagcggccauuguucuguccaaauuggcuuaucuguuaaccauuuuaaagguauagguucuggaggcuuaacaauggccgccaucaaaaaugauauccuaaaccuuggcaggaacuuugucuuuccacuugaagcgguuccuucaaaccuugcaaauuuuuuccuguucccaugccagggacauaccccauuucaugcaucauauguugacuuugagggcuauauaauuguucuggaauuagaacuuguguuccccauuguuguaauaaaucccuuccccauaaauuuauagguacagaaguuauaauugguugaauagucccagguuguccaucgggcccuucacaaugcaaaauauaacuacuuugauauacuuuaggggcuuuaccacuccaacuauguuaaauugaguggguggaauuggccacgcagacggccagugcuguagagaaaggauugaaauguccgcuccuguaucuaccaaaccuuuaaauuucuuucccugaauaguuauuucacagguaggauauuuaucaguaauuugauucaccuaauaagcugcuuugccuuguuuauuugugcuuccaaauccuccuguucauuuaauuucacuuuuccccauuuccacauacggcacaauuaggagcugugcuauauggucuccaggcuuugcuuuccagggaacagaaguagauguaacaauuugaauuuccccauuguaaucagaaucagugacuccuguuuguacuuguaccgcuuuuauauuuaaacuagaccugccuagaaguaauccugucauccccgcuggcaaggguccaccggcuccuguugggaccuuuugcggggauuccccaggcagaaggcucacagcuuuugugcagcauaaaucuacugcagcacuaccggcuguggcgggggacagacauuguacaggggugagggaauggccugagccagaaaugcccugguuugaaauggggccgggaacuggccccucauggcauuuccccaauuuaaaaggaaaaggcucaaauguagcuauaauauuucccuguuuaucugggggguguacucuaacagggaacugccaagccucuaaaucacccucucaucuagcuugcugaauuccugccugaauagaacugagagcuguugcuugaggugcagcuugaacagucaguggggcaacuacuuuucgcccagugucaucuggaaaagaaagauccggagggucaggcuacucuuuuucuucaaaauaaugaggggguacagaaggguagggaugaaccucucccuccauugccgcuuuaccuuuagcuggcaaacaaaccugcucuguuacuucauuauacucuccuuccuccucaucagugugaaaaguuuccaagguggaaugaaccagagcccacacuugucccauuguuacccugaugcuuccaagcuccccuucuuaccacagggacugcuuaagaguacuuggguguccuccagcuuaguuccacauucuccaacuguugcucuggugacccuuugaccuggguucgagccccacguaugggcauuacuugcugagaccagcuuggucguggagacccuaacccaguggugcuagaggaauuaaagacacacacacagaaauauagaguguggaaugggaaaucaggggucucacagccuucagagcugagagccaugaacagagauuuacccacauuauuuauugacagcaaggcagucauaagauuuacuguaaguauuccuuacgggaaauaaagggaugggccaaaauaaaaggaugggcucuggcugguuaccugcagcaugaacuuguccuuaaggcacagcucgcucaugcuauuguuugugguuuaagaacaccuuaagggguuuuccacccugggugggccagguguuccuugcccucauucugguaaaccgacagccuuccagcauugcaucaaggccaucaugagcaugucacagugcugcagagauuuuguuuaugacuagauuugggggccuguuccgaacaguucacuugguuaauuccuaguauuuaauuuuauuuguggcuauuguaaaugggauuacuuucuugauuucguuuuucagauuguuugcugucggccuagagaaaugcucugauauuuguauauugauuuuguauccuguaacuuuacugaauuuaucaguucuaauaguuuuuuggugcaaucuuuagauuucuccaaauauaagaucauaucaucugcaaacaaggguacuuugacuucuuccuuucuaauuuggaugcccuuuauuuuauucucuugucugauugcucuagcuaggacuucuaguacuguggugaaugacagugaugaaagugggcauccuugcauucuagaucuuagaagaaaaacuuucagucuuccccaauucaguaugauacuaacuguggguuuauuguauauggcuuuuauucuauugagguauguuccuucuauacccgguuuuuugagguuuuuaucaugaaaggauguuuaauuuuaccaaauucuuuuucagcaucaauugaaacgaucauaugguuuuuauccuucauucuguugauuugauguaucauauugauugauuuguguauguugaaccauccuugcaucccugggauaaaucccacuuagucaugaugaaugaucuuuuuaaugugucauugaauucaguuugcuaguauuuuguugaggauuuuuuuuuaucaguguucaucagggauacuggccuguaguuuuauuuuuuugaugugucuuugucugguuuugguaucaggguaauauuggccucgcagaaugaguuugaaaguauuccuuccuccuuuguuuuucuggaauaguuucgguaggauugguauuaguucuuuaaaaguuugauaaaauucagcauugaagccauuagguccugggguuuuccuugcugggagacuuuuuauuacagcuuugaucuuguuacuugcuauuggucuguucaaguuuuggauuucuuaauaguucagucuuggcagguuauauguaucuaggaauuuuuccauuuucucuagguuuuccaauuuauuggcauauaguugcucauaguagccucucaugaucuuuugaguuucugugauauugauuguaaugucuccuuuuucagcucugauuuuauugauuuggggcuucucuuuuuuuucauagucuggcuagugguuugucaauuguauuuaucuuuucaaaaaaugaacuuuuuguuuuguugaucuuuuguauuguuuucuucaucuuaauuucuuuuauuucugcugugaucuuuuuuauugcuuuucuucuaauuuuggguugguuuccucuugcuuuucuucuugcuuucucugcaucuuuaagaugcauaauuaggugguuuauuuggaguuuuucuacuuuuuugauguaggugcuuauugcuauaaacuuuccucuuaguuuugcuuucacuauaucccauagguuuugguauguuguuuccauuaucauuuguuuaaagaaaucuuaaaauuuccuucuuaaugucuuuauugacccacuggucauucaggugcauauuguuuaauuuacauguguuuguauaguuucccaaauucuucuuguaauugauucuaguuuuauucuguuguggucggagaagauacuugauauaauuucaguuuguuugaauuuuuaaaaacuugcuuuuagaccucaaggauagaccuaacauauggucuauccuugaggaugaucuauguguugaggagaagaaugcauauucugcagccauugaaugaaaugcccuguaaguauuuauuagguccauuuggucaguaguacagauuaagucugauauaucuuuguugauuuuuugucuggaugaucuguccaaugcugaaaaugaagcauugggagucuucaguuauuguauugggaucuaucucucucuuuagcucuaauaauauuugcuuuauguaucugggugcucuaguauugggugcguauauauucacaguuguuauagucucuugcugaacugaguucuuuaucauuauauaaugaccuugucucuuuauaguuuuuucuugagauccauuuuguuugauauaaauauagcuacuccugcucuuuuuugguuuccauuugcauggaauaucuuuuuucauucuuuuguuuucagucugugugucuuuauagguuaaguauguuucuuguaggcaacagguuguugggucugcuuuuuuauccauucagccacucugugucuuuugacuggggaguuaguccauuuacauucaauguuauuacugauaaguaagguccuacugcugccuuuuuauuauuuguuuucugguuguuuuguggucugcuuccuucuuaaccuuccuuccugucuuccuuuuagugaaggugauuuucucuggugguauguuuuaauuucuugcauuuuauuuuuuguguaucuaucauauguuuuuagauuugagguuaccacaaggcuugaaaauaguaucuuauaacaauuuuaaaccaauggcaacuuaacacugauugucuaaacaaagaggcaagcaaaaagaaaacuaauaaaaacuacauguuggccaggugcaguggcucauguuuguaaucccagcacuuugggaggcugagguggguggauugcuugaacucagaaguucaagaccagccuaggggcugggcacggugguucacaccuguaaucccagcacuuugguaggccgaggcugggggaucauuugaggucaggaguucaagaccagccuggcuaacauggugaaacccuaucucuacuaaaaauacaaaaauuagcuggguguggugccuguaaucccagcuacuugggagacugaggcaggagaaucacuugaaccugggaagcggagguuguagugagccaaaaucacaccauugcacuccagccugggcgacaagagggagacuccaucucaaaacaaacaaacaaacaaacaaaacaaacaaaacagcuugggcaacauggugaaaccccaucucuacaaaaaaauacaaaaauuaaccaggcauguuagugcacaccuauagucccagcuacuugggaggcugagguaugaggauugcuugagcccaggagguugaggcugcagugagcugugauugcaccacugcacucuagccuggucaacagugacaccgugugugugugugugugugugugcgcacacacacaaguauguauacucuauauauaaauaaguaaauaaauauauuuuaccuucauuacauuuuaacaacaucugcauuuuaacuccauucccugcuuuuaaacuuuuuguuguuucuauuuauaucuuauuguauugucuaugaccugaaaacuuguuguaguaauuauuuuugaucaguucgucuuuuagucuuucuacucaagacauguauggcucacacaccacaaugacgguacucuaauaugcuguguuuuucuguguacuugcuauuaccacugaguuuuguaccuucagacacuuucuuauugugcauuaauguccuuuucuuucagauuuaagaacucucuuuggcauuucuuuuaagauaggucuaguguugaugaaaucccucagcuuuuguuucucuggaagaccuuuauuucuccuucauguuugaagaauauuuuugcgggauauaguauucuaagauaaaaguuuuuuccuucggcacuuuaaauaggccacucuccuggccuuuaaggcuaccacugagaaaucugcugccagacauauuggagcuccauuauauguuauuuguuucuuuuuuguugcugcuuuuaggauuuuuucuuuauguuugaccuuugggaguuugauuguuaaauacauugaagcagucuuauuuggguuaaaucugcuugauguucucauacuuaaauauugauaucuuccucuagguuugggauguucuuuguuauugucucuuggaauuaauuuucuacccccacugucugucuacguccucuuuaaggucaacaacuuuucuuuuucuuuuucuuuuuuuuuuugagacggagucucacuuugucacccaggcuggagugcaguggugcgaucucaacucacugcaagcuccaccucccagguucaugccauuguccugccucagccuccagaguagcugggacuacaggcacccaccaccacgccuggcuaauuuuuuuguauuuuuaguagagacgggguuucacuguguuagccaggaaggggcaacaacuuuuaaguuugccuuuuugaggcuguuuucuagaucuuguaggugugcuucauucuuguuuuuuucuuuugucucuucugacucuguauguucaaauggccugucuucaaguucacuaauuccuucuucugcuugaucuguucagcuguuaagagacugauguauucuucaguauguuaguugcauuuuauagcuccagaauuucuacuugauucuuaauuauuucaaucucuuguuaaauuuaucugauagaauucugaauuccuucucuguguuaucuuuaguuuuguugaguuuccucaaaacagcuaucuugaauuauuuuuuugaaagguuacauaucuagcucuccaagauugguugcugaugccuuauuuaguucauuuggugaggucauguuuuccggaaucaucuugaugcuugaggauguuuguugguuccuaggcauugaagaguuagguauuuaucguagucuucacagucuggacuuuuuguacccauccuuccuggaaagacuuuccauauauucaaaggaacuuggauguugugauguaaauuuuucgucauuguugccauaucugccuuagaugacaccccaagcccaguaacacaguggcucuuuuagacuuauagaggcacugccuugauggucuuagauaagaucuagaagauuucucuggauuaccagguagagaugcuuuuugucuuuccuuacucucuccuaaacaaauggagucucugcugagcuuccuggagcugggggaguggugaaacaagcacugcuguggccaccaccacugagauuacacuggggcagaccugaagccagcacaacaccaggucucaaccaaggcccuugguaaccacuguggcuacugccuauauuugcucaaggcccuaaggcucuauaaucagcagguaguaaaaccagccaggcuuauguccuuuccuucaggauggcaagcuccccucagucuuagguccaguggugccauccuggagccagguccuggaguuggaaaccuuaggaaucuaccuggugcucuauucuacugcggcugagcuggcacccaagccuucccaguccucccucccuuuuucaugagcagaggagucucccccuuagcugccacuguccuagguucauggcaaguacugccuggcuacugccaguguucauucaaggcccaagggcucuucagucagcuuguagugaaugcugccaggccugagacucucccuucggggcagcaggcuccccucuggcccaggacaaguccagaaauaccauccaagagccaaggccugaaaucaaggaccccaagggcccgcuuggugcucuaccccacuguggccacacugauaccuaggcugcaagacaaaguccccuuugcucuucccucuccuuuucucaagcagaagucccuuucuguagccaccacaucugggagugugcugggucacaccugaagccagcacgucucugagucucacccaaagguccaugaugaguauggccugguuaccacugcugaugauuuggggcccaagcgcucuuuauucagcaggugauaaauccugccaguacuagguccuuccguucaagguagcagguucccuuguagcccaggcugugucuagaaauguuaucugggacauuugguguccagggucuggaaugggagcuucaggacuuugccuggugcccuguucuguuguggcagagcuaguguccaaguuguaagagaaaauccuguuuacucuuccgucuccuuuccucaaguggaaggaaagagucuccccuggagcugcgagcugcacugccugggguugagggagggguggugcaagcacucccuuggugguccugcuggugucuuacugggcugcgugcccuccaaguccauuggcuccaagcccagcccagcaccaagacuugcccaggaauugcagucuuuguggucugggcugcuauucaaguuuauuuugaaucccagagcaguuuagcccauggugguaagucuugcuggaacuugaguuuccaccaccaggaugggcaauuccccucuggcuacagcucuaaaugcuuccucugugggcgccagcugaauucugcccccuuuugcuuuccacugugacagggcagcacugaguuccgaugugaaagcccuacaaucccugcccucucccucccccaaacacagagauucucuuucugugccacaggaaugggagagggguggugucagcaauucacgacuuuauccucuucagugccucuugcagugauauuauguuaaaaccaugugauugcucaccugauuuuuaguucuuaugaaggugcuuuguuguguggauuguuguuuaauuugggaagaugauugguggaggcuuccauuuggccaucuggcucugccuuuccuccuagaauuauaucugguuguuuuuuuuuuuuuuuuuuuuuuuuuuucaguaguuugugccagccgggauuuugaccagauccacauuuauuugguugauaugccucuuaaguuucuuuuuuuuucuuugcaauauguuuguuaaagaaauuggguuauuugucuuguacaacuucauauauuuuuaaaaugaaugcuguugggauaaauagaaaaauaucaaggcccccacccuccaauucugguagacuuuaccucuugagggauauuaauaugcucgugauggacuaguuuugcuuauuuuuagcaucaaggaagauuuggucuauuccuuucuacuucacauuaugagaacaguugguugguugguuuuccaaacauaaaaugguauuguaauuuggaauaugcuuuucauacuacucugcacucaccaaaauauucugguauuacucuccucccccaaaucacagauguaggguagacucuucagaauuuuaaaaaaucauguuuuccuuuuccccagaaauacuauauuuugagaucuacucugccuaagcaaaaauaggaaauagaaaaaccucucuuuaugcucaguguguaucacucgaacuuuucaaguuaaauguuaucaagcaguaagugucuguucuucacucugacaauuucuuugcuguuccuuguaaaaaguucuacugcgcuuuuuguugugguaaaauauacauaauguaaaauuuaucauuuuaacuauuuuuaacuguauaauugaguggcauuaaguccauucacaguauuuugucacuaucaccaaaacuuuuucauuaccccaaacagaaaucuguaaccauuaagcaauaauuccccauuuucccagccccuuucuguuugugugaauaugcguauucuagauaccucauauaagcagaauuguacgguauuuauccuguugugucugauuuauuucacauaauguuuucaagauucauccaugcuguaacaugcauuauacuucauucuuuuuuauggcugaauaauauuccauuguguguauauaucacaguuugcuuauccauucauccccuaggauauuggauuguuuccaccuuuuggcuauugggaauacuguugcugugaacauguguucacagguaucugacccguuuucaauucuuuugaguauacuauauacucaaaaguauauuguauauguauacacuauauauuuguauauauuuauacaguauaccuauauauaguggaguggcacugcuggguuauauggcaguuccauguuuaacauauugaggaacugacaaacucuucuucacauuuuaaaaacugcuuucuuaaagaucuucguaccuuacuaguugcuaaaucugauggcucuaccucucuucucaccugucuuagcuucucuauaaaucuuuguggcaccucacauugcugucgauagacccucuuauucuucugcuuuguaauccuucucaggcccuuccuggguucuuccuccuccacacaguccuuaaauguacauguucccagagguucaguuacuuaaacucuccuuugcuauuauuuucguguaacuuaaacuauccuuuugauuuuaaacaccucugucaggccuacauuugaacuugaaucucauaggcauuuccauaucaguguucucucaaaugugacaugucuaaaacaacauucaucuucuguuaauccucucaagcccauucucuccguggucccugucacuaaggcuugaaagcuguauauugauuuuauuaucccuuugucccuugggggcccaugcccuguaaaguugacgagugcgggcaguucuccugcugguccuccuuugcacucacuuucacaguucuaaaucaugcuaugagagcgucuuucuugaauuuuucuaacuauauuucuugguucuagauuuuuuuucccucuguuccaaaucauuuuccacacagcugcuagaauuuucucccuaagauauauuugcuuaaagacaauacccuuuuugcaugcagaacaaguuaauucuucucauccucagcaucagauccccuuccugucuucauauaauuaauuaccuuccaguaaccuuauccugcuccgugauccaucuguauucauuacuacagccaaucauucuacuugcuuuucucuuuggaaaacugaaaauguacagguugcaguuucccaagacuugaacuuucuccuugaaauauuucaguauuuggccauuggaauuuuaauccuuaaagccaacacuuaaaucucaacuuaucuaagaaaucaucuucaaguguuucagacaaaauuaaugucugcauccucauuccauauaguuugcuuauaucuuuauuguagcacacuuugaaguuugcuucaggauaugcuaaaguuuuccaccugauuuauuauuucuuuacgauuuuuuuccuuagagaaaaagauuaccgaccaaaauguguaacgguuuccgaggcccucaugauguugucagacugcuuuuaaaaagcugucugcacuuuggcuggguggcucaagccuauaaucccagcacuuugggaggccaaggugggaggaucacuugaggccaggaguuugagaccagccugagcaacauaaauaaauaaaccuuuugucugcacaaaaauaaauaaaccuugcaauuuauaauuucaucauugauaaguguaucauuuaacuacuauacuuugaauguaaguauuuagaaaaacuuuccuaguuuuuguuagaaaauaguaucuuguuuuuauuugcuuguuuuugcuaauuauauugagacugaagacuuuuccaauguauuuccuuguauguuucucuagugaauagucuuuuuaauauacuuguuccauuaaucuaauacuuuauucauuuaucuaaucccaugacucauuugcuauagauauuuuuucuauuuuuguccuuuugcuuuuuaauuuugcccaucaccuuuugacuuauaguaauagcuuuaauugauuuuuaagauuaauauuuguaaauguuuucuuuaguuuucaauauauuuuuagaaacuuggaaagaguugguaaaaagacaagggaacuucauuauaaauuguauuuuaaaagagaaagcauauauuauccuuacaaucuauugaucaguuaacuuaaaaaucuucaggauaguaaaaaggucuaccucacuuuuuuuuuuuuuuugcuccuuccuguacaccuuccugcacagugaucuuuccauuuuuuuuaauugugguaaaauguagauaacaugaaguuuauaguuuuaaugaauuuuuuucuugucuuuuuuuuuuuuuuuuuuuuuugaggcagggucucaugcuguuucccuggcagaaguggugcaguggcuauggucauggcuuacugcagccuugauuuagugggcucaagugauccuucugcugcaguccgcugaguagcugggaacacaggugcacagcaccaugucuggcuaauuuuuuuuuuuuuguacuuuuguagagacaggguuucaccauguugcccaggcuggucuugaacuccugggcucaagcgauccgcccaccucagccucccaaagugcuaggacuacaggcgugagccacugagcuuggcauguucauguuacucaaucccugagccuauucaugcuauuggaaaggaugcuguguuuguuaggguucuccagagaaacagaacccauaggauguguguauacacacacacaaaugcacacgcacagauuuauuuuaaggaacugacuuaaacgauuguuaggaguguguggagacuagcaaaucugaaaucuguggagcaggccagagacacagggaggaguugcuguugcaauuugaguccaaaggcagcgcgggggcagaauuccauugguauguguucagauuuccuccucuuauaaagacaccaguccuauuugacuagggcucagccuaauggcuucauuuuaauuuaacuauucuuuaaagacucuaucuguaaauacaguuacacucugagguacuggggguuaggacuucaacaugaauuuuuaggaaaacacaauucaucccauaaaagaugccaaauaaucuccugugggauggagugggaggaagcaaaccagcagauauuuucuuaaacucauuuauggaauucauaauuuuguaugaaaugcauuuuauaaauggcuagcaauucacuuuuauuaucugauguuauauuuauaaauugcuagguaauuuauucugucuccaaaguguuuccagaaaauucugacuucucauuucauaauaaguuacgagguauuugguauauauaaagcguguguguguguguguguguguguguguguguguguguguguguguguauauauacauauauauauauacacacaaaguaccagguauuugguacuuuuuguuaagaggauacuuuuuaaauuaaauauuucucaaaaacuagaauuggugcuuauuacuaucuuauucuauaaaguauauaaacucaauauugaaucuuacaaaaauauuaaagucauuagcauuuccuuaccgacaagauuggacuucuaaaaucuugcaucaugggaacuaaaaauucuucuuuuuaaaauaaaacauuuuguuuugugauaauuguagauucacauguaauuauaagaaauaauaucaagagaucuuguguacccuuuaccuaauuucccccaaugguaauaucuugcaaaaguauacuguaauauuaaaaccagaauauugacguccuacacccaucuucccccuuccacaaccccccaaaucccuguuguccucaguucguggcaaucacuaauuuguucucuguuucuauaauuuugucaugugaaggauguuauauaaauggaaucauacaguaaguaagcuuuuaggauuagauuuuuucagucagcauaauucccuugauucauccaaguugucacauuuaucgguaguuuggaaaaugccguuuagaauccagccccagcaucacagaacaggguuucugagacuuggcacuauggacauuuggaccagauaauucuuuguuuuugaggacuguucugugcauuuuaggaugugcagcaucuggggcauuuacccaauggauguuaauaggaucucgccagguauggcaaccaaaaaugucuucagacacugccuaaaguucccgcggguugccacguuuucccagaaauuaccaaguauccuaucccuugggugagaaccacuggaguagaguauagaaaguggacuuggagugaagagacuacaacuuaaccacuggcaaaauccauccucagacuacucugcaugucuacacacccuucuacacacauguccaugugagcauucccuuaccuagagacuacauuguaacauuacaaugaaauuuguauuaaauaaugaagaagcagaaguaaaaagaaaauaguuaacauauacagagacacacaccaaacccaugagaauggacucuggaggcuguguccuuugacuccauggacaagacucaacuaaaucauguggacacauuauaaccucuagaaaccaauaugcauacagaacccugcaccugggugucaggugucaggguuaaaggaacgguaguuuguugggucagauacuuuuuuuuuuuuugagacagguucuugcuucaccuacucaggcuggagugcaguacaugaucacuuggcucacugcagccuugaccuccccaggcucaagugauccuuccaccucagccucccaaguagcugggaccacaggugugugccagcaugcccagcuauuuuuuuuuuuuuuuuuuuuuuugguguucuuuguagcgacaggguuuugcgauguugcccaggccagucuugaauuccugggcucaagcugugugccugcugggccucucaaaguacugggauuacaggcaugagccacugcaccuagcccagauacuuucuuuuuuaaaaagcauaucauggaaauuuucagacaugaagaaaguaauagauuuuaaaaaaucuauuaguaauuuuuuuuuuaaccuauagcccugcccuucuugguuaauugaagcaaaucucagauauuagaugauuuuuccuuuuuuuuuuuuuugagauggaguuucacucuguugcccaggcuggagugcaguggugccaucucgguuuacugcaaccucugccucccagguuugagcuauucucuugucucagccuccuaaguagcugggauuacaggcgccugcuaccaugcccggcuaaauuuuguauuuuuaguagagauaggguuucaccauguuggccaggcuggucucaaauuccugaccucaaaugacccacccgccucagccucccaaagugcugggauuguaggugugaaccaccgugcccggccagaauuagaugauuuuggugaugcaaaauaaucuauguccugacccccguucuuuuuaaaauaaacuuuuaguuuuagcguagccuuagauuuacagaauauugugaagauaguagagaauucccacauaucccauauccaauuuccccuguuauuaacaucuuacauuaauaugguacguguauuucaguuaaugcuaauguccauacuguauucagauuuucuuaguuuuuaccuaaugugcuuuugcuguucuaaggacaauagguaaaagcuaaggcucucaugcaggauaccacacuguauuuggucauugugucuccuuaggcucuucuuggcugugacaguuucucacacuuuccucguuuuugaugacccugacaguuuugagaaauacaggcauaugcuggugauacuguggguucgguucugagccacugcaauaaagggacuaucacaaagugaaucacacacauuuuuugggggggugcauauaaaaguuauguuuacacuauaccguagucuuuuaagugugcaauagcauuauagcuuaaaaaaaaagcccaaugugcaugccuuaauuuuaaaaaugcuuuauuguucaaaaaugcuaaugaucaucugagccuucagugagugguaaucuuuuugcuggugagagucuugccuuaacauugaugccugcugaugcuuccugaagguuaggauggcuguggcaaguucuuuuuguuuuguuuuguuuuguuuuguuuuuuugagauggagucuugcucuguugcccagguuggugccaucucggcucaccgcaaccucugccucccgguucaagcgauacuccugccucagccucccgaguagcugggacuacaggcaugcgucaccauacccggcuaauuuuuuuguauuuuuaguagagaugggguuucaccauguuggccaggcuggucucaaauuccugaccucaaaugauccgccugucucggccucccaaacugcugggauuacaggcgugagccacugugccuggccaaguucuuaaaauaagacggaaguaaagucugacucaucgauugacuuuccauucaugaaagauuuuucuguagcuguuugauagcaauuuacccacaguagaacuucuuucaaaauuagagucaauccucuaaaacccugcugcuacuuuaucaacuaaauuuaguaaucugcuuuuuguuaucguuucaacaguguucacagcaucaucaccaggagcgauuccauuucaagaaaccauuuauuugcacauccauaucuuccgucucuauuucuaauucugguucucuugcuauuuccacccuaucugcagugacguacuccacugaagucuugaaccugucggucaagguuggaaccaacuucuucuaaacucccguuaauauugacauuuuguaguucuggcaaauguggaauaaaaaaauaaaugauauuuugaccuccucgaaugaauggguuuuuguuguuguuguuuugugagauacaguuuugcuuugucacccaggcuggagugcagugcugcagucauagcucacugcagcuucaaacuucuggguucaagcaguccucccgccucagccucccgaguuguugggacuacaggcaugugccaccaugcccaacuuuuuuuuuuguauuuuuuuuuuguagcgauugggucucacucuguuguccaagcuggucuugaacucuaggccucaaguaacccucccaccuccaccuccaaaagaguugggauuacaggcaugagacaccauaccuggcuauaaauguucuuaauggcaucuagaaugauaaagcuuuuccagaaaguuuucaauuuauuuugcacagauccaccaaaggaaucacugucugugacagcuauagucuuacgcaauuuauuucuuaaauaauuagacuugaaaguagaaauuacuccuugauccaugggcugcagaauggacaguguguuagcaggcaugaaaacaacauuuaucuccuuguauauauccaugagaguuuuggggugacuagguauguugucagugagcagugauauuuugaaagcaaucuuucugauuaguaggucucaacagugggcuuaauauauucaguaaaucaugcuguaaaacagauguucugucauccaggcuuuguuguuccauuucuagagcacaggcagaguagauuuugcauaauucuuaaaggcccugagauuuucagaaugguaagugagcauuggcuucaacuuaaagucaccagcugcaucagccccuaacaagagagucacccuauuuggaagccggacauugauaucucuagcuaugaaagguucuaaauggcaucuccuuccaauagauggcuguuuagucugcauugaaaauauauuguuuaguguagccauccucaucagugaucuuagcuagaucuuuuggauaacuugcugcagcuucuccaucagcacuugcugccucaccuuacacuuuuauguuguggagaugauaucuuuuuaaaccucaugagcaauucuuugccaguuucaaacauuucuucugcagcuuccuuacuuuucucagucugcauagaauugaagagaauuagggacuugcccuaagacugguuuaaaggaauauuuuggcugguuugaucuucuaucuggagcacuaaagcuuucuccauauccgcauugaugcugugucacuuucuuauuccuguguucacuggcauagcacuuuuaauucccuucaagaauuuuccuuugcguucacaacuuggcuguuuggugcaagaggccuagcuuucagcccaucuuggcuuuccacaugccuuccucacuaagcuaaauuacugguaguuuuuuuuuuuauauauauauacuuuaauuucuaggguacaugugcacaacgugcagguuuguuacauauguauacaugggccauguuggugugcugcacucauuaacucgucauuuacauuagguauaucuccuaaugcuaucccuccccccccuccaccccacgacagacccuggugugugauguuccccuuccuguuuccaaguguucucauuguucaauucccaccuaugagugagaacaugcgguguuugguuuuuuguccuugcaguaguuugcugagaaugaugguuuccagcuucauccaugucccuacaaaggacaugaacucacccuuuucuauggcuguauaguauuccaugguguauaugcgccacauuuucuuaauccagucuaucauugauggacauuuggguugguuccaagucuuugcuauugugaauagugacacaauaaacauacgugugcaugugucuuuauagcagcaugauuuauaauccuuuggguauauacccaguaaugggauggcugggucaaaugguauuucuaguucuagauccuugaggaaucaccacacugucuuccacaaugguugaacuaguuuacagucccaccaacaguguaaaaguguuccuauuucuccacauccucuccagcaccuguuguuuccugacuuuuuaaugaucgccauucuaauuggugugagaugguaucucauugugguuuugauuugcauuucucugauggccagugaugaugagcauuuuuucaugugucuauugucugcauaaaugucuucuuuugagaagugucuguucauaucuuucgcccacuuuuugaugggguuguuuguuuuuuucuuguaaguuuguuugaguuauuuguagauucuagauauuagcccuuugucagaugaguagauuguaaaauuuuucucccauucuguagguugccuguucacucugaugguaguuucuuuugcugugcagaagcucuuuaguuuaauuagaucccauuugucaauuuuggcuuuuguugccauugcuuuugguguuuuagacaugaaguccuuggccaugccuauguccugaaugguauugccuagguuuucuucuaggguuuuuaugguuuuaggucuaacauuuaagucuccaauccaucuugaauuaauuuuuguauaagguguaaggaagggauccaguuucagcuuucuacuuauggcuagccaguuuucccagcaccauuuauuaaauagggaauccuuuccccauuuauuguuuuugucagguuugucaaagaucagaugguuauagaugugugguauuauuucugagggcuuuguucuguuccauuggucuauaucucuguuuugguaccaguaccaugcuguuuugguuacuguaggcuuguaguauaguuugaagucagauagcaugaugccuccagcuuuguucuuuuggcuuaggauugucuuggcaaugugggcucuuuuuuggucccacaugaacuuuaaaguaguuuuuuccaauucugugaagaaagucauugguagcuugauagggauggcauugaaucuauaauuaucuugggcaguauggccauuuucacgauauugauucuuccuauccaugagcauggaauguucuuccauuuguuuguguccucuuuuauuucauugagcagugguuuguaguucuccuugaagagauccuucacaucccuuguaaguuggaucccuagguauuuauucucuuugaagcaauugugaaugggaguucacgcaugauuuggcugucuguuacugguguauaaggauccuugugauuuuugcacauugauuuuguauccuaagacuuugcugaaguugcuuaucagcuuaaggagauuuugggcugagacgaugagguuuucuaaauauacaaucaugucaucugcaaacagggacaauuugacuuccacuuuuccuaauugaauacccuuuauuucuuucuccugccugauugcccuggcgaggacuuccaacaguauguugaauaggaguggugagagagggcaucccugucuugugccaguuuucaaagggaaugcuuccaguuuuugcccauucaguaugauauuggcuguggguuugucauaaauagcucuuacuauuuugagauacaucccaucaauaccuaauuuauugagaguuuuuagcauggagggcuguugaauuuugucaaaggccuuuucugcaucuauugagauaaucgugugguuuuugucuuuguuccguuuauaugguagauuacguuuauugauuuucauauguugaaccagccuugcaucccagggaugaagcccacuugaucaugguggauaagcuuuuugaugugcugcuggauuugguaugcaaguauuuuauugaggauuuuugcaucgguguucaucagggauauuggucuaaaauucucuuuuuuuguugugucucugccaagcuuugguaucaggaugaugcuggcuucauaaaaugaguuagggaggauucccucuuuuucuauugauaggaauaguuucagaaggaaugguaccagcuccuccuuguacuucugguagaauucaacugugaauccaucugguccuggacuuuuuuuuguugguaggcuauuaaguauugccucaauuucagagccuguuauuuuccuauucagggauucaacuucuuccugguuuagucuugggaggguguauguguccaggaauuuauccauuucuucuagauuuucaguuuauuuguguagagguguuuauaguauucucugaugguaguuuguauuucugugggaucgguggugauauccccuuuaucauuuuuuauugcgucuauuugauucuucucuuuuuucuucauuagucuugcuagcggucuaucaauuuugcugaucuuuucaaaaaaccagcuccuggauucauugauuuuuuugaaggguuuuuugugucucuaucuccuucaguucugcucugaucuugguuauuucuugccuucugcuagcuuuugaauguguuugcucuugcuucucuaguucuuuuaauuguauguuagggugucaauuuuagaucuuuccugcuuucuuuugugggcauuuagugcuauaaauuucccucuacccacugcuuuaaaugugucccagagauucugguauguugugucuuuguucucauugguuucaaagaacaucuuuauuucugccuucauuucauuauguacccaguagucauucaggagcagguuguucaguuuccauguaguugagcgguuuugagugaguuucuuaauccugaguucuaguuugauugcacuguggucugagagacaguuucuuauaauuucuguucuuuuacauuugcugaggaguacuuuacuuccaacuauguggucaauuuuggaauaagugugaugugcugagaagaauguauauucuguugauuuuggguagagaguucuguagaugucuauuaaguccgcuuagugcagagcugaguucaauuccuagauauccuugugaacuuugugucucaucgaucugucuaauguugacagugggguguuaaagucugccauuauuauugugugggagucuaagucucuuuguaggucucuaaggacuugcuuuaugaaucugggugcuccuguauugggugcauauauauuuaggguaguuagcucuucuuguugaauugaucccuuuaccguuaugugauggccuugucucuuuugaucuucauugguuuaaagucuguuuuaucagagacuaggauugcaaccccugccuuuuuuuguuuuccauuugcuugguagaucuuccuccaucccuuuauuuugagccuaugugugucucugcacaugagaugggucuccugaauauagcacacugaugggucuugacucuuuauccaauuugccaaucuguguuguuuaauuggagcauuuagcccauuuacauuuaagguuaauauuguuauguguauuugauccugucauuaugauguuagcugguuauuuugcuuguuuguugaugcaguuucuuccuagcauugauggucuuuacaauuuggcauguuuuugcagugucugguaccgguuguuccucuccaucuuuagugcuuccuucaggagcucuuuuagggcaggccugauggugacaaaaucucucagcauuugcuugucuguaaaggauuuuauuucuccuucacuuaugaagcuuaguuuggcuggauaugaaauucuggguugaaauuucuuuucuuuaagaacguugaauaugguccccacucucuucuggcuuguagaguuucugcugagagauccgcuguuagucugaugggcuucccuuuguggguaacucgaccuuugucucuggcugcccuuaacauuuuuuccuucauuucaaauuuggugaauccgccaauuaugugccuuggaguugcucuucucaaggaguaucuuuguggcguucucuguauuuccugaauuugaauguuggccugccuugcuagguuggggaaauucuccuggauaauauccugcagaguguuuuccaacuugguuccauucuccccgucacuuucaggcacaccaaucagacguagauuuggucuuuucacauagucucauauuucuuggaggcuucguucauuucuuuuuacucuuuuuucucuaaacuucucuucuugcuucauuucauucauuugaucuucaauuacugauacccuuucuuccaguugaucuaaucagcuauugaagcuugugcauucaucacguaguucucgugccaugguuuucagcuccaucaggucauauaagaacuucucuacauucuaguuagccauuugucuaaucuuuuuucaagguuuuuagcuucuuugcgaugcauucgaacuuccuccuuuagcucggaguaguuugaucgucugaacccuucucucaacucgucaaagucauucuccauccagcuuuguucuauugcuggugaggaacugcauuccuuuggaaggggagaggcacucugauuuuuagaauuuucagcuuuucugcuguguuuuuccuaucuuugugguuuuaucuaccuauggucuuugaugauggugacguacagaugggauuucggugugaauguccuuucuguuuguuaguuuuccuucuaacagucaggacccucagcugcaggucuguuggaguuugcuggaaguccacuccagacccuguuugccuggguaucagcagcagaggcugcagaacagcaaauauugaugaacaguaaauguugcugccugauuuuuccucugaaagcgucaucucagagggguacccagcuauguggggugucagugugccccuacugggaggugccucccaguuaggcuacuugggggucagggacucacuugaggaggcagucuguccauucucagaucuuaaacucugugcugggagaaccacuacucuauucaaaguugucagacagggacauuuaagucugcagagguuucugcugccuuuuguuuggcuacgcccugcccccagagguggagucuacagaggcaggcaggccuugagcugcggugggcuccacccaguuugagcuuccuggcugcuuuguuuaccuacucaagccucagcaauggcgggcaccccucccccagccucgcugcugccuugcaguucgaucucagacugcuguguuagcaaugagcaaggcuccgugggcgugggacccuccgagccaggcaugggauguaaucuccuggugugccauuugcuaagaccauuggaagagcacaguauuagggugggagugacccuauuuucaagguaccgucuguuacagcuucccuuggcuaggaaagggaauucccugaccccuugcaguucccagaugaggcgaugccucgcccugcuuuggcucacacucaguaggcugcacccacuguccugcacccacuguccaacaagccccagugaaaugaacccgguuaccucaguuggaaaugcagaaaucacccgucuucugcgucacucacgcugggagcuguagacuggagcuguuccuauuuggccaucuuggaaccacccccaaucacuuguaguuuuuuauuuaaagugagagaugugugacucuuccuuucccuugaacacuuauaagccauuguaggguuauuaauugucuggauuucaaaacgguuuugucuuagggaacagggaggcccaaggaguuggggaaagacaaaggaauggcugguuugguugagcagugagaacacacacauuuauugaguaaguucccuguuucacaucugcacgugguuccuugugucccaaaacaauuacaggaguaacaucaaagaucaucgacacagaucacauaacaaauaucauaguaauaaaaaaguugaaauauccugaguauucgcaaaacguaacaccgaaacacgaaguaaacaaauacugaugggaaaaugguguucauauacuuggucaaugcaggguugccacaacccuucaauuuguaaaacaaacaaacaaaaaccacaacgucaacgaagcacaauaaagugaaauguuuaaaugagguauaccuccacuggucagguaucuuguagaugucccucaguugggauuuguuucauguuuuggggaggaagacuacagaggucaaaugccauugucaucauaccauauuaaggauacauacuaucugugcauaucacuauuuagaguaaucucaauuaccuggcugaggcagugguugucagguuucuccacuguaaaguuucuccccacccucccuucuuguacuguaguccuuuggaagaaaguccaugugcacagcccacccuugagggcgaagugucuaaauuauuuggaauucuguguggagaucuguuauagucuguccuguuuacuauuuagucauuuauuucucucaguuuggauuuagggacguuuauuuuauacuuugggcuauaaugcaauacaacuuuauuuuuuuguucagaugauugucacagcuacggcuauuacgagcucuucauuugguuccaucugucccuuugaugugcccccgacauuguaguuuuuguuuguuuuauugagcacuuccuuauuuucuggcacugcaagagccaucuugcacauuuccugucccagucuuagaaucugccauuuuucuaaggacuucugguccuuuuuuauuggagaaugauauuaaaaaccaagaacuggguguguguuaagccauucuugcauuacuauaaagaaauaccagagacuggguaauucauaaagaaaagagguuuaauuggcucaggguucugcaggcuuuacgggaagcauggugcuggcaucugcuuggcuucuaggaaggccucgggaagcauccaaucauggcagaaggugaagggggagcagacacgucacauggugaaagcaggagcaagcaagagagagugguaggggaggugccacauacuuuuaaaugaccagaucuugcaagaacucccugucagcaagucagcagcaagccaugagggaucgauucacccccaugauccaagcaucucccaccaggccccaccuccagcacuggaucauguaucugccucugucauauuacacagaaguugcccugcccuaaaaauuccccugugcuucauauugaacccucugccuccccacccuaugagccccugacuacuacugaucucuuuaucaucucuauaguuuuaccuuuuccagaaugucauacaauggaaagcauucaauauguagccuuuucaaguuggcguccuucauuuagcaauaugcauuucaguuuuuuucacaucuuuguguaguuugauaguucuucuuuuugcugaauaaaacuccauuguauggauguaccacuguucauucaucuuuugagggaccucuuaguuguuugcuuccaaguuuugacgguuauaaauaaagcugcuguaagguuucauaugcagguuuuuguguuggugaguuuugauaguuuaaagaaauugguacauuuuuucuugcauuugugggcauagaguuauuuguaauauuucuuuauuauccuuuuacuguucaugggaacaguaugaugacugguucuucauugcugauauugguaauuugucuuuucucuuuuuucuaagggaagagaggguacaaucuaaucaguuuuaccuggcuagagguuuaucacuuuuuuugaucuuuuuaaagaaccagcuuuugguuuuguuaauuuuucucuuacuguuuuccuuuuuccaauuucauugauuucuauuuuaauuuuuauuguauuuuuuucuuuugauugccuuaggcuuaaauuguuuuccuuuuuauuuuuaauuuuuuaauuuuuaauuuucuaguaaguucaugucagacaaguaaaaugggcugacuucguaauaagauuugagggaggcauauuucccacaagcacaugaaaacccagucaccacacuuaugaacuacaaaagaaucaaauuguucuucuuucucugguuuucagaagugcaagcuuagaucuuucuuccuaauauuuucauuuaaugcugcacguuuuucucuaaacacugugugcuuuguaucccacaaauguugaugaguuauauuuucauuuuuacuuuaguucaauauauuguuuaauuuuugagacuucuuagacccauggguuauuuagaaauguguuaauuucuagauauugggggauuuuccagauaucuccguuacugauuucuaguuuaauuauguuauuugagaccauguuuuguaugcuuucuagucuugaaucuguuaagauguguuuuaugguccagaauguggucuauauuggugaaugugagcuagagaagaauguauaucuaccaugauuggauggaauuuucuauaaacgucauuuagaucagguugauugauagugcugugcuguucuaguuaucaguuucuuuacugauuuucuggcugcuugaucugucaguaacugacaguguugaagucuccaacuguaguaguggauuugucucuguauauuuuucuuaguuuugccucauguauuaugaugccuucuuauuugaagcauacacauucaagacuguuacgucuucuuggagaaccgaccucuuuaucauuauauaagauccuuuuugucccugauuaucagacaaaaucuguuuugucugcaguuacaauuacuccagcuuucuuuugauuuguaaugucagcaugauauaucuuucuccaucccuuuacuguuagcauaucuaaagcuuuauaguucaaguugguuucuuacagacaugauauaguuaggucuuuuuaaaaaauuuuguccacugugacacucucuuuugauugguguauuuagacaauucacguuagaagugauuauuaauauuguuggauuagcaucuuccaucuuuguaacuguuuugcacucauugcuuuuuucuuucuuuuuucuuuuuucuuuuucuuuuucuuuuuuuuuuugagacagagucucccucuguugcccaggcuggagagcaguggugugaucuuggcucacugcaagcuccgccucccggguucacaccauuuuccugccucagccucccaaguagcugggacuauaggugcccgccaccacgcccagcuaauuuuuuguauuuuuaguggagacaggguuuuacuguguuagccaggauggucucgaucuccugaccucaugauccgcuugcuuuguccucccaaagugcugggauuacaggugugagccaccgcgccuggccuuuuauuucuuuuuaauuggacauuuuaugugauucaacuuuaucuccucucuuaucuuguaugagcuuccuauucuuacagcacaacuuaucacacaguucuggaagucagaagucugaaaagcaucucaggggacuaaacucaagguguuggcagggcuguuucacuuuuuugagguucugggagagcaucuguuuccuugcccuauugagaagccaccugcaguccuuggcuuguggcccuuuucuuccaucuucaaagcuagcaguaggucaaguucuucucacauuguaucaacucugaucuccucuuuugccucccucuuucacauuuaaggacccuuguaauuauauugggucuacccacauaauccagaauaaucucuguauuuuaacgucaucugaguagcaacuuuaaucucaucugcuaccuuaauucuggggauuaggauguguacauuucugaggggaccauuaucggggaaucugccccaauauucacguagguucuuuucuauuuuccuuaagcguaggccagcuugagaaauaaagggacagaguacaaaagagagaaauuuuaaagcugggcguccgggggacacaucacaugccgguagguuccgugaugcccaacaagccacaaaaaccagcaaguuuuuauuagggauuuucaaaaggggaagggagugugcaaauagguguaggucacagacaucaaguacuuuacaagguaauagaauaucacaaggcaaguggaggcagggagagaucacaggacuacaggacuggggugaaauuaaaauugcuaaugaaguuucgggcaccauugucauugauaacaucuuaccaggagacaggguuuuaagaucaaccagucugaccaaaauuuauuaggcaggaauuuccucuuccuaauaagccugggagcgcuaugggagacuggggucuauuucagcccuguauucucaaccauaagagacgggcacaccugggggugcuguuuauaagcguauaccuccaggcacguauucucuuucccagggauguuccuugcugagaaaaagaauucagcgauauuucucccauuugcuuuugaaagaagagaaauaugguucuguuccacccggcucaccggcggucagaguuuaagguuaucucucuuauucccugaacaauugcuguuauccuguucuuuuuucaaggugcccagauuucauauugcucaaacacacaugcuguacaauuugugcaguuaaugcaauuaucauagguccuggggcaacauacaucuuccucagcugacaggauuaagagauuaaaguaaagacaggcauaggaaaucacaaggguauugauuggggaagugauaaguguccacgaaaucuucacaauuuauguuuagagauugcaguaaagacaggcauaagaaauuauaaaaguauuaauuuggggaacuaauaaauguccaugaaaucuucacaauccacguucuucugccauggcuucagcuagucccucuguuuggggucccugacuuccugcaacagaccauuauucugucaguuacgauguagcaugucaauuauacuucuuuuaaaaaguuuuuaggaggcugaggcaggagaaucacuuaaacuugggaggcggagguugcagugagccaagaucaugccacugcauuccagccugggcagcaagagcaaaacucugucucaaaaaaaaaaaaaaaaaaaaaguuuuuaagcugggugcuguggcucaccccuguaaucccaggauuuugggaggccaaggcagguggaucacuugaggucaggaguuugagaccagccuggccaacaugaugaaaccccaucucuacuaaaaacacaaaauuagcugggcauguuggcgcacgucuguugucccagcuacucaggaggcugaggcagaagaauugcuucaaccugggagguggagguugcagugagccaagauugugccacuuccagccuaggugacagagugagacuccgucucaaaaaaaaaaaaaaaaaagaaaaaagaaauucuaauguguagaaagcaaaaguuccucuucaaagcuuccccuuuaaaucauaaauguuauugauaucuuuucucagaacuaacuuucuucaaguuucuuauuuuauaguaauaacucucuguuaagccuuauguagcaaaugugacagaauaagcauacucugacuucaguaucuguguuaaacaugcucacaggcacauaauacauuuuguguccuuguuccuuagucaaauuauucgugcugaaugugcccaggcaugucccagcuugcagccuccucccuuauuugggaauauuauuacuuuguaaauccuuucguaaguaacuuccuuuuuuccuuuguuccucacugccuuuaccuguuuagaaaaguuuugaacuguuagccaaucggguuuuaguuuagauugugaggucuggcuccagccaauggagucagaacacagcaauagggaccucaugcguaaaggauaaauauucuagugucuuuuuuacuuugugugugcuuguggcaggauugcugacgggcaccacccuuucugcagagaguaaacaucgccuugcuaaggaaacuuuuugucugauugcugauucuucucugcgacaucggggaauaagcauuuauuuccaacauaguguuuacucuagaguuuacaauauacauuuuauuuuauuuuucaauuggcauauaauuguguauauuuaugggguacauagugauguuucuauauacguaacguaucagugaucagaucagaguaauuagcauauccaucaucucauacauuuaucauuucuuuguguugggaacauucaauauucuccuuauagcuauuugaaacucuacaauauguuauuguuaacuauagucauccuagagugcuauagaccaguagaacuuauuccuccuaucuagcuauaauuuuguaaccuuuaacaaaucucuuccuaucuccucccuucgcccacccuucccagccucuaguauccucuguucugauuuuucugugagaucaacuguuuuucagcuuccacauaugaaugagaacaugugguguuuaacuuucuguuccuggcuuauuucacuuaauauccuccaguuccauccauguugcugugagugacaggauuccacucaaauuauggcugaauaguauuucauuguguuuauauuccacauuuucuuuaucuguuuaucuguuggacacccagauucauuccguaucuuggcuauugugaauaaugcugcaguuaacauggggauguagaugucucuucgauauaccaauuuccuuuccuuuggauaaaugcccaguagugggauugcugguucauaugguaugcuauuuguagauuuugaggagccucuauacuguuuuccauaguggcuguacuaguugauauucucacccgcagaguguaagaguucauuuuucucugcauccuccccagcauuuguugguuuuguuuuauuugucuuuuugguaauagccacucuaacugggaugagaugauaccucauugugcuucugauuugcuguuccuugaugauuugugauaagugaacauuuugucauauauuucuuggccauuugucuucuuuugagagauggcuauucagaucauuugcccauuuuuaaaucugauuuuuuuuuccugcugagauguuuuaguuucugguuuauucuggguauuaauccccuuuuggaugaauaguuugcuuauauuuucucccauucuauagguugucuuuucacucugcugauuguuuccuuugcuguauagaaguuuuuuagugugacauaaucccauguguuuguuuuugcuuuuguugccugggcuuuugaaguuguauucauaaaauauuuucccagauuaacguccugaggcauuuccccuguuuucuuucaguaguuuuauaguuucaggucuuacauuuaggucuuuaauccauuuugaguugauuuucacauagaggugggaggcuaguuucauuccucugcauaugaauauccaguuuucccaguaucaucuauugaagauacuguccuuuccccagugaguauucuuggcaucuuugucaauaaucaguuggcuguagauauuguggauugauuucuggguucucuauucuguuccauugcucuguauaucaguuuuuaugccaguaccauguuguuuccaucacuacagcuuugagguauauuuugaagucugggagcaugacgcuuccagcuuuauaacuuuuuuuuccucuuugaguuguaagccacuuuuaguauauuuggaacccugugggugugguggugaagugugagggagggugggaguucuggaaucugguuaaaucucagucugacagugggucugggucucacauagguucacucuuacagugggcugugaucuucacaaguauuucucuagcguuagagcucuucuccccuguuaucuauuccugcccuauuuccuugaggcccugaccuuugcggauuuuuuugcccuguagguaugacaggaaggcuggagggggcuggagugggaggaaugcccuuugcauuccccuaguuaggagaaggaucuagcaaaguuuuuuuccccuggagcaaaugacuuuguggcagagaaaacucugggcuuauuacucuuccccuccccugccagagggaucucucugggaucuuuuaccuuagugccugguggaguuccuggagguaaagcccacagaagugugggucucgcaccuccugagacugcuuccccgaguuucucacucucacuaguccacaccgagcauccagcaccagcuuauggcucuggcaguuucugcuccagguaagcggaucuccucugugucuuuccagguuuccagcacaguuugcccuguuagcucaguucucugaucgucccaaaagagccauugauuuugaauuuucccagcuuuuucucauuacauguugcagcugaaagcgaagucaccaccuuguuuuuaacuuguauuuugugacuuguuaccacuucagugcuuuagacacauaggcucagugcugcaauauugugucuagguuugauuaugcuaaauuuaaccuuucuuauguaucaccggaguaguaaggauuucaaacuacccugccugguagcuuucgcuuuccuuagaaaagcuuaucacuucuugacugggccccguggcucccgcccauaaucccagcacuuugggaggccaaggcaaggcuggcggaucaccugaggucgggaguuugagaccagccucaccaacauggagaaacuccgucuacaaaaauacaagccgugggguggcgcaugccuguaaucccagcuccuugggaggcugaggcaggagaaucgcuugaacccgggaggcggagguugcggugagcugagauugcgcuguugcacuccagucugggcaacaagagcaaaacucugucucaaaaaaaaaaaaaaagacacuuugggaggccgaggcgggcggaucacgaggucaggagaucgagaccauccuggcuaacacacugaaaccccgucucuacuaaaaauacaaaaaaauuagcuggccgugguggcggacuccuguaguccuggcuacuccggaggcugaggcaggagaauggcgugaagccgggagguggagcuugcagugagccgagaucgugccacugcacuccagccugggcgacagagcgagacuccgucucaaaaaaaaaaaaaaaaaaaaaaaaaaaaagaagaagagagaaaaguucaucgcuuuuuuaauguucuguuccugcaaguaugaagauauguuacugcuuuucagaaaaagcagugugcuuuuuucugugcauuauuuugcacuuuaaggcaagaaaagcuguaaaggcucucuuuauuagauuuuucauuuagaaauaaauuaguucaucuaaggauuugucaaguuguuccuuuucuguugaaaccugaauugauugguuuugguucuucuggaagcagaucuugagauagaaaucugaauccaaguuguguauuugcgagguaaucccaggacacaccaguaggggaaugaagugcgccgucuaggaaagacagccaauaaagggcauguuuucaagccaggucccgcuguggacaaaugaagcuugauugugcugaggaauucuagagccaguguagcauacguaugucagaguugugauuuuuccacuggggguuuggagggaggcuggauuuaaggaagcuggagucuucuuaucaguauauugugaggacugcccucagguagguacacauuccccuguaguuugggccugcccugcacgugggcagaugggcuucagaagccagagauacagguacuggcaguuggaauucagaacacugugcgggauaguaaugcucaaggggaccugcaaacaacaguaacugcgauguuuauuuacugggcuugguuaacagcaugagcuaggaucuggugauuugccagauugauuaagucugucagcuuucuaaaccuguugaggugguagauucucagaaauuaauuuucuauacaguucacgauguauggaggaaaaaaguuuucugaaaaaggcccauagcugggcaugguggcucaugccuauaaucccaauacuuuggguggaugaggugaggaucgcuugagcccaggaguuggaggcuacaguaaucuaugaucauaaccaccacaccccagccugggugacagugagaccuugucucaaaaaaaaggcccaagauucugucacaguuugauuugcugauguucuuuuuggcaguaccuagccugcacucuuugaaaugccaaaacaacuguuuagaaaauagcccuggccuugugcuuccgauaauggccugaguaaccuaguuaaagccagcugauacuuuucugaaaagcaucaaggaauuuacaacauaguaaagaauuacuggguuaagauuugggagaugauagaaaaccagagacgugagccucugacccagggccgcuuuugcccggcuauuugcuguucuggaagagcaggugagaggcugagcaguguaguuaacugacucacaggaggacagaaacaaaaacuggagucuagaacuugcuguggguaagaauccuggugagccaccugggguuaauguugaaaccuugagaggcugccauccagaacacucaugggcugggagugugccagccuuugccuggacugaagcuccauggggucaccuggggguuuaguaaaucucaaauggugaaauggauuagggugaucucaaauugcuggugaccccagucaccuaacagagacagaugaaaauccucuccagaggaagauaacaucucacgccucaaauuauuucugaaaugauuuuucaaauaguguccaccauaccaccaagucaguguaaccaggcccacugggagacuaccuuaacaagaacccgcacagauaacagaggauagaaacaggcuuugcagacaguggaauuaccagacagacgcuaaagcauauguuuauuauguucauggagauaaaaguugaauaaaaacauuucaacaaggaacuggaaacuuaauauaagggggcaaagcagaccugaaaaacaacuaaauacuagaucuaaaaaauacaguagccaaaauggaggauucaguggauucagcagauuagauacugcugaagagaaaagugagcccccgagagaucagaagaaaccucucugaaugaagcgugaggggggaaggcuggacaacacugaagaagcuguaagaaauauacuccauccugagaaagucugacauacgugauuugaauccuagaaggagaagagggagggggguagaaggaauauuuguuuuuguguuuguuuuuuuuagacagaguuucacucuuguugcgcaggcuggagugcaaugguacaguaucggcuuaccccaaauccaagugauucuucugccucagccuccugaguaucugggauuacaggcguaugccaccaugcccagcaaauuuuguauuuuuaauagagacaggguuucuccauguuggucaggcuggucuugaacccccgaccucagaugauccacccgccucggccucccaaagugcugggaugauaggcaugagccacugcgcccggccggaaggaauauuugaauaaauaauggcaaagauuuuugaaaccccaugaaagaugacaauccacagaauuaagagauucuuaauauagcauaaggugauucuuaaaguuuuccacuucuaaguaauaugcaaauucauuuuccuuagauugagcuuccuuccccuccuccuuucuaauuuuagcagugguuuucagaauucugcugagaguaaguguuuuucuaacaagugaugaauuacauguuuuuuuuaaucacauuuacaaaauaauuuaugugcuagaguuccaaaaauuuugauuggacaaaaaggaugcaacuucuguuuugauugaagacugagagauaagaacaucuuaaauaaaaggcaagcuuuccagacccaaaggauuaguuuauaaugcaggaauuucagcauaaugggcagucagggggcagagccccucacuggcaccacucagccaugguuuauagguagcuccuacucugucucccuugccgacugggaagaaugacucucacggaugaauggcauagcugacacaggaaagaguauguguaggaugcaagcgaaaacccuuuaacuaauacuacuauuaauaauuauguauaacagcuggacacaguagcaugugcccauagucauuuuauuucaauuuauauuauuuguuuuccuuacuguucuuuucuaccucauagaauuaggagguagaaacuacugaccucaugcuugcucccugaggcuagcuuuuaccugagguagcuuuuaccuucuugucuuccacaggucuauagugagcgagagcugcuacuuuuuacuugggcauucauucaaaguguugaagaauaacagccucuaccaucccuuauucacuggcucaucagcugucccagguuuugcucuucuagguauuugccauguuguuuguccuuuuaguuucuuuucuauguguuugauuaaauuugcuucuuucucccaucagcauuaccuugugguuuucuucugcauuugagacacaguguuagacauuugaugcauucauguucuuuucgauugucuuacagagaagagauucauaaauaucagggaugucugaggaucauucccagggagcauaugaugucuggaauuugcucugaaccuuuccuaauucagcaaucgccuuauguguaauuauaaacuacuauugguagcuauguuuucuucuagcuuucuggguagauaaggaaugggaaagaauaauguguauuuuuauguugucaucaccugguaauuucacagggguauguggguacuguacuguuguaaauuaauauuuguacucacaugacuacagcugaguuaaaauaugagugugccucuuuuauggaaaaagcuaauaaauauuugcuguuugacaauuuguaaugcaagaguaucuuacaagaaaauagcuggaaacuacugaaagguaaauaaauacauuuuaaaugcauuaaauauuaugaaaauuaguuuauucugguagaaaaugaaagcuguccugugaaauagaauuuucucauuagucuugugguaaaagauggacauuaaaaggugguuaagaauuucagauuagauagugauucauagaggaaaaacuauucuucaaauugugcuuuuagaacauuuguucaguacucaaauuuuauucucauauuuuugacaaauugauggaauuaaaauauucuuucggugugcuuaaaccugcucauuuuucuuggugcuuguggcuauggaaauccccuuugcuugugagguuaaaauaauaugguauccuauuucuuucauagccuuaaaguauuuaaucuuuuccauaguuguucuuauauuuucaaguuagggaguuucugucuaagaaauuuuuuaccucauuuauuaaaucacuacauauuccuuguagaaaauguuuuaaauaaaagaaagaacaaagaaaauuagccaugaugccacuaaccugagucuauuaauuuuuugguaguugccaaaagcaguauagcauuuuguagauaguguagaaagaugaaaauaaguaguagauuauauagcaaaacauuaaaguggugagacuucuggugauuuuuaaguaguuuccuuuuugcuugucuguguuuucugagcuuuuagcacaauagcaaaagcuauuaaaacauuaauugcgggccagguacaguggcucacgccuguaaucccagcacuuugggaggccugggcaggaggaucaccugaggucaggaguucaagaccagccuguccaacauggcgaaaccccaucucuaauaaaaaaaaaaaacacaaaauauuagccgggccugguggcgggccccuguaaucccagcuacucaggaggcugaggcaggagaaucgcuugaacccaggaggcagagguugcagugagccaagaucucgccacugcacuccagccugggcgacaagagcgaaacucugauucagaaaaaccaaaaaacaaacaaaaaaaaccccauuaauugccagcacccugaauggagccuugccuguagaucuucuacuguguuccuaguuuauuagccuuuucuuuaggauuauuuaagauuuucauuaaaucauucagaaaugauuuagauuucugaaagauuaagauuucugaaaaauguuagauugguuagacuggaagauuaguggaauuaagccaucaucuguagagugacauugcauaacaggcauugucuuagugaccuuuauguaauuuaacuacuucauggagcacaguuuuauagcugguguggacuaugaccucuguuaauagaggacgacuacaaaaagcauuucaaaagaagccuucuuaccucaaagcccgguauugugcuguugagaaacaccccucaggcuaaucugaugaugaugccggaauguaaauugggugagcugagauuuuaguccuuugcgaccuaaauaguuugccacaaagcauuuuagauauuaacaacaguuuuuaaauauuaacaacaguagaugcuaacagucacaauaaaaguuugcuuuuugugcagauuaaaauauguaugugcuuaaauuguuauuugcauguuuuuguauacacauuuuucuaguuuccuggauugcauaguaguguaaggcuacucuucaccugcaaagaugaugucagcuuccagcccugaccccauaccacucuauguuuucuuccucuucuuauggguaucagcuuuuuuaaaaugguuuaugggggaugcuagaaaccaacccaauauuaugcuuugucuuuccucuuuuuauccuuuguuuuauaauauaggcagguguguguguacuuacauguagcauccuauauauacuuuucucaucuuuuuucaccugacaacauaauuuacagauuaaucuguaauuagcaacuaauaaaaauauuuuccuuuguauagcuguguauugcucuauuguguggauaguucauaguuuguucaaccagccccuuauuaauggacaaugggauuuauuuuagccuuuuacuauuauaaauaguccuguagugaauaggccuaugcauauauuguuuucuauuuuuaccaucugugguuuagauuacuggaaguaauauuacuaagucaaagaguagauaguguauuuuugcuggguauugcuaaaugaaccugcauagaagguauaccauguguuagaaaugcuuguuccucggugcuguaaagaaauagcacuugaacauuaauuuccucagcaaggccauuuuuacuuucugcagaaaggguacacuuaccagcaguuuugccaugagaguacaccgaacaaaggagacagggucauuuauaaccugacgcauccacccuacugcugugucugguuuccauuggcuggaacgggaccucacauucuguauuugucccgauuggcuagcaacuuagaacuuuuuaaaagaggcaaaggcagaggagaacaaaggaaagaggaaguaacuuguggaaugcugagaaagguaaaaaccuucaaauaaggaagaggaacgggcuaugaccuaaugcuugcuuggacuaguaaaagcaugccagggcagauauuuaggcuaaagugugggagcuaagaacauaaaguacauugauuucuuuauuauggcuagcagauauuuaagaauguuagcacaggucuuugaauaaauuuugcugcuaagagaaguuacuauuuauuccuaauuagauggggaggaaaguuuuugaagaggaaacucuccuuugguuuuuacacauguaugaaagcuucccuacagccucacucucagaauauguugucaagcuuuuggauuuuuucaguuugaucgggugggaaaugauauuucaauguaauuuaaauuugcacuucucuuaguauaagcagguuugagcauuuuuucauauagcuaagaacuauuuguguuucuguucugugaaugguuuguaagguuguugguccuuuauuuuuagaaucucuauuugagauuguggcucacagacccuaaggugacccccaguaauugugguaauuacauagcaauagaaaaccaacacugagauauuacucuuuugucugugauaccaauugugaguauuuuuucuaguuugucacuugucuuuuuacuuuucuuuuggugucuuuuaguauccaaaguuuuuugucuuuauguaauccaguuucuuuuccuauauucugaucuuuuuuaguccuagcuagaaaaauuuugcccaaucccagauaauagaggaauuuacucauauucucuucuaguacuuguauggagucauguuuuauaauuaaauauccaguuuucgggauaaaugaugggaggaguagacucuguuguuuuuccuuauggcuaaacaguuguucugacaucauuuaguugaaagucauucauuuccucucagguuugugauguuuucuuuauuuauacuaagcuuauacuaaauuuauuuauagcaaacauauuagauuucuaaauuucuaaauguaauugggucuuuuuucucuucuuuucccauugguuugucugucugugcgugggcccugcugcgcuguuuggauagagaagcccuggaguucacuuguucugcaguggggcucacaccccacuaguucuuuuuccaaaguuuaccuggcuauucccugcuuauuuauucuuuuccaaaugaacuuuauaauuaacuugucuagcuccagaaaaaaaaaccugauaauauauuuaacaugauuguguagcacuuacaaguuaacuuagggagaaaugacguauuuauuaggauuuugugucuuuuuauccaagaauauggcauguacaucuuuccauuaguucaggucuuccuuugggaccuuuuggagcuucuuauuguuuuccucauaaauguuuuagacguuuauuguuaaauuuguguuuaguauuuaagauguuugucuugauauucauaaaugagacuuuuugugggggagguucagucuuugucaggucuuugaaaucaauguuauguucauuucauaaaacaaauugggaagcuuuccuuuaaaaaaauauuuggcuuaaguagcaguaggauuuccucugacacucuucucugugccugguaguuuguuuuuguuguuguuuuuuauuuuuuucuuugguguuuuuauuuugggguuuuuuuggggaacucuuuuaugacuuucuuugggacuggggucaauuuuaauaaguuguauuuucuuuaaaaguuacucucuucuagcuagguguaguggugcacaccuguaaucccagcuauucaggaggcugagaggaugaugacuugagccuagaguguggaguuugagucuagcccgggcaacagagggagacccugucucuuuaaaaaaaaaaaaaaaaaaaaaaaacuuuuacauuuucaaguugauuuuguuagaacuauacaaaaucaccucuuuuaaauauuuucucucacaguguuuucaaauuuauuguuaagaaaucauggacuaagaggaagacuucguacuuuuguuggcguguugaguauuuuguuucauaaugaaaccgucuaaugaaacuguuuaaacugguuagccgucuuucuugccucuccuucuucacaauaagcauucauuuccgaggauguggucugcucacacauuauacucuucucuaagauuucgcauugcacagaaugugaacaauguccuuuaaccucuucuggaacagaaauacacuucaaaaauuauacaaacaaguauguauuaauuguuaauacuaagcgcuaugcuaaauauauggggcugaaaagauggaaaugaucucuguccucagggggcuuguuuaugguaaguauagcagugcuuacccuacaggcaaauugucuguugggauaucuuggguucacauaccuguaaaggaugauucugcugucaaugucccccuccaaagucacaauguugagcaucucauuuuccagccaugacauuucaccuuucugguucccucugucugguaacaacuccagcaauuauuuggccacaccagguccucuaauccauaggccuauccacauuuuucaucuugccucauacuuccacauccucacaucucuguuucccuggcuuaaaucugugauuugucauaaucaucccacugcauauaccuugccccauuccuguacuguuguaccucccuggcaaaaacccacgucucagcuuacaaggcaccuaucccugagcagcuaccagaccaugacugaagaaaaacguaaaaccauagugacuugucucacuuuaauaaauucaaguucacaacugguuagccuuuuauucauuuaacuuugaagaacguauuaguugaugucuaacugcugaaguuuuggcccuauuaacuauucaaguuuaugauugaaagaauuugucacuaguuguuuugccuuaaguaaccugagauacuugcuuugacucucuuuucaaaggcuuucagacuuggauauuaaaggccuggguaauugccuuuagaagggauagcaaacaguaugaaacacaaagauuuuguuguguagauacuagauucaucauucauuauuaguguagauuaaaguuuuagcuuuugauuuuuguuuggauguuuuuaguuucuuaagcaggugagaaauuuauugaauaauagacaucugauuucuuugcauuuccuucauauuuggguguuggcuucuuuuuuuuauuuuuggagacagucucgcucucuugcccagguuggagugcauggcaugaucuugacucacugcaaccucugccuccuggguucaagcgaugcucagaauccucagcauccagaguagcugggauuauaggugugugccaccacaccuggcuaguuuuuguuuuuuguuuuuuuuuuugagauggagucucgcucuguugccaggcuggagugcaguagugcaaccucggcucacugcaaccucugagucccugguucaagcgauucuccugccucagccuccugaguagcugggauuagaggcacgugccaccaugcccagcuaauuuuuguauuuuuaguagacaugggguuucaccauguuggccaggaugguuucaaucuccugaccucgugaucugcccaccucagucucccaaagugcugggauuacaggugugagccaccacacccggcccaauuuuuguauuuuuuuaaguugagacgggguuuuacuauguuggccaggcuggucuugaacuccagaucucaggugaucuacccaccuuggccuaccaaaguucugggauuacaagcgagagccaccgcgcccagcccuaacuucuugaccuauccgaaaacagauaguuccuuuauugcuucugaauaccauuaugcuuaauuguauaaaagaaaugaugggauuuuauaaauguauauguuuuuaaauuuagucuuacgauuuacuauguaaaaaauacucucuaaagaauuauaauaugguuugggaaaaagaauaacaucugccugauagaguuguugaaaguuaguauauuuuacagcucaggaaaccaaggaaucaugauguugagcuguuguggauaggaugagccagggugguuauuccauggagaaucuggacagaguuagccaaauccuguuggugaggucuuugagcagaaaacuuuuucauuuugcccuuaggugcuggcagguagccaagagugaaccuaaggaaaguaguuucccggguuuuuuguuuauuuguuguugucagugaauucuguaagauuagucugccuguuuuuaucacaaagaccauuauuuaaguuuugaaaugagacaauaaauuccugaguuguuucuuguaccuuuuccaaaaauaaacauggcuguuguucugugcuaguuuuuauacuauuguugaauaagauggucaugaccucuaugcauaguauuaagguauugcuuagcccaaacaagauaguaacagauuuguuuagaaauuugcaagcauguugcuaaccauauuacaguaauuuuuuucauuuauuaacaaauauuuauuaaauuguugcuauauucuacgcauuauuauaaucuccagggauagacaaaagcucuuucccuauuggagcuuacuuccugguaugggagagauaaacaauaaauaauaaacucagggaauaaguaauuauguauacguaagaaggugauaaauuccauggaauaaggaagaccagguuuaauguuuaguggguggauugaaguuuuaaauaggguaaucuugguagggccuuauugagaagaagauauucgagcaaagauucaauggcagugaaagaagucaucaugaaauuaccugggaggaagaguguucuagacuaagugaagagccagugcauaguccauaauggaguguaauugaaauguuugacccacaaggagaccugugucuaggacaaaaugaaugcagagagaagguggugggaaaagugcucagagagguaaugccagauuacguagggacuugcaggucuuuguagggagcagauggguggucaugucuaccauugauauuauauguuaagucuagaucuaaugacaaaaaauuaauauuuguucaguuuuuacuauauucauccuauagauacuuuucagcacuuucugugggcuauucauugugcuaagugaagggaaaacauuaaacaagaaaacaaacagcaaaugcaagccacaguccuugugaagacuaucuugguucagugcaaagggugguguuuugugugucagucauuguaucugacacuuuacauauuuuaccuuguguaauucugaguauuucauuugauucugaguauccaauaagauggacaaugucauuaacuuggaauacaguugaugaaaaugaggcuaagaaaaucugcuaauuuuuccaaaguugcauuacugauauauggcagaaugggauuagaauucagucuuaucuuuucauuauaccauugauucccaaaucuggcugugcaucagaguuaacuuggaggcuuguuuaagcuaaagauuccuuaaccuuaucucugggaauucccauuuagcauagcuggcguggagcccugggaaucuguauuuuuaauaaauacuccaaggauuucuguauuuugaaacuaccacccuccauuauuauauuuaugguagugugauacaagugauuauaggaaccuuugucuuuuauuuuuaaagaaaaugguuuuguuguuucauuguuuaguaucauguuugcuaccagauuuuuagagaugcucuuugucaggcaaagauuucccuauuuuuccuaguuuguuaagaauugaguguugaauuguaauaaacucuuuaucuccauugauaaaaccauuuggguuuuuuuucuuuuaauuuaugaaggugguagauuaugguuuuucaaauauuggaccaacuuugaguacuugaaguaaauacaacuuguuuaugguauauucaguuuuuaaaaacaugguugguuucaggguuuuuuuuuuuuuuaagauuucuguaaucucucugagauugucuuuaauauucuuuccuuaaacugcccuuauuuugauaucagagugguaacagccucagaaagggacauggagaaucuuuccucauuuucuguccucugaaggucauugcaucuaccuaaaaccaucuguuccuuagauacuugguagaacucacuuuuaaaaucaccuagaaauguuuuuaugauaguuuaacauucaaagguacuacagggcauccagguuccugauuuuccagaguugguguuaugcauuuauguuuuucuaggaauuugaucauuucaccugaauuuguaaacagugcuccuguuuucagucugugucuguauuuaugccucuuucucauugucgucuuauuugugcauuuuucuugauauguuuugccagugcuuguguaguugcccgauggguucuuccugcccacuccacagacaaaaucauacccugagaccauagcauugcagucaagaaagaacuucauucaugugaagcuggcccaugcaggagaacugggcuuaucacucaaauccauuuuccugagggcucagaguuuaggguuuuuauggacaguuuggugggcagggggcuagggaacgaguguggcugauggguuggggaugaaaucauagggggguggacaacagucuuugugcacagaguucaccucugggaccaguugagucaugagucacaagccuggguaggaucugucugaaagauaucucaaaaaaacaaucuuagguuuguuauauguaaaauguuuguucccuggugccauaaagaaauagcacucaaauauaaauuuaauucucucagcaaggcaaucuguauuuucugcagaaagggugcucaucgcaguuggaacaauggcgagagcacauucgaacaaaggaaagacguaauuuuuaucccuuaugcuguuuguuccugcuacuguguccugucuccauuggcuggagccagaccgcgcaaucuaaacuaaaacccgauuggcuaacaguuuaaaacuuuucuaaauagguaaaaguaauggaaagacaaaggaaaagaggaaguugcuuaugccaaauagggaaggggcauaggcugcgagcuggaacgugcccgugagcauguccagcacaaauauuuugguuaagguacaaggacauagaauguacuaugcaccugugagcauguuuaacagcuacauaggauagggcuuaacaaagaguuauuagcauaaagugaagaggcuugaaggaaguuagucuuuaaaauaaacuauuauuucuaacacuuaugauuuacucuuuaacaagaagggaaacuuugaagaggaacuuuuuacuuucuacagguucuacaauaaugauguuaucuauaggaacaaucgaggaagucaugaauuuugcgacgucuggccacaugacucccgagcaguaagggauuauagaaacuacaccuacauuucuguggaguuuaggcccuuccaguucccauuaucauauucuugcuuacaaaggugguuuucagucccugaucaaggaaaggggcuaguuauagggaggggcuguuaucauccuugcuccuaaguuaaacuggaaaccacauuucuccuaaaguuagcuuggcauacacccaggagugaccagggacaguuuggaggucagcuaugucagauuucuucuacugucacaauuuugcaaaggcaguuucauuuuauuaauuuuacugaucuuuuaaagaaccagcauuuggcuucuguuguuuuauuuucauuuucuauuaauuccugauaaugcuuuuauuauucuuuuauguuccuuggguuuauucaguuauauuuuucuuaauucauaguuuguggucauguuuucuaauauaggcaucaaaagcuauaaauuuagccauauccuauggguuuuaaaaaaguuguauuuucacuacuuagguucuguagaaaucucuguaguguucauuugcacauuuuguaaccuuucuaguuacuucguuaccauugguuuuuaguguacuugucuuggucacagcauguggcuccuugaccccacuggucgcacuccucaagagccuuugcucuuauucccccacccccccaccccaccccacccugcauagcucuuccccagauagcugcaguacucacuauucaguuuacgucuugacacaaguaucacguuuucagggaggccuucccucuccaucuuccugaagcuucacacaccuucuucuccucguugcucuuccugcuuuauuuucuuuccucagcacuuaucacuuucuaauguauuauuuaacacaguguucccagcuggauagagaaggaaguaaagccauuaugggguguauagcuggagacugaaauagaauuaaaucauaagggaaguggggagggcugagugcccggacuuugccugucaugagacugaagacauagggguagaugcagcugaggagucaggguugugguuggagagggaguuuuuguuguuguuguuguuguuuuuuucauguggagucucacucugucgcccaagcuggaaugcaguggugcgaucucggcucacugcaaccucugcucccggguucaagcaauuucuccugccucagccacccaaguagcugggauuacaggcgcccgccaccacaccuggcuaauuuauauauauauuuauuuuauuauuauuauuauuuuugugugugagucggagucucgcauugucaccccggcuagauugcaauggcgcgaucucggcucacugcaaccucccccucccggguucaagcgauucuccugccucagccucccgaguagcuggaauuacaggugugcgccgccacgucccgcuaauuuuuuguauuuuuaguagagacaggguuucaccauguuggccgggcuggucucaaacuccugacuuugugauccgcccaccucggcuucccaaaguacugggauuacaggcgugagccaccgcgcccggcccuaauuuuuuguauuuuuaguagagacgggguuucaccauguugcccaggcuggucuccaacucccaaccucaggugaucugcccacuuuagccuuccaaaguccuagaauuagaggugugagccaccgcccccagccggagaggaaaguuucaacuuagacaugaagaggucaucacaucaguccuggaugaugaugaaauugaggguggggcaaaguuccuuauguggaauuuagguaaaggugacagcaggaacacuaaccaagacauuuggaggcaggguugggcaugguccaacaugauagugggaaucaggcuaaagaaaacacgagaaacgacaucaguguccaucuuucauagcugcuaauggaguagcucuugguuucuucagggucuguuuuggaugguucccuuuugugagggccaagcagcccaugguggaagcgggaaggccgggagugguuugaggaaaacaaccuguaagcguggaccuugcuauauggaugaagaagggguuggcucccuaggugccugguuccucguggauucagagcagccuguccgguuacacucuuuaacuucaggaucucauggccuguggaagaagcagugcuuuuguuuuuguuguuuguuuacuugcucuuugucuacccuaagcgaacauuuuagggaguuauaaugucuguuuccccuaaaugucacugcucuguacauuuuuguugcaauauuuuuguuacaaaguugcacauugcaauuuuuuuuugucuuuucauuugcucucaugggcuuccuuacuuagagaacauuuucuucuacuucaaguauuuguguuuuucuguuuaugucuuuaguuuuaaaaguaccugcagcugacauagcagcgcuuucacuggcgccugauuuuccuuuguacuauugucauuuccagccaugccucugguauuacuguuggugggaguuuuuguuugguuggguuuuuguuuuguuuugguauguuacuguuguuuuguuuuuuuacuuuuuaauuaacuuguaguagaauacuuaauaguucuugguuggcagacaguuaagaaacugaacuguuuaccaucuucuaggcuuauggcauaaccuuguacaagagaaccuaauuuuuacaguggugcuuuacugaugccaguuugcuuuguccugaucuuuuggggacaauaccauuuuuaagauuauuuuaugcuguagaaauaaguaacuuaaaagcaguaucucugugcaguuuucuuauguaucuacauugcuuauaugguuucucugccauaagucuguuuacugagaugauuuuauaugugcauugggcuccuuagaauuccuuaggaaauuguauuagccuccaugaagaucagauaucagaaagcuuaggagaaauugccaggcacgguggccucacgccuguaaucccagcacuuugggaggccaaggcgggcagaucaccugaggucaggaguuugagagcagccuggccaacauggugaaaccccaucucuacuaaaaauacaaaaacuagccagguaugguggcacgcaccuguaaucccagcuacuugggaggcugaggcaggagaaucacuugaacucgggaggcagagguugcagugagccaagaucccaccacuuuacuccagccugggugacagagugagacucugucuuaaaaaggaaaaaaaaaaaaaaagcuuaggaaaaauugcuguucagugcuacauuuaguucuucuugccuuguuuuauaggugagggaauauaauuacuugaacucuuuauuugaaaauaacuuagauuuagagugcacacuagggcaggcauaaccuuugauuggaaaguagaauuuuuuuuaaguuguuuauauuuauuuauuuuuauuguuuugagacagagucuugcucgguugcccaggccagaguacaguggugcaaucuuggcucaccacaaccuccgccucccggguucaagagguucugcagccucagccucccaaguagcugggauuauuauaggcgcccaccacaacccucagcuaauuuuuguauuuuugauagacacaagguuucaccagguuggccaggcuggucucgaacuucugaccucaaaugauccgcccaccucagccucccaaagugcugggauuacaaucaugagccaccacaccuggccagaguugcuuagaguugcuuauuuuuaauaauagauuuuuaagauccuuggauuaaaaaaagaaucuugcaguucuuugguuggaagagacuuuaguuguccuguuaugauacaugugguacuuguuauuuuccuugugaaaauuauaaccugaugagaaaaauuacgcaacugaaagcaguccagaacaaaggugaagaaguauccauuaacaugggcaaaugaaucagucagcuauuucacugccguugguucucugagcauuaacccacaggccugagguuuucauuguugaacccuuuuuaaaaacucaguacuauccauacaucuucuuguauuugaauauccguuaacuguacgcauagugguccuacuuggugguuuggaaaacagugauucuguauuugguggaugguuuaaaguauacugaagugucuaacauauuuauucuucuuuuuuaggaaauugacaauggcccuucagcuaugcuaggucuauaaugggaagugucacaguucgguauuucuguuaugggugccuuuuuacaucugcgaccuggacaguuuugcuuuuuguuuauuucaacuucagugaagugacucagccacuuaagaaugugcccgucaaggggucugggccccacggaccaucuccaaaaaaauucuauccccguuucacucgaggcccaagucgagugcucgagccacaguucaaagcaaacaaaauugacgaugugauagacagucguguugaagauccagaagaaggccacuugaaauucucuucugaauuagguaaguauaugauguuuaccagcauccauaucaauguauuuaaucacuggaaguuugauuaauuaguuaauuaggagaucagaaaugcugcaucauuuuuuccccacugauuuauuuuguuugugaacuaccugaaguucugugguuucugcagacucaguggggaguuauauucuaauuuauccaguucugacuucaguaucuuaugagaaaacaaacaagguccagggaagaaaaauuaaaaggcuagaaagaaaauggaaccuaugggagaagggguuuguuuuuuguuuguuuuuuuaagagauggggucucaccauauugcccaggcuguccccgaauucuugggcucaagcugcccucccaccucaaccuugagaguagcugggacuauaggcaugcaccacugugcccagcccuggaagaagguuuuaauugcuagaauuguuaauaagggaaagaaaugguugaaaguuuccuugacuguauuuaacuuauuuuuaaggguacauuuaauuaauacagaacauaaaguacugaguuuaaaaauaagcugggguuauuuauaucuaauaugauuuucacuuaacaagaauuacuaaggugcuagaaaaaauauauguauauauaauauaguuuaugaaaucuuaguuauaaaauagcccuuuuuuccuccuaaaaaauuauauucucuucaacuuggaugcaagacucuauugucuaugccuuugaauacugcaauuuuagaguguugauuuugacauuuuauuuuaagggauaagugagcaauuuuuguuaucauuaaaacuuaaagaacuuggaucuugucacaaaaacaucaaauaauagguaauuuaagaguaaaauacaagagauuuuugagagauugagagagccuuagaaugugaaagaaauguuaaaauagaguuuucacuuggucauaguuucaaagaaauaaaaucaguucuuaggacuuaaugauuuucuaauauaggaagucaaaaguauguaaaauuuuaugaggaaacaagcuaauaucuacuucaguuuucauuuaaaaauauuuuuaaauagagacgugaucucaccaacuucaauuuucauaaaguacaauuuucauaaaucuuuuucaaauagccaguggacauuuuuaaagcauuaaugggaaaaugucuagcucuuuuauuuauuuauaguuacauugguaaagcuuuuaucaagaaguaauacugaguuuaccauuuugaauagacucuguauuugcuuuugaaagaaguagugagagaauuguagauauugaauaacaaacuccagcugccuaacugaaaaacuaaauuccuuauagacuaucguaaagaauccacaaaaaaccuauuagagguaauaaaugaauuuggcaguugcagguacuagaucaacaggcaaaaaccaguugcauuuuuauacuguagcaacaaguggccugaaaaaugcaguuaagagaucaauuucauuuacaauagcaucaaaagucauaaaacacuuaagaauaaauuuagccaaggagcugcaagauuuguaugcugaaaacuguaaaacauugcugaaagaaaucaaaguaaaccuacacacauugaaagauauuccagguucauagaauggaauacuaaauacuguuaagauguagguaucacccaaagcaauauguagauucagugcaaucccuaucaaaaugucaguggucuuuguuguaaagagggaaaagguuauccuaaaauuaauauggaauuacaagaggcucugaauagccaaaacagucugaaaaagaacaaaguuguaagacucagacuuuccaauuuuaaaaauaaauuggacuacaucaaaaacaaaaacuuucguacaucaaauaacauaucaagaaugugaaaaaagggcuggacgcaguggcugaugccuguaaucucagcacuuugggaggcugagguggguggaucaccugaggucaggaauuugcaaccagccugaccaacguggcgaaacccuaucucuacuaaaauacaaaauuaggugggcgugguggcaggugccuguaaucccagcuacucgggagguugaggcaagagaauugcuugaaccugggaggcggagguugcagugagucaagaucgcgccauuguacuguagccugggcgacagagcaagacucugucucaaaaaaaaaaaaaaaaaagugaaaaaagacaacccacagaaugggagaaaauauuuguaaaucauauuucuaauaaggguucaguauccagaauauauaaagaaugcuuguuuguaauuuuauuucauuuugagacagggccuugcucugucaccugcgguggagggcaguggcacagucaugacucacugcagccucaaucuccuuggcucguuugauccuccugccucagccucucgaguagcuggggcuacagggguguaccacuaugcccagcuaauuuuuguauauuuuguagagacaagguuucaccauguugcccaagcuggucucaaacuccugggcucaagccauucgccugccuuugccucccaaggugcugagacuauaggcaugaaccacugugccugggcccaaacaguucuuaaaacucaguaauaaaaagacaaauggcacaauuuuaaaaugggcaaaggauuugauagacauuucuccaaagaagauaugcaaauggccaacaagcagaugaaaagaugcuuaauauaauuagugauuacagaaaugaaaaucaaaacaaugagauagccaucucacacccacugggagggcuauaauaauaaacuuaaaaaggagaguagcaagcgacagugaggauguggagaaacuggagcccucacauguugcuggugggaauggaaaauagugcagccacuauagacaguuuggcaguuccuccauaaauuaaacguagaauuaucauauaacccagcaauaccacuccaggguuuguacuuggaagaauugucaacaggugcucgaaaacuuguacucaauguucauuagcagcacuauucucaauagacagaaggugacaacauguuauccaaauauccaucaacugaugaagggauaaacuaaguguggucuauccauaccauggaauauuauucagacagagaagggaaugacguugugaucaugcuacaacauggaugaaccuugaaaacauuaugcuugugaaagaagccacacacaaaaggucacauguuguaggguuccuuuaugugaaaugucuagaauaggcagguccauggagacagaaggcaaaugagugguucccagggacuggggaaugggaggaaugggaauaacugcuuuaauggguauaggguuuucuucugcggugcugacaauauucugcagcuagauaaucaugcuggucauacaacauugagaauguacuaaaugucacuaaugguauguuuuauguuacgugcauaauuaucacaguuaaaaaaugaaaaacauccacaauuucuuacauaaaauaaauuuaauauagaaggaauuaguauaaauaauguaguaguuaaaaguaugcagauuucugaguagagaauuacugaacaagcagggaaaggaaccuaugaaaagguauauuugagaaagauuauuggccaggcaugguggcucacaccuguuaucccagcacuuugggaggcugaggcugguagaucgcuugggcucagaaguuuaagaccagcuuaaggugguaucuacugaaaguuuaaaaauuagcugagugugggggcgcauggcuguagucccagcuacuuaugaggauuguuugggcccaggaggcagaggcuacagugagccgagauugcacuacugcacuccagccugggggacagagcaagacccugucucaaaaaaaauaaauaaauaaauaaauaaauuuaaaauuaaaaacauuuucucauuuaaucugaaauuaauuauaaaauuaauugaaaaggguccucuggcauguuaauucauugagguuuggcuacaauuuugaguaggggaauaagaaaaguaagcuaaaacaaucuuuucauauggaaucuuuucaagagaccuauaauagaacaugauucuuucauguucugauacuuguugaauuaaggaguauuuauugagaaucuucuuugugcaaggcucugcucuagguucuagguaucaagcaauuuuaguuuuauuucuuuuauguuuuggucaucaccaaagucucuucucuuguggaguuucucuccuuguauaaaaugcuaguggagguuuguuguuuuguguuuaaaaaggaugaacugcauuugaaacaguuucagagagaaggcauauuaagagauaauguuucucaaaguagauauggggacacuaguugcguucagauaaauuggggaaacacugcauucuauuuuuuuugagacagaguuuugcuuuugucacccaggcuggaguacaguggcaugaucuuggcuugcugcauucgccuccuagguucaagugauucuccugccucagccucccaaguagcugggauuacaggcgugugccaccaugccuggcuuauuuuuguauuuuuaguagauacgggguuuuaccauguuggucaggcuggcguugaacugcugaccucccaugauccacccaccuuggccucccaaagugcugggauuacaggcaugagccaccacgcccggcuggaaacacugcauucuauaucucaacccuuuacaccuggauauucauaaaacauucacuguauuaaaggaacagaguucuacuauuuuuuaaaaauggacuuuuauuuauuuauuuauuuauuuauuuauuuauuuauuuauuuugagacaaagucuugcucugcaggcuggagugcaguggcgcgaucuuggcucacugcaaccucugccuuccggguuuaagagauucuccugccuuagccucccaaguagcugggacuacgggaaugcaccaccacucccgccuaguuuuuuuuuuuuuuuuuuuuuuuuuuuuuguauuuuuaguagagaugggguuucaccguguuggccaggcugaucuugaacuccugaccucaagcaaucugcccgccuccacuucccauagugcugggauuacaggcauaagcagccgcgcccugccuaauauuacagugacuuugauuaggccuguggaggaauucccugacaguuaaaccagaaacugugaagcuuuuuuuuuuuuuuuuuuuuuuugaaaagacaggaucucacucugucacccaggcuggagugcaguggcacaacuguggcucacugcaaccuugauguccugggcucaagcagucuuccugccucagccuccugaguagccaagucauggagacuacaggugugagccacugagccaccacaccuggcuaauuuuuuuuuuuuuuuuuuuuuuuguaguagagacaaggucucgcuguguugcccaggcugggcucaagcaguccuccugccuuggccucccaaagugcugggaucacaggcgugagccauugcgucugacccgggaagcucuuuuuauggaaaagcuuaucagucgccuuuuucuggggagggacuccuguaaaaacucgcauguaauugaggccugucaagggccacugggguucuaaaaucuauugcuuuaauggaaaauuauaaaaauuuuuuuccugguugcagguaaauuuuucuuuugaauauaauaaacuauucuuaagauuaugguuuguggccgggcguggugucucacgccuguaaucccagcacuuugggaggccgaggugggcagaucacgaggucaggagaucgagaccauccuggccaauauggugaaaccccgucucaacuaaaaauacaaaaauuagcugggcgugguggcauuugccuguaaucccagcuacucgggaggcugaggcaggagaaucgcuugaaccagggaguuggagguugcagugagccaagaucgugccacugcacuccagccugacgacagagggaaacuccaucucaaaaaaaaaaaaaaaauuauggcuugugagcaggugguguuuaugguuaagacaccuugcuuugaccuagacugauaagaauuugacuucaaccuagagacaaccuaaguuugagaaaagagauauuagauuauaauaggauaaagucagcauuuucuuaagaucauaauaucguuaacaguaacaugauacuuucuagauuuaauucgcugacuaacuucacucuuuugcagguaugauuuuuaaugaacgcgaucaagaguugagagacuugggcuaucagaaacaugcuuuuaauaugcuuaucagugaccgcuugggcuaccacagagaugugccagacacaaggaaugcagcguaugugccuuaucggauuugcaaauacauuuuaacaacacgaugcuuuuagugucaguguaagaggucacgaggacgggguucauauuucccaaugcagcgucuuuauucagcauacuaggaaacuugagacagauuuccacuuguauuauaugugaagccacauggucugagauguaccaacagaguccuggagcuugcugugucuccuuuaacauuucagaucaccuggggaagcagaguagggugcuaauuaaauaaccugaguauaaguuuguucuaaauguuuauugauuggauucauggcaaauaggaauuaacaucagugaagaauuuuacucucauuucacuuuucucuuucauuguuuuuuuuccaucaaaggcuuuucgugcauguggucagucauuccacagacagacauuuguugagcaccuucuguuugcuacacgccgucuugagcccuggaagaaacaaacagauguaguaguuccucaguucucagggcuagagucuagcaggggaggcaaauaagucaacaaguccuuacaugaguaagggcugugacaggguuuggggaaaugggggcauaguacuggaguggucccugcagagaggugacaaggcuggagggaggcagggcucagaugcuggagggcugugugugcccugggaaagaauucaggguucucaauguguucucuaaguucauggcuuuuuuuuggggggggggggauggagucuuucucuguugcccaggcuggagugugguggcaugaugucggcucacuauaaccuccaccucccaaguucaagugauucuccugccucggccuccugaguagcuaggacuacaggcgugcaccaccacgccugguuaauuuuuauaguuuuaguagagauaggguuucaccauguuggccaggcuggucucaaacuccugaccucgugaucugcccaccuuggccucccaaagugcagggauuacaggcgugagccacugcgccuggccaguucauggcuuuuugauguugcuuaaagcuccuaacccuuuuuuucccaaauaguugcuuggaaugauuugauacauggaagcucuucuguuaucuugguauaucauaauuuauucaaaucuuuuuuauuauugggcaaaaaaauaaaauuucaaauauaaagucuuauauuuguuuccuuuugaaaccucauugaggagaagcuggacaucagcucaugagugcugcaugaaacacuugcagugauuuugguaaaaagaacucacauuuuuauguacccucucuuccaaaaaagaaaaaaaacccugaaguuuaaaaagucuuuauucggcuggacaugguggcucacaccuguaaucccagcacuuugggagggcgcgguggguggaucacgaggucaggagaucgagaccauccuggccaauguggugaaacucugucucuacuaaaaauacaaaaauuaccugggcgugguggcgcaggccuguaaucccagcuacucaggagguugaggcaggagaaucgcuugaaccagggagucggagguugcagugagccgagaucgcgccacagcacuccagccuagugacagagcaagacaccgucucaaaaaaagaaaaaauuuauccaaaaguaaacaagauagcagguauaggagggagacauuauuagcaaaauguaaaacucuugaagaagaaaccguauuguuuuuguaaaugcuuuuaaaaaaaauuguuguuaccauaauguuagaaagaggcugaacaggcuggacguggugguucacgccuguagucccagcacuuugggaggcuggggugggcagaucaccugaggucaggaguucgagaccagcuugaccaacauggagaaacccugucucuacuaaaaaugcagaauuagccggauguggugucgcaugccuguaaucccagcuccucgggaggcugaggcaggagaaucgcuugaaccugggaggcggaggucacgaugagccgagauagcgccacugcacuccagccugggcaacaagagcgagacuccgucucaaaaaaaaaaaaaaaggcagggggugggggaagagggugaacaaggggacaguaaaucuguaggugaauaauaaucuaaaccauucgagccuuuuaaaaugucagaauuuccucaucuuuaucuuuacagauguaaagaaaaguucuacccaccugaccugccagcugcuaguguuguuaucuguuucuauaaugaagcguuuucugccuugcuucggacagugcacagugucauagaccgcacgccagcacaccugcuucaugagaucauccuuguggaugaugauagugacuuugguaaggaaugcugcaccugguaacauuggauccaggcugucagucacuacagcacugacaaacacuaacacagcugaacuuucaaguacgugguagguggggauccuacacgugcagucacagcugggcugaccacaaauaagucugaagaaauccauuaucuuuguaaccugcuuauaaacuaugcuacccaaauuugggccgugaaauuuuuuccguggcuuacuuuaaaaaacacaccucuuuuuauuugaaauaacuguagguucacaggaaguuacaaagacggccuauguaccuuuauccaguugcuccaucauaaaauuccccugucagaaccaggaauccacauugguacagugugugugguccagggucauucugucacacagguggacucccacaacccucacugcaaugauacagaacuguuuccucacccggagggcccuugugcugccucuuucuagucacaccuccugcuuuccucuacucuuccccagucccugaaaccacgacucuaugauuuuguuuccaucucugauuuuguuauuucaagaaugucauauaaauggaaucacacgguaugugaccuuuugagaugggcuuuuuucauuuggcaugaugccuuggcuuaugcuucucuauuaagucucuuacacugaucguccccagauaaaaguggauugcauucugauagcuccucaaugaucucugaaugccaguauuuuaugauucacuacauauucuauauucuguacgccuuucuuaauucaacauagacucuugcuaagaauggcuuuguguacccaaacaggauagaaggcuuuuuauuacacugcucauucagcucucagugaccuugcaagaaaggcuggaagcccauuuuauagagggagaaauauaaaaaguaauuugcucagaccccauagcuguuaaguaguagaguggaaaugagaccucuggucugcauagcuccaagccuucugcucuuuucaugacagcaggcugcaggaacacagugguacagguguaugccagugacuuuuucaugcacucgagcguuuauuaaguaccacuuguaucaacaucagaguugguauaccaguauacuuaaauauagaagguaaagaaauggagagagucaugggagcaaaauucucaaaccuuggccaaaaacaaacaaacaaaaaaccuaauaaauaaaucugagucuggaccacguagaagauugguuacauacugauuucuagaauuuaugguugguuuuuguuuuuuuuuaagucaacuuguauuuugguuuucacuuuguggcuauuuuaccuaaaaggaaaaauucauaauuugaggugguuuguauauuaacuauggaaagaauuacugcuuauuaucuuacacgaucuuucaaguuauucugaaauauacaggugaaugacauagaauuccuuaaaaaauauuuagcaaccuuggaagaaagaugcuaaauuaauaaaaggacauauucaaugcuguucuuguuauucuugguaggggcaauagaaguuguuucuuaacuauuuugaaauggacuaagacuuaauaaauuccuuuguaauaaaaggcauuuauaucucauuuucuuuguuaucaaugugauuuauauauggucagcugaacauuuaugcacucaaaauacucauuucaaacauucuuugugcaaagcauugugcucgaugcuauggagauacaaauaagucuguaacuaaaguaaguauuccucuuugcuaguauuccagcucuuacccuucauuucuuuuucuuccuacaggauaagcuacaauacucuuuuaaaguaaaauauucuguaguauuugcuugauaguuuguuguaaauuuuagcaaguacuagauacaacuuuagaauagcuguaaagugucuuuauauaugucucauacaguuugaauaauugugggacuuuauuuucagaugauuugaaaggagaacuagaugaauauguccaaaaauaccucccuggaaaaauuaaagucauaagaaauacaaagcgugagggguugauucgagggagaaugauuggcgcggcccacgcgacagguaucacuucucguuagcuuugcucuacagguguuggaugacaagggcucgagccucagcgccuguccugauucugcaaagucuaugaagaguaguguuucaaacggacauugccagcaggagagaugaggcuuguucuguuugggaaagaccuguucauaacgccaagccugccaucccaaagcacauagugcagggggcugaacucucaaauccucagugucuauuuucauagcaacccuucuuugauacuuacugccccucaaauauauuuuauaucuuauucacuuauauaagcagaaaagcccagaccaaaauguaacugaauuuuuauguuuuuaaauacaaaauuuaaaauguaugaacccaaacugucgauuggaacuaugcuuuuaacucuuagugcggagugcaucccucuggagccacacaucaugacuuuaauugguuaauggacguaagauugacuuacaaaacuauaaauggcauuuucuuuaaaauucccucuuaauccuucugauuccaucaaggagcaagucuccguuguuacuaguauauuuccaucauacacugcucucccccuuuaaaaagaaauaaccgaucucaaauucagucuucugcagaaaauauaucugguuagucuucaguuacguuauauugauucuguuguauuucguuuuaugguuaccuauguguaauuggucucccugaguuucauuuaugacuguaauuaaaacauuuuuaaauaaauguaauuaaaacuaaugaaucuguuuaaaaauguuaggcaugugauauugcagguagggcauggacauggcgaaaaaauuuugaaaaucauuugagaaugauggaacuugguggggauauucccuagcagugacagcaucuacugcaguccuuccuauauuccacgcucuccuagauaaccugccucuggguuugugguggucggcacugcucaccaccacucccccuguggagccacuggcucgugugcugggcugaguuggaacuucacuuuuaguaucugucuucucuuauuucucugaagcccacagugaccugaagcaauuaacaaaaaaaaaagagaagcagcuccucuacauccuaucugcaguggaugcagacugaauucaaggcuugugagacuuuuuuucuagguuucuagucauguaaaaacuuacugaauuggcuguguggaguuauuuaaggcaaagcaauaaagugaaaauccugggguauuuucaauauuaagccacucaaaacauuguacuguuacaaugcaaguuuacugugaacugacuuuuuuuuagauagcaauagcuauuuagguuuuuuucccuuaugaucucuucagguccucauugagauauaguuuaggaucuguccgaagcaagccaguuugcauggaagucauuguuucagguucacugugaccagauguggucuuccuuuaaauugguguuaauuggaaaaaguaacacuuuuagaauuaagaaaagcucugaauccauuuucuccucgaagcaauugugauuggucucaccucacccccacugaugugcauguggaagguucugccuuucugcauuaagugacagcggagagcugccuacaucccccacccuucaggcuguuuacagacacugagcugugggacugauucacgggcaucauugaaaacugucugagauacugcuuuuaucacuaguugaaguuggauagauaacauuuggugcuuuaaguaguucauguaaaaucuucauacauuucacgagugcacuuuuagaaaaacaauaaugugaccugaugaugucauucugaguuucucaacugcucagaagaaccguggagcucuuaaauuugaaauuauaaaaaaaaaaaaaaccucaguucugcucacauuuaucaagaggagcuuaaaaugcagaauaaaaugucgaugauuuauauguugcuaacuagaagaaagguguaucccauuggcaggugagagccacugaagcuaagaggguggggggcaguagaaaggaaaggugggagauggaagaaacagaaaugagcaagaggcguccccgagagcgccaccagcugcgccucccucucuccggggagaacugcuguguggcagccaucauccauaguuacagugcauguccuagucaccagugagaaggcagcuguguucucuguacucuguuuacugaggcagagagaugucuucuaagugugugccaaacuucaaaauauuuugauuaaaauaauuguaauaaaaauaccuacauacaacuggccaccgucauggcaccaaaacaucuuggaauacucaauaucugggcuuccaaagaguugaguuguuacggugagacuuugacucuguuuacugaagagauucugaauugccugucaguuuuuucaagagucgcgcguaugauuuguaugggucccucaaucacagcaggacacugcacgcagcauuacuggcugagggacguccuuguugaccaccggcagugaaguguaguggagcaguuaggccgucuggggcugggaggguggcagucguguuucaugcugugucagcgcgucaucccauuggacgggugguuguaccuaaauugaguguugugacacucuccugagccucuguuguuuccuccccaggagaaguccuuguguuccuggacagccacugugaagugaaugugauguggcugcagcccuugcuggccgccauccgugaggaccggcacaccguggugugcccagugauugacaucaucagcgccgacacgcuggccuacagcucguccccugucguccgcggaggguucaacuggggacugcacuucaaaugggaucuugucccccuuucugagcuaggacgagcggagggagccacugcaccaauaaaguaagaucgcuccuuuguuugacaaauuccuaccagugcuuccuuaaaagagaacaaaaugauauuaaagauaauuccuccuucuuuguaaggagcaaaaguguuagacuuaauuuguacguuaaaaauucuugaguacguauugaauuuuaugcagucugccaaguccuaaggaaagauuuaugaguaagacaguaugugugcccucaaggacuuagagccugugagaagagcagacagaccaggccaccauugcagaggaagcccugggagggccccguguggugguugcuguuugguaugucaaacacugcgguguauuuauaguucacuaacuuaccuucaguucuuugguagccggagugauguugugaaaaacauuaauacguaagccuuuucuuucauuaggauuuugaagauggauuccugcuaguauaauuacuaagucauaguauaggaauuauuuuacguucuuaucuguguuucaucuucuguaauauaaagcugcucuuauuuuuguuuucuuuaaaaauuucuuacguagauugaauucaaagagguguaccuguauuuuaacuuuuuaaagaauacauuuguucuugauuugccagaguguaaucaaaauugguacuuucuccaaacaaugccaggaucucagaagguucacguuucaguuauuccucccccaauuuauuuguuauuguuauuauguuguuaucguugcuuauuuguuguuauauacaacaauauuguauauuguuauauaauuuaaaccccagaagccauuucuuacguagcaguauucacacaggcuugcccaaguaucuccgcuuuauguuacccuguucuuucugcagcuguaggcucuauccgggauugcucccacacucuuagucguucuuuuaguuggacauccuagugaucaguccucuguuuuuccgaaaauguccuuauguuucaccauuguuuugaagaacauguuuacucaguauccaguucuagguuggcaauagcagacauauauguucuuucagccuuugaaggcaucauucaagaaccuucuggcauucaccguuucagacaggaagucagcguuguuagucuuacuuugcuucccuuaagauaaucucuuuuucauuggcugcuuacauuuuuuuuggucuuguuuuuaaaaagugucuuuuggauauguauaaacaugguuacuuuuuugaaguaacuaauuugcugccgaauucugccuugucuuuuuuguugaauauacugagcaguuaaagucuuugcuugauaauuccauauuugaaaccccuucauaucuguuucugguguauguuguuucucucauuuuguuuucaugugauuuuaucuucccauuugccugguuauuuauuuguugcuuauuuauuuuugcuuagugccagacaugauauaugaaaaauuauagaaauacauucauaccugggaugauguuuuuucccugcagagauaauuuugcuucucuugugcaggcagcuugggccacuagaauccacaauccccucuauccaguuuuaggaagugagcggacuggaagcuagcucgagucccugagaggacuagucuguggcuuuucucacuccagcacagggcuucucagccuuggcacuacugacauuuugggccagauaauucuuuguuguaggggcccucuugugcauuuuaggauagguagcagaaucccagaccucaacccagauucuaggagcacccugccacacaaacacaucaagaugugacagcuaaaaaugcucccaacauuaugaaaugucuguuggggacacagucaucccaguugagagccacuggucuaacuugugugaguccaacucccaacgugugauguuugucaggucucuccuugguggaccuuagagcccaguuuugauccccaaggcucugugagauugucagaaggaaugaccauaucagguggcuuuccaucagaaaugguuauaauaggaaaagaacuuucgagacuuagaaaaguagccuucguaugccagauacuagcauauuauuagcaaucuagaaaauucaguuguauggccuggcucauucucugauacuggauaaaaugauucauaaucauuaauucaauuuuuauuaguuauguuccaaaaugacacugaguauuuuaaacaaaaguaguagguaagauaacugacuauaaggaaugaguacaguaauuuuccuuuuucuaggucaccaacaauggcuggagguuuguuugccaugaacagacaguauuuccaugaacuuggacaguaugauaguggcauggauaucuggggaggagaaaauuuggaaauaucauuucggguaauuuaauuuuugcaugcucaauuaauaacuguguaguggaauaugauuuucauccaugaucucauauuuucuuuauauucuccuugauuauuuuuuuuucgagauagggucuuucucugcugcccagguuggagugcaguggcguggucauggcucacugcagccuugaccuccugagcucaagcgauccucuugccucagccuccugauuagcugggacuacaggcaugugccuguaauuuuucuauuuuuuguagagaugggcgucucacuauguugcccaggcuggugucgaacucuugggcucaagugauccuccugccucggccucccagagugcuccaugacuaucuuuauugacaaauuguccuuaaugaaugcuacuuugucagaaucugugauauggauaauaucuguucgaaaugucaagaguauacauguugauccauuggcuaggaaaacaacaacaaaaugaaaaagcauguaagaagccauguauuuauugguauuuauuuuuuugagacagggucuugcuccgcugcccagguuggaguagagugggaugaauacaguggcucacugcagccuugaacuccugggcucaagcgauccucccaccucucagccuccuaaguagcugggaguacaggcgcaugccgccacaccuggcuaauuuucuacuuuuuguagagaugcgagucucacuauguugcccaggcuggucuugaacuccuggacucaagcaauccuccugccuuagcuucccaagguguuaggauuacaggcgugagccacugugccuagucuguuuuuauggauuuagagguacaagugcauaguguguggugguaaagucuggcuuuuagugcacucaucaccagaguaaugcacauuguacccaacagguaguacuucaucccucacuccucucccaucuuuuagagucuccaguaucuguuauuccacucuguguguguguguauauauauauauauauuuuuuuaaauuauaaaaguauuguuguaaugaaugguuggauauaaauuuaaaaugucuuaaugugcuaauuuaaagguuuguucuuuuuuuguugguuuauuuuauugauacuaccagauacauauagucauauagucagggugaccagauuucccugaggccuaagaccauccuaguucauaccuguucucuuggaaaaauaaauagcuucccauuguacuuucagaaacagcucaguuugaugcugcauuauaccaucaccccauguauagcuuaccaaguccuuuguguauacaggcaccccugucccgaggaggaaauccaccucgcauuaucugucuucuccaauugcuaagguuugaaaggugacagcauagguggagucuguggcucagaggaccaugguguagacagucuuugggaaaggcagaaagagggcgaggggagagcugagacuucuccuuccaagcaaauaucccaguauuucucccaaccaucuccuaguccaguuagcagaaucccuaucagauaauaccaugauacuuguucauauguccuucuguauuucugcaaauguauugacuacaguauuuuuaaaaagcaaguuuuggcuggguccaugguggcucacgccuauaaucccagcacuuugggaggccaaggugggcugauccugaggucaggaguucaagaccagccuggccaacauggugaaaccccgucucuacuaaaaauacaaaaaaauuagcugggcgugguggcgggugccuguaaucccugcuacucgggaggcugaggcaggagaaucgcuugaaccugggaggcagagguugcagugagccaagcgccacugcacucuagccggggggacaagagcgagacugugucucaacaaaaaaaaaaaaagaaaaagcagguuuucauucuguaaguuuuagaauguuaggguuaaaggcguaauagauuuuauuaugcuucuuauuuaauagauuuuauuauuaaaaguucagucucuuuuuagauaaggcaaucuaaucccacaaaaacgaacuuaacuccaaaguaauucagauagucaaggacagaauuuagaccagagcuaaggucuuuugaaucuuaaucuggaguuauucuauauauuuuauauuaaaaaaucuguuuuccaaaaaagaauaugcauuguauaagcaaguaccugugaaacuaaaaugagagaacagguaauaagcacuucuuaaaagaaaauaaauaaauaaauaaauaaaaauaagcacuucuuguucuuaagugccuaagaucaagucucuugaucuguuaaagcaacaaaguuggguaagugcaauuucagacuuaugguaguaaaugcugacuauagcauuguuuuagcauuuaguuccuuguaaugauaaagacagacaauuucuaacaauguguaccuucucauuuccuucuauuugaauauuuguaucuaauaagauaaauaucuugccaaguuucauaaacaccuauugaauaaagauuaauuucauugaaaauucauacauugguuucacaacaacaugaggcaacuguuaacaccuguuuuugcuucuggccagaucuggauguguggcgguaagcucuucaucaucccuugcucuagaguaggacacauuuuccgaaaaaggcgaccauauggaucucccgaaggccaggacaccaugacacacaacucuuugcggcuggcacaugucugguuggaugaauacaaggugagaugaaauuucuuguuuagaaggaugaaugauaggccggcagugacuggccuagugauagcuuuaguugcuuacuuuucacucuggcauauuucucuugguuaaccuucaccuuagggccaacucuuucuaguuuccccccacccccuucaccuaguacuucacuucuuucugguucuaaucugacucuuuuaauuuuguaagugucuacuccauaagaaguaaugcggcuaauguuggaagaaauuccaucuucaguuucuuuauuccgucuggucucucuauugugacgccugcaaaaguuggcuuucuuuuuuuuuuuuuuuuuuuuuuuuuuuuuuuuuuuuuuuuuugagacagggucuugcuuugucacccaggcaggagugcaguggugugaucacggcucacugcagccucagucuccugggcucaagugauccuacugcuucagccucccaaguagcugggacuauaggcaugugcuaccaugccuggauaauuuuuuuuaaaaaguguuuuuuuuuuuguuuguuuguuuuuuuagagaugggaucucacuguguugcccaggcuggucuugagcucuugggcucaaaagauccuccugccuuggccucccgaagugcugggacuacgugugugagccacugugccaggccuggccuuuucuuuuacucauuggacuucguggugacccaaucccguuucuuccccuguuagagggcacauuuagaauuacuucccacuuucucuucugccuuaggucacuuuauauauuuucuuuguaaugauuuauugaaguauaauccaaaaauugauuuuggaauauuuuaucacugcaaaaagaaguccauagccuucgaucaucuccccaaagucucccucucugccucagcccuagacagccaauaagcaaccauuaaucuacuccuugucucuacuuaauuugccuuuucuggauauuuccuacaaauggaaucauaaacuauguggucuuuucugucuggcuucuucaguugagcauggcguuuucagguucauccgugccguuccauguaugggucugcauuccuuuuuauugccaaauaauauuccauuguaugaacagaccacauuuuacuuuauccaccagcugaucaacauuuagguuguuuccacuuuuuuuuuuuuuuugagacagaguuucacucuuguugcccaggcugaagugcaacggcgcaaucucggcucacugcaaccuccaccuccuggguucgagugauucuccugccucagccucagccucccgaguagcugggauuacaggugugagccaccacgccugguugcugcuguauuuguguauagcuauuuuuuaaacauuuguugugcaccuccuguaugccaggcucuguguuagggcgugagccaccacgccugguugcugcuguauuuguguauagcuauuuuuuaaacauuuguugugcaccuccuguaugccaggcucuguguuagguuuugggggauaaaagaugaauaaggaagugcacaguaauuuuucacaccgugagggaaaugucaacagagacauguagcuugugcuggaaugacagggacacaguggugcacuguguuugggggcaguagggacuccacagugcuucuccuacagcacuguuuaucuccccucucccuccuugaccagacuuugaggucuaauuccaugcucaucucugaaucaucacuggcuaccauaguucucaacacauggucccacuccuagccacucuuugaggaggucugccaguuuaaacucauuuucauagucagguuaauacaguauuugccucuuugaccguguugacauugcacugaguguguaaaaucaggggaguaaaguggcuggugccuuagcauaaaucgaggcaucagcacccaguuauacuguagucacugcauucuucaccagcacucacucagaagacaaaggccagcugcauuuccgaauaucauugauauaauaauaauuuuaguaaaucucaaugugccuuuuuaguauccugugugaguaugcgugcucauacaaaaagcacuucugcuguguacugaaguacggugcuugguucaaggaaaaacacuugugcaguuguuugaguuaugggcggagcuagcggcugcucuccagaacacucuuuuuauauguuaagacugacucacaaaccauaguuacucguauuuggguaaaacgaacuaaauaaugaaaaugaaaacaacugacaguauuuguugcaaaugacaaaauucaagcccucaagugaaaauuagaauuuugaaaaacuuacauuuaccgccaggagcuugacagcuuccuaguacuuaaaaauuuuacuuggccgggugcgguggcgcaugccuguaaucccagcacuuugcgaggccgaggcaggaggaucaccugaggucgggaguuugagaccagccugaccaacauggagaaaccccaucucuacuaaaaauacaaaauuagccgggugugguggcgcaugccuguaguuccagcuacucaggaggcugaggcaggagaaucgcuugaaccugggagguggagguuguggugugccgagaucgugccauuguacuccagccugggcaacaagagugaaacuccaucucaaaaaaaauuuacugaggagaucagugguuuuauauauaauuuuuugauauuguauagugaaauuuuucaauauuugguagaacaguacaauccaguggaguaguauuuuccaaaugacuaauccacacuguuacaaaaacggguggaagauccauucagagagcaagacagaccaggagauauuauuuaacuuuauuuaucuuuguuuuuugaaucagagucuuacucuguugcccaggcuguagugcaguggcacgaucucaauucacugcaaccuccaccucccagguucaagugauucugcagccucggcccccaaggagcaugcgccaccacucccaacuaauuuuuguauuuuuucguagagacacgguuucaccauguuuggccaggcgggucucaaacuccugaccuuaagugauccgccugccuuggccucccaaagugcugggauuacaagugugagccacugcgccuggccgauagaccaguacauuuuaaugcaacaguguaaaaaucuuaauaugauuucauauuccacaucguaacuagacuucgaaaguuauugaauuuuggaguaguauuaaccccauaauuauauauagguuguaauuuuaaaaauacauauauuuaaccaaaacaacacacugcaacaggcuaaaugcagaugugagaauuuagcuggcuuguuuuaagccagccagccagcaaaaagguuugcaaaaauagaaagcagugucacuguucucacuacauuuuguguuuguaaugaguauuuaauuauuuuaaggaauuaauaauuuguagguuucucuguuuuaauuucugugugauaaauaugaacagacacagcccacacacgcagacccuccugggaguuuuccguaauuuuuaagaacaucgaugacugagacucacgaguuugagacccacugaucucauauauacgccuguuucauugauucucagauacaguuuaagguacauguuauuaucauuguuaguaauggacuuaaucguguaaaaaaucucuauauaguuguaucaucauuuuuaacaaaaaauucgauuuucuuauuuuuacuuuuuuuaaauucaggagcaguauuuuuccuuaagaccugaccugaagacgaaaagcuauggcaauaucagugagcguguggaacugagaaagaaguugggcuguaaaucauuuaaaugguauuuggauaauguauacccagagaugcagauaucugggucccacgccaaaccccaacaacccauuuuugucaauagagggccaaaacgacccaaaguccuucaacguggaaggguaagaaagcuguuuuuuccaaguggcuuaugaaaagcguuugauaugaaaaguuuugagguguccauaagcuaugacaggugacacuguggacuuaacagaguguaaugacaggcuucagcuugccuuucauuauauucucuuuaugggaacuucucuacgcaaguguaggaccucaaguguagauccuugccuugccggcauagcugccuucugugaggguaaguuaugugacgcuuuccaagagcgcagaggcauaugggaauacaccccggacagaggccauggaagugucaacuucgugugucagaggccaggccaacaaguggagaaauggggcagugaucugcuauuugcucuuagcucugggaaccaaaucacagagcagaggugguagugagggucagaguggggacauggauuucaugccugguguucccagaagucaucugagcucagcagaaagcacauugaucaaccacauuuccuuagcugucuuugugucuuaaacucauuacaguuauauagucacaguuaaauuguagggguccggccauaaaaucauccccuucuccugagucaucucuuagaguuggcuucuaaaagcuaagggcagguacugucuguguugcccagugucccuucuuuuaugaagaaggcacuucucccagagcagugucaacucucccucaguggcuaggaggaagccuagagcuuucccccuuccucuucucucuacccuauaauaagacaaaaacaaacccaguaucaggauguuuagugucagguguuuuucucuaaguaggagagagcagugugugcccauguaguugaucgcuuaccauuauuauuucuugcuguuugucucacccucgcaguucugugauaguugucaccggugucucuccaguguagcaugcauauugcauuucauuguguacuuuuuuauacauguuguucuuauaucccugacuucauuugaagguucuuuagggcagggaugacauuuuaauuucuuucaucugcuguagauuaguaaacauguauauguagcuagaauuccuagcugacacugucugcauguuaaaacugcuaauaacuuuuggaguuauaacuuuugucuaucuugaugcuccuguguucugaggcuagaacuuaggaauuaaaaaugcauauauuuuuaugagccuuggaauucguaccuccggaauaaccuuucacauuuugccuggaaccaccuccaggcuugggaggcgucucugggauuguuucccacauucugagcugugccuucucuuacagcucuaucaccuccagaccaacaaaugccugguggcccagggccgcccaagucagaagggaggucucguggugcuuaaggccugugacuacagugacccaaaucaggugagugacaccucggggcucacagccaguguccgcaaggaggcuuccaguguagggaagcugcugccagucacuccugaggacaucagugucuacuauucuggcuuuucuuaacccauuucuguguaguguugcguuauuggaacgcuaagcuuauggggguuaucuauauccuagugcucaaggucaccgccagggucugauuuuucaccgaaaaaaacugcaaccuccagcauaaauggguuaaaaggaagagaguggccuuagaugacaccucagucagcuacuuucgucuccuuuguauguuuuuccuaucucugcucgucgucauagagcauuuuaguuguuuacaccauuauuuguacuuucuaauauuaugcggaauaaauugugacuuacgagccauaggaauuuguuagaaauggccaagggaagcacuacagaauuucaguugauuccauucaccuaauuucauuucagcuuauguaugucuccuaaauaauauuaaaacgggccuaaaaaucagcaaauaacuucaguuuagaacgguaauuucaaacucguuuaugucugauaaaauagcauaauggaacagcagucuaaucucauaaauuguagugucucauuucuauuuuagugguggguuggugucacucagaaaggaaaaaaaaagccacuugggcuuuuggguaaauaaugugugcugugaugugugcugugagaugucauccagcgcuccaccagaagaggucacgcccacugucucaggugauacguguguugaaaauguaguuuaaaagggauuucuggggcccagugcagaggcucaugccuguaaucccagcacuuugggaggaugaggugggcggaucacaaggucaggaguucaagaccagccugaccaacaugaugaaaccccaucucuacuaaaaauacaaaaaaaauuagcugggugugguggugcgugccuguaaucccagcuacucaggaggcugaggcaggggaauugguucaaccugggaggcugagguugcaguaagcaaagauuguaccacugcacuccagccuagugacagaguaagacucugucucaaaaaaaagaagggauuucugugcaucuucuggguagaagagguggcaguguuguggaaguauuaaaaucgcggugacgcaguuucagugguguaggucacagugagaugagagcugaaauuuguuccagaaaauauaaguuggggugauggaguuauccuauucuaaggcuaacuuaguuaugcuuauugcuuaguuaugcuuauaugcauaguugugcuaauucuguagccacuagucacauuucaaguguacaauagcugcauguggccaguagcucccuuauuggacacaggcuaugagacaauaacaguguugcagaaaauucucucacagcucccuaugacucugauucagggucuucauauuagugaacacugcacacauccauuuggguucuaugaguugaagcaaugaguaaauagaacagaagagaauagguuccuuuugagcauagugauggcgcauguuggagagugaguuguucacugcacuugccaugucacccaguuguguuccugaagauaaucugugauucagccugugcacuuccugacugccccgaugaggcaucgacgaaaauggcagccgugugcccuucugucuccagagggucagccagaggcugucgggcuccucugucaccuacacaguccaggaauuaagagaguuauguaauuguuaaacccuaaaauuggaaaagaguuaauucagucaaauucaaugaacaaaauucagccacugcuuagguuucuucccagaauagcaccucacuuucuccugccuuagcuaucugaaguggaaugaaccaaguugaaaucugcuucccuguaagucuagugcauuggucuguuucugcuuugagaccuuacagaaucaauauguggaagaauaugcaaaguguuguucagucuuaaaauucguuaucuaaauuuuauuuuauuuuucuucucuagaucuggaucuauaaugaagagcaugaauugguuuuaaauagucuccuuugucuagauaugucagagacucgcucaucagacccgccacggcucaugaaaugccacgggucaggaggaucccagcaguggaccuuuggggugaggagugcucggugauguugggagaaugcgcagaggcccacaagguugagugagggaguguggcagaugaacucauuuucuaccuuggggguggucuucucagucugcaguacagugguccccccagaaaccacagguaguacaaacccuguauauacuguauuucuuucuagagauacaccugugauaaauuuaucaauuaggcacaguaagagguucacaacaauaacugaaaugaaacggaacaguuagaacagcauacugugguugcgcaguggcucccgccuguaaucccagcacugagaaggcggaggugggcggaucgccguagcccaacagccuguuuguuuucucuauaaaaacaaaucaguauacuauaauacaaauugugauugcggucagaaaauaucuuauuguauugugcugcagauaacaaacagcagaaaacuaaccuuuggcuaagaggggacuauuguaucccuuaaucugaauucuuaagugcuccaucucuccucuggauuuccauguuuugccaguaauuggcaguauuuuuuuguugcuaccuuuuuuucagaaaaacaaucggcuauaccaggugucgguuggacagugccugagagcaguggauccccugggucagaagggcucugucgccauggcgaucugcgauggcuccucuucacagcaguggcauuuggaagguuaagguggaugcuguggugggaacguugcuucaucaggcguugccuccgguguggaguuuggggcuuuaggaaagccuggguuggguggagcagaaccaucuuggagaagaugacaguucccuguccucccggagaugccuggguguguuagcagaggugacacgugucugacagagacgggagcucugaguguccacgggugaagaagugaguguccacgggugaagaagugaguauguuucaccuggacauuaaggugauguuugagcugcuguuaaggaauuucuugcuuauagaggcaaaccacaguaucauuuuaacucuagaauugggcuuguacagaaggauaaaacccaggaaaauggauauuucuauucagauuuauuuaugccucuuuuuaauccccuuuaaugaugcagugguuuuuaucugaucaggaacuugucaugauuuccuuucuuagacuucauaggagauagugcuuuaaaaaaaaaaaaaacuucuauuauuuguuuaguauguuguaaguagaucauuuuaaaaaacugaaucuauauuauguuuaacuucagaaggcaucauuuauaagacaguauggcaguuaauuauaaaauuauuuugaugaauuaugauacaaucuacauaauaaagaauccuuuugauuauu
